United States Patent 7,365,185 (GENOMIC PLANT SEQUENCES AND USES THEREOF) - sequence listing, part 20

SEQ ID NO: 48634 - DNA, 1501 bp, Oryza sativa
ccagatcactgtctgccatcaaggctgtcaacatttcaaccatggcaaagatttgctctgaatattctgtggtatctggactgtcctgatcgatcacgactggagatttgcgcctaccgtgatcaaccaatgacttgggcacttgttgactagctaaatttctcgttatattccatcaaaattccaacatatacttagccgtcaaatgggttatgcataccagctgattaactttcagtcaagtatatattgtacggattcaaactttttacaatgctttgttcaagttttttcaggaatacacaagaaacgcattttttttcattaagagaaataaaagttatatacaaagtaaattaaaaatcagcaggagaccaaaacatgagaagcaaacaagaagaaaaataagttggctaccacgacctcgcaacggcaaaatgaagggaatcgttgagtttgctgctcaccaaagcaccgcttcctcaacctttccctttgccacctcgacccaaggcctgttctgttgatcgaatacccgattgtttcattctttttcaaatcgtccaagccaccagcgttgcgacagtgtcaaatcctcggtgatgtgacttaggaatcttcattcggcttctgcaaagtcagaggtggaaagatgtctcgtttagaggcaagcagtctggatgctctatcgctctcaacgtctaccaccaaagttgcctttgattccgagcaagctaccaaaatatggtcaatgctttcatcttgctgatcgcagaggacacaacgatccaggtgtggcaacccacggttgcgtaaaacgatcggttgtctagcatctgttcatagctaccaaccatatgaagaaatgacgttgaggcggggcgagcgatttccagattggggctgagagaaaggaccgaagaacatggccttatatataggttgatctggaattgtattggcccaaactctcccatttccaactgagtgaatctgggttggtggtactgcgatcaacagattgaacaagcgaccaaagcttgaggtagtccgggatggcctggatacccaacgccccacatatgtctctgatccatctgcgatccagcagcgcttctgccaccgtccgatgccagcgcacgtgggccggaacatgatcgtacgtagatggaaggggcaatagatcgaacgcaaccttcttgcagccaattgtctttccagaagaggatcatgtgtccattacccaggtgaacttgaacaaagctgcgacgtaaagaattttgtcgcagctttgttcattttcaatgatcaatcttcagtccagtacagaaaccagcagaactttgatttcaggacatcacagatctgcacaatgcgcgtaaaattcaccgataaattgaataagacaccagtttaatccgtcaaaaacgtcttctgcgtcagattgcacagttaatttcgcggaaaaatatcatcaacttggtcgatcatactcatctga

SEQ ID NO: 48635 - DNA, 1501 bp, Oryza sativa
atacatcatataagctaacaagttgacttaaaagtctaagccagtaagcttaaagcctaaacaaagagggccttagagcaggtacaataacatgctataagccagctgcaaacatattttaaggagataaatcaggagagagaagagcagcgggctacagatttatagctagctgtagtacggactccaagacgcagtgtgtctatgacaggtgggactaggtattaatagtgtagcatataactattgtatgaataagctattagattggctataaatgaattggagccagtagttggctatactattgaacttactcttagaagataagaggaggaaaagaggaataactagtgattttttttcatggatgcgtgctgtaccttcttcacggttgtgtgaggaattactagctggcaacggtgttgtgtttatttttttataatatccatgattgtaatcctgtatttttctctgtctattgatataaaaattcacactgtatggtgcggtcgttatgaaaaaaaaacatttgttgatttgtacgattgaatatttatcgcaattcatttatctagtcatcattccattaaattctgcaggcacacttcacctgatgtttgtgcggtcacaatcagtgtctaaaccctaaaaaaataaattactactccctccgtcccataatataagggattttgagtttttgcttgtaacgtttgaccactcgtcttattcaaagttttttgaaattattatttattttattggtgacttactttattatctacagtattttaaatacaacttttcgttttttaagtactttaagttcaactttattatctacagtgtgatcatctttgtttaggctaaaacttactggcttaagcccacagttaaatgctctaatatcatttttcttagaaatcggcatacaattttcaaaaactatatattcctccttggtggaacgcgaaatgttatactgacccttgattgcataccatttaaaagggaaacttcttctaacactaaaatatgcaacaattgcaggggcctaaacgaaagaaaccaccaaaatctctccttacttaacaaatccccttcccgttcccactgcacactcctcgccgccatccccaaacctcccgacgatcccaccgcctcgaacgtgccgccgttccagcctagggttcgcgggctctccggctgccggattcgcctcctcgccggcgggtaaggcggctgagggggagtgccggggcgctccgcatcgctccctccctccctcccgtcgtcgtcgccggcggcgtcgggtcgggcccggcggtatcgtcccgcggaaaccctagatttcgccgccgcacgcgtggagcaatcgtgcggctcctggtgtccctctatggctatgtaaggaggggattccacctccccccttgtgaggctctctcggcataaccgctctcgcgttctagggtttgcgccgcctcgactgcaatgg

SEQ ID NO: 48636 - DNA, 1501 bp, Oryza sativa
cctccacgacactaatcccaaccagaatcacctctgccccctaatttgccactaatgacaagcttatacaatatgtggtcaaagccgcgaccggtctgaccacgtcccttcgccgttgatcgagtcgacgtggctttcctgacgccgtcgacgatcgatcgagcaggccatcgatctggtcgtccgtaattcatctactaaccgcttgcggctgcaggttcgcgcgcacgcacgcacgcgttgcatttgcctagtccttcgggttggtgtggcttctgaaaccgactcctcccccactcttctcccacgcaaatctgaaattgtgaagtgagcggtttgcctttaggcttatatatacggagaccttaacaccacgcagagagagagggaggagacgcgcgcgcgcaggttcagatagtttcaggcttgggaggaaggaaggagaggcagagagagaatttttgtctgagagaattcagatttcagagagataattttcgtctgaagaattgtgtatcgatcgatgtctggtggtgtgatcagcatggtggtcgcgccatggattctcgcttgcgggttcttgctctgctcatcctccttcctcggtgagaacagttctcagttcattggttcatctttctgttttttttttcaggttttttaccttgcttgcaatttcttctgttttctttacctcaagggtgatcggttagcttcaatctatacatgagttcatctgaggtttagaattacgtttaatctcttatagtagattatagtgtatgaatggttacagcatgtttctcatagctagagtcgcagtttcttcaatctgttcttgacgtctagctagctactttcatcgcgttctgttcatagcagtttttttttctttttttgaagaacgttcatagctaggttggttttgtctcccatcacgtcttgttttgtttcttgatttgagcttatactgccattagggtaaaggattttcttttaactttgagggatcctttgggataaagatggcgccaaatgtctgcttcgataattaattatcgattgcaggtagagccgtataggtggttgccaggcttattctttgtgttcttggttaggtttcttaaagaaagaaatccatcctgctgaggaaacactgcatgattggtttcaggaggaatgctgcgactgtagctatatttattttgtgggttttcaattttttaattacccatttatcgtactggacaaaacttcggtaatactccagtatttaggagaaggaaaaggataacaacaatattgacatcagcatcctgattggacagatttcgattacagtacaaatatatttcgtatggttcagaaaaataactgtatctagtccactgggcctatgatgcgttcttacttccttagaccagttctgttctttcagtaaaagtttggctaaacctacctaaataatttaaataggtcatatctgccattatttattaga

SEQ ID NO: 48637 - DNA, 1501 bp, Oryza sativa
tgtgtccattttttttagaattttctgtaaaatttgttagttggcatgcacagagtgtacacaacaagcttgttgcatagagtattaattcaaagcatatatacttacatgacacatctatccatccataccgaagaattaatcaatgcttctaattaatgtcatgacatcgatcgatacatatgatacaaaatgatcattgttgatgaaccaatgaactttagtaaatctgtaatgccgttgtaacttatatacggcctggccaatttattcgaacctgacgaacaaaattaaaaaatcaattgaagcgtgtgcttaatattaatccccctgtactctgcagattccgcagcttgcattgcataactcgatcatctcctccagctacggcggccgtgtcggccggccggccggacttacgggcacgtgacacccggtgggcaattcccggcgccgccgccgttggtgcagcaggacgggacagagccggcgagctgaacggcggcgaagccgccgtgccgagtcgtcgccgccgccgccgctcccttcgcctgtgggttccagccgtgcaccggcctggccgccgccgcctcgtgcagcgtcgccgagaggatgatcgccgccacggcgagtgccgccatgatcaccctcatcaccgccgacgatcttgccatcgctgccgacgtgtacgtgcaggagactgcagctaattagttatagctggattaatatatagttaatacaggtgatcgatcgatcgagggagatagagatctctatattgcctgtgtggattcgatgagctcaaacatgaaagcacggaggtgtttatatactggcagctgcctagctacatgcacgcacgcatatatgcgagattgatcgaggaattaactgggaattttctgggaatattgttcaacttagggcagcaataaaacaatcgtttcctgcagctactacgttattcttggaggatacgattaatgcacccaacaagtatgaaccgaccgaccatcgaaagctagtgagatcgaccggtagtccacaactccagtcatcacacgttttcagatagaaaaacccagctagttgtagacataaatgcatgcatgcgaaagtctcttaaatttgcccctcgagaacgtctccccctcgtttttcatgtcctcttaaaattatttaaaaattgaaaaaaattaaatcaatgtgtaatatatcactccaaaatttaaccaacattaatagagttaaaaataataaatttggctctgaataaaacacatagttcaattcacacttccgttcctacatatatacctgcgtcgttgcatgcactgaagaattaatatatgtgcatttatagtacattgtagtaatattcagatttaactagcaaattaagaccggccgggccagcttgcatgctgatcgaattgctgattacatcaatactattacgtaagcaaaaatgaacatatattgtgctggtaatttggca

SEQ ID NO: 48638 - DNA, 301 bp, Oryza sativa
tccgcctcgccgcgccgcgccggccgccggcgagaaggggggagagagagagaggcggatcgatttggggattttttccgagagggatgattcgggaaaggattaatgggcttcgttgtgggtgggttagccttgtagcctcggcctgttgggcctcgaaatgctaggttaccccatctgggccgtcgatgttagatcggacggtcgtcgagtcggatacccaccactatcccagcacgcggcctgggagccgcacggccgcaacccaccaccactcccgaagcttctctcatggcggcca

SEQ ID NO: 48639 - DNA, 378 bp, Oryza sativa
gacgaatcttttgagtctaattaattcgccattagcacatgtgggttactgtagcacttatagctaatcatagactaattaggctcaaaaatcgcgatttctccctaactgtgcaattagtttttcttttaatctacatttaatgcttcatgcatgtgttcaaagattcgatgtgatgtttttgggaaaaacttttttttaactaaacgaggccttatgggggcattttgtaattacgaaagattaggggggaacttttgtaatttgctcgtactatatataatcagctaaggcgaaataactttctgaaatctccgatagccagcaaacaaagcagggcgggaagcaggaggagagggagagaggaagcggcggcca

SEQ ID NO: 48640 - DNA, 438 bp, Oryza sativa
ctcattatgctaggaattatgctaggaattcatgtgtattcattttcttatgggatatcaatgggatgaagagtttatgagaattaatccatttgactagggaattggtaacttatatcaattactcctaattgatggatggttgatggttgtgtagtggaggatggttcatggctagttgatgacaattagttgctctattcctcttcctattccattggtaacctacatcaattactcctcattaatggttggttgatggttgtgtagtggaggatggttgatggctaattgatgagaattaattattccatgactcttacccttcatcttccattccttctataaaatgagaatggatttgatctccctaagaagaagtgagacacactttcatccatttccaaggctgttgctgctacaataatcccatcccga

SEQ ID NO: 48641 - DNA, 426 bp, Oryza sativa
aagtatgtttaatcccacaaggaacaaaacaatgaaacccatatccctcacaaacaacacagtcaacagacaacattgttgataagaaacccaacgaatctaagagaatacaaggaaacccaacctaaaccaaatagaaaacaatccatctctaaaacatccagattggaaaaaagaaaaaaaaagaaatacatcactactgctttactttaagcattttctaatttttatcacctaacctaaacaagcaagccctacaatcaacggcatgaatgggaaacaacaggtccggttagatttcatgggaacatacatttataaggcctttactttaccctaatccctaaaatcagtgcaaggcaacgatatctgatgtaaattaggttccgagatcaacttggtctgggcgtttgtgcaaggggacca

SEQ ID NO: 48642 - DNA, 1501 bp, Oryza sativa
acattaataaaagtaatatgcaaaattgaaagatctcatgtatatacagagagttagatttgccaacatccaaaatagaaaaaagaagacaaaaatattattgatcaatgttgaacacatgagagtcagcgtttgtcactcgcagacaatccgatggagtactacgtcctagtacaatgaatctaacaaagtgtcacatcaactctcaggccccctttgattcaaaagaaattcataggaattttagaggatttcattcctataggaatttttcctacaaagccctttgaatcaaaggaatgaaccctatggaataatatgaaattcttatggaatgcctcttcccatacaagttttggaagaattttaacaagaggtagaacctcatgaaagaaatcctttgagtttttatctctcctcaaattcctgtatttttcctgtggtccaatcaaacggtcattcctatatttttcctgtgttttgcaatcctctgttttacacttatattccagtcagaatcctatgtttttccaattcctccgttttttcattcctgtgattcaaatggcccttaggttggctttttttgacggagggagtatctcctgtcgctaattttcgtttggaataataatcaacgaattaatgctgaacgtccattcgtttttctcactcgtttgacacgactagctgatcatcactgtggccacgtgttatatatgttcatcggtgatgcgacactcaaagccggccgtctcctagtcgtcgaaactactggtcttcctcgttgactacaatatgaccaagagagtttacttccgggttatatatatgtacatgccaaattaccagcacaatatatgttcatttttgcttacgtaatagtattgatgtaatcagcaattcgatcagcatgcaagctggcccggccggtcttaatttgctagttaaatctgaatattactacaatgtactataaatgcacatatattaattcttcagtgcatgcaacgacgcaggtatatatgtaggaacggaagtgtgaattgaactatgtgttttattcagagccaaatttattatttttaactctattaatgttggttaaattttggagtgatatattacacattgatttaatttttttcaatttttaaataattttaagaggacatgaaaaacgagggggagacgttctcgaggggcaaatttaagagactttcgcatgcatgcatttatgtctacaactagctgggtttttctatctgaaaacgtgtgatgactggagttgtggactaccggtcgatctcactagctttcgatggtcggtcggttcatacttgttgggtgcattaatcgtatcctccaagaataacgtagtagctgcaggaaacgattgttttattgctgccctaagttgaacaatattcccagaaaattcccagttaattcctcgatcaatctcgcatatatgcgtgcgtgcatgtagctaggcagctgc

SEQ ID NO: 48643 - DNA, 198 bp, Oryza sativa
ccaaccacaatattagataccattccattgtatactaaagcctacatacagattttagcttcactggtatgatcatacaatgatacttcctccatttttctttatttgacatccaacgtcaaacaaaaaaaaatagaggtagtattaaaatggcgttgtcaatccattcaactcctttctaggtgagatagcccacat

SEQ ID NO: 48644 - DNA, 281 bp, Oryza sativa
agtatacagcaagataggatcttctaccctttttaacttaaagaagtcaagggggccccttaattgtccaaccatctcggatcatcggggcatctgacctgtaaaagtatcaactagggtattatcgtttatcgggatcaatgatccaccttcagtaggaatgtgacaggaacctttcttgggaggggcaaaatatttatgggtgaaatctttgccttcgggccggcaacgatgcctgtgggtgccgttttcctcttggggcgttgctgcataatctcatc

SEQ ID NO: 48645 - DNA, 206 bp, Oryza sativa
tttcttgttcaattttttagtggtgaatgggtaaatttaagttaattagacatgtgggaaatttggttgtcagtacttcctccatcccagggtagtactaggttgctatattttgggacggatggagtattatatgttggctacctaattttctctatttaagtcctatcttaaaaattgcctctggtaaatctgttacttgcagc

SEQ ID NO: 48646 - DNA, 281 bp, Oryza sativa
ggattgaatatatataatactgtagtgacgcatctggttcttcaaagagcaatattctcagatgctgtcttcctaaagatcaaactgctgaccttttgaaagcagactctagagagtagagacacacaaagcagacactactataataagtgtcggctagttacacgcagtagatgactctccagtaaatcaaatggtcttcagtgctccagttcgatcaaaacttacacaatcaaatattctatcagttgtgttaaatacaaaaattctatccttgcctt

SEQ ID NO: 48647 - DNA, 279 bp, Oryza sativa
acaggcaagttatatatttttaaattatcttgctagtgtcacaacactagagttatcacatgtttctctgatttgtttgaacagcctgattgcaaacttaggtggtagtattaagctagattatctggttttataggaaattcggagatcttttttagctttccttttctattatgcatttttttaagctactcatatgtggcatagaacctattttttgacctataatttcccaagtatcacaagtaactctttgtttgtcttcatggctaatttaaa

SEQ ID NO: 48648 - DNA, 244 bp, Oryza sativa
ttatgagataccggtttataggaaacaaagttttgatcaggtagaatctgagttcatgcttgtttatggtttgcagggttcagaggctcagaaatttcaggctgcctctttttaaagcagcataaaaccagtgagttgctatcgattaaaggccgctatatcactgaaatgtgttggatttatgatcttttggtttgtaaacctatctgcacaatgtttcgctcgatttgggttctgttacagg

SEQ ID NO: 48649 - DNA, 952 bp, Oryza sativa
gcgaggagattcgccgggttcatccaaccagcacgtgagacgccggtgtttgctggaactttccgtcgccgtaagcacacgcgtgtcgattcgcgtcgatccgcccgctgccgaagcgacgtccggtcgctgcggcgcgcgattcgctcggtagtcactcacaagatcagagctgttgcggtgcggagcttttgcttggaccaaagataaaaaggcaaaatcttctcttgctctaaacggtactccactcgggaaaacttaaatcatccctataagagatatccctttatttttcatgttacttaaaaagtcatcaaaaaaattataaaaaatagtagaatagatcaatatgtgatatgttactttacaaacatgcaaattcaaattcaacttatacaagtagaaacaaaaaataacaaatttgactatgaagtgaacgcgtaattcacggtcaaatttattatttttgttttgaattgtataactcgaattttgactcacatgtttgcgaaaagatatatcatatattgatctatcttgataaattttaaaaatatttgataattttataaatgacatgcacaaaatgaggggatgtctcctcgaggaaaaaaaatccgcttccactccactcaatcttgtagctaggagttgacgaaaagctcgtaactcgttaactcggctcataacaagctcggttcaactcagctcggcttgtttcattttcctaacgagtcgagctggtattttagctcgttagaaataacgagccaactcgagctggatcgcgagccgtcgagcctaaacgagctaggatgacatcaagtcggatggccaacatggacatcctttcggcccaactaggcccatctcggccatgatacaacggtgttatcatatgatgcgcgtggccagcctaactctcgttatctcatatacataaaccgataga

SEQ ID NO: 48650 - DNA, 367 bp, Oryza sativa
atggtttgcatgtaaatcgcgagacgaatcttttgagctaattacgccatgatttgataatgtggtgctacagtaaacatttgctaataacgaattaattaggtttaatagattcgtctcgcagtttacagatggaatctgtaatttgttttgttattagtctatgtttaatatttaaatatttgtccgtatactttaaaaaaatttggcacacgaactaaacacagcctgtatattatcccttattattattattattattactcccctacttgacgacaactagtactttttttgcggggagacggcgactagtattgtactccttttttcattacataatcgtatactccctccgtttcacagt

SEQ ID NO: 48651 - DNA, 175 bp, Oryza sativa
gaaccctacaaatttggtattaattgtgcaaatattttacgtgtaacttttagagatatggaaagtcgggaatggatgtatcattggccgaggtttttgtctccatatagaaacgaagtggctaaatttattggtattgccaaggttcacgctgagaagaacaatatgaggaaga

SEQ ID NO: 48652 - DNA, 270 bp, Oryza sativa
tccatgacattggaatataaaatctccagatctctgcagggccacacactagtactgtcgctagccatggccctggtagtattaactaccactacgtacgcatgttcttgtggacatggattggagtgacctgagaggctggtgagcccttacaaaaatggtgaagcaccctaatcttccatgggagatcgagatcggtacagcatcttccttccttttatattccgcagggtatcaaattggagtattttttctctactcgtgtagcga

SEQ ID NO: 48653 - DNA, 1501 bp, Oryza sativa
ttgtaaactatagtgggtgtgttggcgattaaattggatgccctttcacccctccccgagggtcccttttataccatgaatcatcttgacccccaagaaagacctgaggatattggatctggtacggtgtaaccgaaattctatcccttccgagtaggattttggaaatcacttagactcgtagatatattttccataatttggaatggattccaaatggtatacaaggaaacgatccgtgtacatgaaggtacaccttatctgtatattccataagtcgtaggatagaaggtatgacttatccgtaaccctggcacatagaaggagttgtataagtaatctattataaaaaaaactgcatgctaacttgtaaaaacaatatccaagtgaattcccacagattaagataggcttcactcgttgcaacgcacggatattttttttagtatctctactattataaaagttgaagatgtttttgccggtactttagtacgtcatccgtgtatgagtcggtttttaagttcgttcgcatttggagatacatatccgtatttgagtcaggttttaagttcgttcgcttttataaaatacaggagtcataagaaatctcttttaaaaaaactcgcatgctaacttgagatgatcggactcggactcctaattgcagctcatgattttttcagaaaaatacatatccaagcaaattctcatagtgaatttcgtataaaaataataaaaattaaaatagtcttcacccgttgcaacgcacggacatttttttctagtagagataaaagtttgaaacacaagttggaaatttttaataagtggattagagtagtttggaagtggagtctgatccacctcatccttggagcaagcagggtttttttagaggaacattaaattccattataccactggttcggctaaatcgccggcaaccacctcctccacatctggaggaaaaccatcccagctgaactgagtcgtctgagaactattatagctataggctgctaaagcatgagccactttgttacaattgcgtgggcagtaatggaagctaaaaacattaaaagagttttcacaatgctgtaataggaaaggggtgcgtgtgacatatcatcaatcaataaccagcctaaccgtaccctttttctccttttttttaaaaattttttggtctccttgtttaatttgcacattgtcgtcttgcgattacggctccacgtgagcgcgtgtgcgatcaggaaaacacagtttgccggtaatctcactgttaatctcgcgtttgactatgtcgcgtgcctgctccttccaccgctggtgcctggtttcaccttgtatgcatgccacgtgagatctggtaattttgcaaaaacctccttgctcatgtataaaattttgaactaaccctcgatccaccaccacaaagcgcacaggaacaggaagggaggggggccgccgccgccgtcatactcatatcatatcttct

SEQ ID NO: 48654 - DNA, 1501 bp, Oryza sativa
agcgcgcgacttccccctacctggcacgccagctgtcgagggatgatcctctctagcgggaggtcgtgagacccccctttcgtgagttcagccgggggaagaagctcgcctctagaaatcacgtatctgtccctaaggctcctagctagctcgcacacaaccaaattatacaggttcgggccgctatgaagcgtaacaccctactcctgtgtatgggatttagactgagagttacaagggttcctaaactcaggagaacactcttctcctagagctcaagttcactgagagtcgtcccctttctcggtgggcaatgtcctccttttatatcttaaggggataccacatgcaccgcctctacctactcttctttcgggtggggacccaccctatcttgaccggaactcgacccgtgccttcgcctggaagctaaaccacagcttgcccttgagcggggcccagcgctgtccctcgcctgacacgggggacaaccctgtcattccctcattaatgggtgaagacttgtggtggccgccgtccgaatgaccctccgatgggacgggtcatacctacctctactccgccggaagcagatgcgacatgggagcacggttgtccgtccagtcagacgtgaccggcgtcaggccggtcacagaccggtcattcttgactattgcgcgtcagtttagcacgccgcacgtctaccccactgcattaaatgcgacagggggcagttggggcgctgcgcgcattaaagggggttcagcctgggccccctcctcgctcgctccccctgccaaatggcggctgggcgagggcctcggggcaaagcggtgcaagggcccgaggggcatgacgtggcaccccgaggccccgaccccctcggctgctcctgcggttcgcggaatgcgggggcaggaccaggctgtagggacacgtggcaggatgggaaggtagatttccctcatttcgcatacctccgggtccatatctccgacaaacataaacattaatccagtttgaaggaaaacgctatgagatgctagattgtgcaaaaaaaaaatctaacaagtgattgaggacgtgtttagaaagtctatgggtttggcaccaatgacaaggaggcttaatggaatgtgtttcttagataattctggtgaaatggatgttgatttggtaactcctctttagatagacattttatgtgttgctaactcttctcttgatcaaatatcttggtggcgcactagtgttttctgttgcctctactctttatgctcattcatgttggtcattgatgaacaaacatgcggttatgtaaatgtttatattttgttgtttcttaaaataaaattgagccccctcttttaaaaaatgaagctataggaattcatttggtatctcactttttaagagaagtttcatttgctgtagcctaatatatagtgcccaagaatttctggaagtgacattaacatacataagtaaacctgagcacaac

SEQ ID NO: 48655 - DNA, 1501 bp, Oryza sativa
ttttcagggtggtagatgtctaagctaatataatctagcaacacgatttagccgataccggcagaaaccctaaaacgagaagcaaccgatagagctaaatcgatatgctaagactagattaacagagacatatgataaataggtaggcaagtatatcatccaaaccagagcaatccaagaggtcgaatgtactgatgcagccttgaacaacgccgacgtagacgatacaatggcctgggccagcagaacattggacttatcccttcgccggagatcaaagacgatgcagccccgcgtcgggtgccaagttccgccggaacgtaaaaacaaaagtagaaataaaagggtggcgatgcgccgaattgtattgatcgtgagaatcgattacatagaccccgggtgtacatatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactaccatgccgcatcctctttaaactcggtcacttagggataagcttcctttaatagattgatttccttaatcgaatatagcaggaatccgactattggcgactttataactcccatcggctgattccgagatgctgcagccgataatgattctaagccgatgacgtctttgccgattaccaaatttcactgttaacaaggggcatgacgtggcaccccgaggccccgacccccccggccgctcctgcggttcacggaatgcgggggcagaaccaggctgtaaggacacgtggcaggatgggaaagtagattcccctcatttcgcatacccccgggcccatatctccgacagtagcccccggcaccacatcggacattggcctcctgaggtcggtctgatgtggtgcctcgcgacttcccaagctggggttgtgggcccggcagggaatctaagcggatgccgccgagtggccgggttggcgtatcaaccacaacagcggtttgaccgccactgaccgcgctgatgatgaggatgcttaaggcgcgaaaatcagggggtcggttagaccacacctcaactccctcgcccgccacgtatgcggcggtactggtgacagttcgcccagattgcgcccgtgaccgccgcacgccctacaccgagtgtgctgttgacaggcgcactaaatgcggggcgaggattcagtgggcgacgtgatgagtggtcgcgataaacgatgaggcaactgcaggcgcgagaatcatgggggcaaccgtgagggcgtgaaacgagaaggcgagcgcgggcgaggcaaggataaaaggatacggaggcggggactttgcctccttccttttgccaactgctcacccgcatactcgctccctaagccctaacattctcgccactccacgctattccgcacgccaagcccctcgtcgtttc

SEQ ID NO: 48656 - DNA, 169 bp, Oryza sativa
aactatagagtaatgtacgcttatttaagtgttttgtgtttccttccgagttcgaacaactgtacactgtgtgtctgtgtacaaacacatgagcaaccgaacatgatgcgcaagaagacgccatgagttgtacgcagctggccggcgatgcgtcgagcagtttccacca

SEQ ID NO: 48657 - DNA, 713 bp, Oryza sativa
aggagagccaacgcctagaccaacgtatagcaatggtagtcttttttcatgagatttcccgtagtattttttcctaaggctgctttgtcgccgggacgacatgtactaaaaacttctttcttaatacacaacaatgtgcaattctctagtgtattagctataaattaacgaatgattatagggatatggaccatactaccatagtgccaagatgcactagctagggtatagaagcttggaacagtagatgccaggtaagccggacgctcaaagcaatccgttagcgttcaggcacagcattctcctggacgagggtaatacaagaccagaagtggccgccgcaaagaagtctccggacgaaggatatccttgtcctgacccgccgcgcactccaattctaaccggctgcctggagtgcaccgaaaggaagctataaaaccaaatcaaaccccatccacccgcggaagcatgcgcgccaacgcactccccacgcgatcccacagccctccgcttcctctcccctttcgcctattcatcggtaaaccaacgcgccgtcgcccacagatattcccccgccctttttctctttaacctctcgcagccagccagccaccatccgaaaacaccagaacccgattccatcccggttgctgttcttataatacgtggagaagaaactagactagcttcttcgccgtgagggctttggtgcc

SEQ ID NO: 48658 - DNA, 1501 bp, Oryza sativa
tgcagaggggaaggatcccgtctagaatcagtgtttgctcggcggtgtccagacccaacacccgccgaatcaccgtcttcgcgtcctcctcgccccaatcccaacgcttgcccacatgcgtgcgcatggggtcgttgggtccagtgtactcccacgcgccacgtgatttatcttggagaggcgcgatgcggcggcagaagtagtcgccaaagaccattgcccccgtaaggcccaggcttcgcaggcccctgaggcgatcccgcaccgcgtcgtactcctcgcccaactccgaaaccgctagccacgtggcggatcgttcgagagggccagcgggaagccgaagttgcgggtggtccggcagcgcggtgtagaaccagtccttcttccagtcctcccatttcttgcggagatgactctcgatgtattgccccgccgtgcctggccagggctggaagtaacatccccccaccaccgcaccttgcagcagttgcgggacgaagaaagactggaacagccgcatcgtcggccgcaccccgatgaacatctcgcatagatgcgcgaagatggccagcgtcatcacggcgttgggtgcgagatgcaaggcatggatttcatagaaatccaaaacctcgtggaataatccggagaatggcgggatcaaccccgccatagcaaaggacaggaggtgcacagatcgctccgggtatcgcggccgcggccacgactcccccgccctcacggcggcgtcttccggcataatcttgcgggggagactaagatgcctatccgccgtaatgcgcgatgccgaaagcactgcgtcgccagcatcttgagccatgatgaccggtggagaaacgacgaggggcttggcgtgcggaatagcgtggagtggcgagaatgttagggcttagggagcgagtatgcgggtgagcagttggcaaaaggaaggaggcaaagtccccgcctccgtatccttttatccttgcctcgcccgcgctcgccttctcgtttcacgccctcacggttgcccccatgattctcgcgcctgcagttgcctcatcgtttatcgcgaccactcatcacgtcgcccactgaatcctcgccccgcatttagtgcgcctgtcaacagcacactcggtgtagggcgtgcggcggtcacgggcgcaatctgggcgaactgtcaccagtaccgccgcatacgtggcgggcgagggagttgaggtgtggtctaaccgaccccctgattttcgcgccttaagcatcctcatcatcagcgcggtcagtggcggtcaaaccgctgttgtggttgatacgccaacccggccactcggcggcatccgcttagattccctgccgggcccacaaccccagcttgggaagtcgcgaggcaccacatcagaccgacctcaggaggccaatgtccgatgtggtgccgggggctactgtcggagatatgggcccgggggtatgcgaaatgaggggaatctactttcccatcctg

SEQ ID NO: 48659 - DNA, 937 bp, Oryza sativa
tactcaaatggagcattatttaaattaaataagttatgggctattttttcaagaaaaacatttcaacttaaatatttaaggtttagtttgatttagattattaccgtggagtgcttacttcgtccctatattttagaacatagagtggctaattaatggtagagataaattaaatatttaaatgaatagcaaaataacatgtgttgcaacgaaggaaggcaggtttaattatgtatgcgtactatatacttcataatatcaaataggaagccccaatggttgcctgtgatcaattagttgatatatgttctgcttttagccgattcatatattgctttatatatttctcttgtgacaagtggatgtatgattgtttgtgaggagaggtaaggagaaaatcaagaagataggtaagactaggcgagccattagtacataattaattgagtattaattattttaaattttaaaaaatgaatttgtatggtttttagagtagcttttatatataaatttttacaaaagacaaatcgtttagtagttcggacaacgtacacgtggaaaatgaggtaaatcttctctcaatcttcaagtgaagaacacgggggatgaaaaagttttaaactacttttattcagactctctacaattatgcgataagttaatttatgtattcaattttaaacatccgcagtgaaacagtgcttaaatattgctgctgagaattatctgatcaaagcaatttataactgtaaaatacttgtgggaaagaagaaagatatccagaagctcatgcaaaatgtgagagggacaatgcatagaacccgactttatctgcactttgctctgaggattgttctctgaaaccaaaaaccactggtgcaaaatagtagtactactcaaccagccaaacctttaccaaagtgaaaagtcacca

SEQ ID NO: 48660 - DNA, 827 bp, Oryza sativa
aatatgcccaatatagtaattttactttctgttaatttgtccacccaatcttaaaaaggctggctttccagcacagagggagtaggcttctttgtattcctcagggaagactccaaatggtagttgtttggccgtcgtcggctcgtcgcctcgtagagatgcatccagggtttacattaccggttgaccactaaatttcgagctatatcgtatcacggttttcgataaatttcgaccaaatctactgtttaaccttcgaaattctaatcagaacttaattttgagtcatgccaaaacgtcgaaatttcacagaattcgaccagtttttgttggaattgtgaacgctggatgcatcatgattcatgtcgccgtctcccactctctcgctactgccaccgcggcgccccgcgcgtccagtgttcccatccctgcggagttgggagacaacgctctcgaaatcgattctctgctcgcatcctgccctcatccaacattccaacacaaggcacgcacacatacatgacagtaacttggcagctgcaaatgcgggcagtatgcacagcacgtagtcacgtatagaagaacggtacagtacgacacaaccaagcagataccagctggccagctcgagccttctcgttggtggtcaacccaaatgtagtaagcttttgtatctcttttccaaggctcgcctggcctggggcaggagaacccgagcttctccgccatggggatctccgccgccgccgccgccgcccccttccttctcctcgtcgccctgctgctgctgctgccgtcccccgccgcggccttctccttcacctaca

SEQ ID NO: 48661 - DNA, 216 bp, Oryza sativa
ggatttctaatcatcggcgaggactgtcccagtgcgtgcgtgattgattggtctctacctagctgtagcccgtaagagccgagcagaaccggttcaatacatactggccatactgctacgtgggtctgtttgtcatgtgggccacactgtcccgtattagtgtctcacgtaatccaagcttacaaatcaggattccttgtattgcggccgggagaa

SEQ ID NO: 48662 - DNA, 407 bp, Oryza sativa
gcattactttaactcattaaggacataacaaccttcacatttacttgaataaaaatgttagtcctctctaatcgcattgtaattaatcaccaaaatcattaggggcctagatgcactttcacatggctagttgataacaattagttgctctatttctctttctattccattggtaacctacatcaattacttctaattgatggttggttgatggttgtgtagtggaggatggttgatggctaattgatgagaattagttactctattcctcttcctattccatgactcttactcttcatcttccattcctcctataaaatgagaatggatttgatctccctaagaagaagggagacacactttcatccatttccaaggctgttgctgctacggtaatcccatcctga

SEQ ID NO: 48663 - DNA, 573 bp, Oryza sativa
ttcgataaggttaccaaaattttggtaaatttgtcaaattttcgcaagatttcatatgtacttactaaaatttggcaacaaactaaatgcagctacttttttttataacttaaaaaaaaggtaaagttaaaaatggtaacaaagtgaacaagctcttaaattatacattaatgatttagctcgtcttaggtgcggtggaacagctgagcttaaccgcaaagcctgtttctattgagaggacgcaaaaactgcagtggaagaaacgaacgacagaagctgccgtgcaattcgtagttgcgtttggttctcgtcgagaggtcgagtaataactttggaagaaaggcaaaacaaacgcgttgggcttaacacagtcttacacagatcgcttcacttttacacgaagcccctcgcaattcttcgacctcctaaactcccccatcgcgatccctctcctcctcctctttccccaatctcgcgcgacgcggcggaaccctagcccccaccgcgattcgctcgccggagagggagagggagggaagggaggctaggggaccccctcgccggcggcggaga

SEQ ID NO: 48664 - DNA, 385 bp, Oryza sativa
tcatattaatctattttttaagtttataataattaaaactcaattaatcacacgttattatcacctcatttgcgtgaaatgttgaaaatttagttataattcggtatattttaatccaaaataacaagataataaacatgatatttacaataggatttgatccagtgatagtggtgaatgtaatcaacattagcatgcttaacgtagaataagcatcaacaaccacataataacgcaatgttgatattacgatgaacattaacagtaaaacttctaattaaaataatataagaaggttataccccaagaatagtcctccgttggagtttgaggcggtattgcctccgttggtgttgacgggaacctccttctccttgtctctagt

SEQ ID NO: 48665 - DNA, 431 bp, Oryza sativa
cattttgttcaagtgtgagacttctcatgcaagctgcataagaattacggtgacccaacattacacagcctttggtggcatgccgcgttcatcgttcccatgaagctaacatttgctaagtaatgagtcatgctacctaggatagaggaatgcctccctagaataatttagagtggaatctgaagaagaatgttgcttgtaatttattgatctttctgttaattttgtgtaataaacccaatttcatcgaagaactaatgaaaaaatatgcacacacggtccaacacaaactaagtagcagcttgagtattacactctgcaagtcctattcaaataatgttaatatgcatttttttattttattttgcaaatcaatgatgctaccattctaatgcttaagttgttttgccatccagggaccagcgttatca

SEQ ID NO: 48666 - DNA, 1501 bp, Oryza sativa
gtcatgatactgtccaagcacacacgttcataatcacaattttactaacatgaagatgatataaaaaaaagtatccattggtagctgatgaaaaagcaagataatattatcctcgatagtctactaatgatcaaaatataacatcttggttagaactaccattgtcggtgaaatgaaaaacaaaatcctcatcgctagcgactcagggcatgtctgcccccagggtgctatcctcatgggttgtgctcgaggcacttcactcctcgggacgaccccttgtgggttgtgctcagggcacaactgtgctttgcccccaagtgctcggaagagcaacagcgcattgttaactctcgcaagctcagacttcctcacgtgtgtattctatcaagcctcacactcagtgcgcaaggtgtatatgccaacctggtgtgcgaccggacaacacgcaataggacgaagcacacctatcccctgtagcacgtgtcaccctggaaaaacttttgacttcttcacttcactcgttaatcggcatgtgaaacagtcacctccgctaggcctaagggatatcgacaagaccaagcatgccgaacttaaggagtagggcccactctcatatgtacatattggtaccgtggacccccccccctccccgtttataaaaggaggatccacaccacctgtaagggggcttgcttttttcgatgtcagattaggcggagttaattagactgattcaagccaagttagaataaactcacacttcaagagaagaagagttcatcatctcctacttagaacaacatccacccaatctacattgtaaactttatcaccctcattcataacaagaacacaagagtagggtgatacgcttccgagcagcctaaacttgtctaaaaagaccatatgttcttatttgcatgattcgattgcctcgtttccgctcacccattccatagccaaatcttccttggggggtgccactcctccccgctgaaggagctccatacaaccattgatatacataaataaggcttgccaccaatgcaacaaaacactaaagtgattctctatctatttgtagcctgccaatagataactatttttttcatatatccctattaaaataaaacaaatcatagagacgtgtgaaagatatatgtgatataataggaggtcaattatcagaatccttagagataatttgagatgaaccgtctcatattatgccattgcaactacaagtgctcaattatcacaaaacaaaatttaaatcattttgtgaatgttgctataatatatttattgaaactacagggaccatctaacatccatgatgatcggttatttcataattttacaagtagggatatttaggatttgatactcataaaggtggcatttcaggatcccaaaaaaaaacctccgtgcctatgacatggtggttgttctgatcccacaataacagatgcgtgagtggtacatcctaaattgtaactat

SEQ ID NO: 48667 - DNA, 1501 bp, Oryza sativa
ataaccctaacgacgatggcatttttaggacaaagtcgtttgtacgatggcatttcttaaaactcacacttatcgatgccatttctgagatttggacacttgtcaatagaatttcttggagattatctttttttttacgttaatgcacaaatctcaaaagttttaggggcaaaaaagaaaaacttgcgaaagttttctagcaattccgttcctcgagccggtaccatctcccagattagatggcgttgtctggtacctacattattgaaccattgaatctagcacaatcaactgtcatgatttggtacctgcctccgctgttgatttatttatacatcgtgtgtgtccatgctataagagaaaaccagcagaaatgacatctgttggacaagatttagcctatgaatctgtttggggagcttctaacaccttcagtttctcttagaatctccagttgccagaagctcctccaaacagtctagttttttatccagattctgagagtctgtagttgtagaatctagaaaatgaacttagaagtcaccagctagtttctcagcagctgcttatcagaatcttaagctgggttgatcaacttacaaagcgagtgactaaaaatttcaccctccacacaggttgtggtatatcactgatgtattttcctcgtgaatatattgtcactcttacttaaaaagagaccgagaatcacaaagactcgacgtaagtaaggtgaaaacatatatgcatgtagtattgcggagtacttccttgcagcttaattaaccgtacgtgaacacaccacgtatacgtgtgtatatatttatatgcaggtatttgtcttagataggagtaggagtgtgggttttggagattgacgatcgatgattaaggaagaagaatgaaattaagctagctagagcctagagcgtagtttggatgcgccagagcatgatttgggagcaatcggagtccggcatccccctcgtcgtcgactggttgtattcctccaccgccacccgctgcacgaacttcactgattcctgcatatatatgtatacacatattattaagcgcatatatatatatatatatatatatatatatatatatatatatatatatatatatatatatatatatatatatataatctcaattactagtacgtactcctacttcgtaattgtcaatagttactgtgtacttatgtatgatgaatctgcagattgggatccaaactgtacggtaattatagtacatgtactactactacacgctgaaaggcttctagctagtgaggctggaataatatatggaaatgattgatgaaattaagcaagcaagcaaacaaacaaaccaaaaagaaagcagacagacgcggagcttgtgcgtgtctagtgtcgtgtgcgtacgtgaattgcgcattatattcttccgacttttaatctcttttcagttagctagctacttccttcgtttcgactttactcacacacacact

SEQ ID NO: 48668 - DNA, 1501 bp, Oryza sativa
aagttaatctaagaggaatcaaaatcaaaatgtatgatataactccagagaagagtaagaacctcaagttttcaaattatagtagttactgctgtacaggaacaacaaaacaaaacattacctagccgtgccatactgcatcaagtgcccgggaatgcttatatcactgaagaaatcaagtgaaactgccaaacagatgtagccatatcagctcaaccaattgtttgtgaatgaggcttttcctactaactagtaccagaagaggaaggggccatttgtaacttttatacacatgtgaggcacaaatagtccaacagtaaagaacaggaattagttaagagtacacgcttgtcaaagataaaatttacatattcagtttaacaggatactatgttgaaaacagataactatagttcagaactaccctccagatatttagctagcaatggtttgtgtaccccaagaaatgtaatcactcttatgcaattgaggatgctgattccaggttagtaatcaggtctacagtggcaaagaagcatactatgatattaatcaacatctatttcattcaaacaaaaggatatatgagaaagtaaactagtccattgtttcgaacagcatgacctcaggataaaatagtgcaacagatacagagttaaacatcatatacaaatttcgtagcttattcttagaagacataagacatactatgacatggaaatatgaacataaaaattccatacagtacaaaatgttatccgatgttatagacaactgctacaaaaggaatggaatattccaacaggcaagataactagataagagattgccagcaaaccagctctttaaatgtcaataagaaaataagcaactcaccatgcagacccttttcatcatatccactgatcttcccgacaagaacctccccaacgaagggcctgaacatcagcaacctaaaggaaacctatacaggatggggaaaataaggaaatctaagagtgatttgcaaattgtaggaatcctcagaactaaatgcataagttcactgagacgacgtgttgcacacaccacactaacagaaatactgtaagaaagagcactgatgttaatagacacaactctaatcacaatgggtcattgagaacatgctatgttgtcatcaagtcgatcgcaactagtacataggctcgaaatacactaccaacatgagtaacagaattaatcaacttagagcttaaataagtctccaattgtgctgaaatatttttcaggcattcacctcctacagaatcttatgagacaagtacaccaccaagcagacatgtatcatacatatatcgcaattccatcaccaaaacaaaagggtaaaagcaatgggagcacaaattactttgtaagtggagcagccctctcctggaaagatgaagcctccttcgacggagcggatgtcgtagacggagacgcagagcccgaggttcgcgacgacctacatacagcacag

SEQ ID NO: 48669 - DNA, 250 bp, Oryza sativa
cataggataataagctagttttaggccttgaacagtagtccttcaatatgtactgtcatttctgatgtatttcagggatttattcttaatatttatatattaacaaagaagaaaaatagttagtaaaccaaactgtttcctgccacaaagaatcaatacggccctaggaaccattgtgatcatgcaggatttcaaaaggaaaacattaactataggcacatctgaacctaggtaaaaagctcttgaggta

SEQ ID NO: 48670 - DNA, 1501 bp, Oryza sativa
tcaaaccgttcaccggaggtccctcggcagtatttttgcccagttttactgacgtggcatcctagtcagtaaaaaaaattaaaaagtacatggagcccacatatcagctgcacattttcttttctcgtcttcttcagtgaggcggccgggcagatgagggcgtggcgacaggcagcggtgcgggcacagcggcgcgcggggaagaagcgagagaggggagaggaggcgggcacggcggtgggcggcgtggagcgagcgcgccagcggtggcgggagagggggagagaggcagctgggacggcgggagcggcgggcagggcagcgggcgagagtggcagcggagcggcggcgctcgtcatgctctagctcttcaccgccggtgtcgtcgtcgtgttggttgacctccacgagcgtggtaggcggagcagcggtgggcagaggacggcgggcgattacgacagagcggggggcctggtcggcgagcggcggggggcaagtgtggctgcggagcggcggtaggaggtcggcaacgacctcttcgccgatgcggcgcgccaccccctctcccgccggcctcatctccgcccttgaagacgaggttgatgggctcctcgtcattgtcgccgtccccgggtgggagcggcggcgcggggggctcgtaatcgtcgtcgtcggacagggcggccttggcgcccttcttgccggagaggagagagagccggccgagcttcactcgcgagcttgtcggcggcaatggcgtccctccacgcgcgagagaagaaaggccaaaagcccgtgaacgcatgcatgctagctatgggttctcaagtgagggatacatgcatgcaatagagagaaaaagaccaaagcaaaagcagcttgtgattgatttgcaggctgcactggttgaaagtgacaagatcgatcgatcgaatatatatgtactacattcatgaatgaatgcatatgtgcatgtaactctaggcctcgcccacggcgacgacgacggtggagagccgacgacgagggcggccacggcgcgcggctgctccgcccgccgccgcgctccgctgcctccgctccgccaccggacggccgctccgcgtagcctcgctcatggcgacgacgacggtggagagccgacgacgacggcggccatggcgcgcggctgctccgcctccgcctgcagcctgaaggagaagaggagagaaggagaagaaaagagaagaaaaaaatgtgcagctgacatgtgagccccatgtatttttttaatttttttttgctgactaggatgccacgtcagcaaaaccgggcgaaaatactgccgagggacctccggtgaacggttcgagtgagtttaggggtagacatttctggttttgtggttaagggacctccggtgaacttattcccccaaagtattttgaatctgatccatcgaaacatgtcgctgccgccactgcactactgctatgatgatagacactgttgcatatttgta

SEQ ID NO: 48671 - DNA, 1501 bp, Oryza sativa
acccgccattttcactcccttgctctcactcacaggtctaaaaaccaaagctctcatattacactcatattagcaacctactccagcattacaccaagagagaccctcaactaatccatggaagaagaggaatatgagattcctgatctcaaccttgatcttggtgtgcaagaagtgctacaagatgaaggtgatgggatccctgaccttaacctggatcctgctgtgcaaggagaagatgccttccaatatgaagatgaagagcttcctgacaaccaatgttttggtgctcatgaagatgaacatccagaccctgccatgcaagcagttgaactctccaatggccggagtgcacaagaaatttgtcatctaaacatggagccaggtatggaatcaaaatcttaatgcaaagcaagttatggtcttactcacatttcccatcctcccttctgctgaaataacagaaacataaatgttgaaagtagcaaagtttgtatgatcaaaatttatgaacaaattcataaactaacaagcccaatattacttctttgcataacacagagctttgcaactttgctattagtgtcaatcagttgttgcttttagtcaagagttgtaaacttcagccatcagtcatatatatactcttatgtggtactgtgcaaaaatgatgatcataaatggctctataaattttatttgctcattatgataaccagccattagcccaacaatctccaaagtttataagcgtacatcatgtgttctaaatagttggaatcagcatagttcaagttttatttcataaagctggttttaatatcagaaactactaaaacaatccaaaaaattaatattatgaactttatatataacaccactgaaggatgacccatataggtatgggaacatgtgttttttttgtggtagatgacctaatgcaaaaaaaaacttttgtggtcaagaatggttacttaatttataatgcacttttctatatatttcatcatacaaagcacatgacagggtggttaaagccgcgcgaatgcactacttcattagctagtttctttgtacaaccttcaactttaaatttatcttcgtcacatgtcatgcagcaaattatggagaagatgatattgtatttgacgatgacagactctatgttctccaagatcaatcaaattatgcaggtacatacattattttttgctcatatgtaatcagcagtgatgcagatggggatatcatatgagtagctcatgtctcaccttttctgtccatgcagacgaggaggattttgatgtttattctccttatatggatgttgtctttgatgaagatctccatacatcaagtgatgaggaaggtatgacatgcaaatgacattcattagtgtactgcaagtataaaatatattgccaactgatatgtatatatataaatattttctttgtgcagatactcaacaagacaatataaagagaaggaaatatttacc

SEQ ID NO: 48672 - DNA, 257 bp, Oryza sativa
ggaatcttttcccgccgtctgattagatatgtgcggctcagatgagcagcaggtgccgcacagccgcagtgagcccaggaggaggatgcactggtgcatggggtcggagtactccgaccccctctgggatttcagctagcggttaacgtgtcgtgttgcggtgattaggactatgtactctgcgcggcagtgttgcaacaacaacagctggaaccttttatgctgcatcgaacttgccctttgcaacattatggcca

SEQ ID NO: 48673 - DNA, 1501 bp, Oryza sativa
tggaataattctgaaaattcttcgtcccattgatgtcccataagagaatgaatacacatgaattcctagcataatgagccttgaaatttatttgatttaattgatttaaatggataaattacccaattaaatctaacagaaactccgttagaagaggcgaaggtgagaaatatatggctatctgctcatcaagtttttgactttttgttatactattctttcaacatttgtagcttgtcggtccactgttctttcgtaagatttcaactcctcatgttgagactgttgctattccggtaactaagcatttgtgaccgttcatatgtcgtcctcccattcgtacgctgggccttcctcattagtgtgaattgcaagagtggaacaaacggagacgatgtaaaatgagaaaggaatactcacaggtggcacattcccatatttccaccatatttatatgctatatagaacaactctcataaactatatatatacttccacgattgcatcagcttgaggttattgcttaccgaaaacaaaaaaaatgccatagaaatgagaggccacgggaaaagaagatgtcgctcaagaaatagtcgccgagagcattaccgctggagcgttcagttcaagtccatcgatcacttgacatcttggtgctgcagcattagtggcaatctggcaagcatggtcttaccggcttttgcgttgcggtcaggctgacactggcacagatttccaacggctgcgacgcgctgtaaaccaccatgggtctcatcactccttgaggttatgaacttaatttggtgtagacgcgtggatagttttcagggaaaaaaaagggggaaaaacatgtgattgatttatgtacatttttgtttcgttggttagatatgtaacaatgactactgaatattttgccaactcatgcatccagctatgtatctctaatttataaccgtaactcaatcgtataataagcgactgatgaacaccagctcaggaatgacctcaagctaagaattttggggctagcagcagtggcaaagtcgaagaaaaggcagatatcgcgattgacatggctgaaagaaggggatgccaacacaaagtttttccacattcacgcaaactcgaggagaaggaaaaaccacattcaccaactccatacaacaagtgctatcctgacagaacatgaggaaaaaagtgacgcgcttttcaaccatttcaactcaatcctaggcaacaaggaggcgtgaaattgcaccctaaattggaacgcgatggatctaccacaggttaaccccgatgaactagatgaaccttttacagaggaggaagtttgggccgctttaaagcagatgccggcagaaaaggccccaggtctagatggctttaatggtaccttctacaagaaatgctggcagctaattaaacaggatatcatggatgttttccagtgtttgtataacctgtcaggatgaaactttggagcactcaacagagc

SEQ ID NO: 48674 - DNA, 1501 bp, Oryza sativa
tgttttcggtaagcaataacctcaagctgatgcaatcgtggaagtatatatatagtttatgagagttgttctatatagcatataaatatggtggaaatatgggaatgtgccacctgtgagtattcctttctcattttacatcgtctccgtttgttccactcttgcaattcacactaatgaggaaggcccagcgtacgaatgggaggacgacatatgaacggtcacaaatgcttagttaccggaatagcaacagtctcaacatgaggagttgaaatcttacgaaagaacagtggaccgacaagctacaaatgttgaaagaatagtataacaaaaagtcaaaaacttgatgagcagatagccatatatttctcaccttcgcctcttctaacggagtttctgttagatttaattgggtaatttatccatttaaatcaattaaatcaaataaatttcaaggctcattatgctaggaattcatgtgtattcattctcttatgggacatcaatgggacgaagaattttcagaattattccatttgattagggaattggtaacttatatcaattactcctaattgatggatggttgatggttgtgtagtggaggatggttcatggctagatgatgacaattagttgctctattcctcttcctattccattgcattggtaacctacactaattactcctaattgatggttgattgatggttgtgtagtgaagaatggttgatggctaattgatgagaattagttactctattcctcttcttattccatgactcttactcttcatcttccattcctcctataaaatgagaatggatttgatctccctaaggagaagtgagacacactttcatccatttccaaggctgttgctgctacggtaatcccatcccgacgagtgtatgcacacgcgttgggagagtaggcctccgaaaccacgcactgctgcgacgtatgcacggacgggcgggcgatcaggtttttggggagcgcaagacgagactactcactgttcatcaacgtctacttcgtcttcaccaacatatcgagcactggagacaacggcaacactagagacaaggagaaggaggttcccgtcaacaccaatgaaggcaatactgcctcaaactccagcggaggaccattcggtataaccttcttatattatttcacttagaagttttaatgttaatgttcatcgcaatgtcaacattgcgttattatgtgattgttgatgcttattctacgttaagcatactcatattgattacattcgccactatcattggatcaaatcccattgtaaatatcatgtttattatcttgctattttggattaaaatatgccgaattatgaccaaattctcaacaatccaaaaacctgataggtccttttaggtagttggctttgctgcaatactgaaaccacatgtttttgatggttctaactataagagatgctaagcacgtgcactactgtggttgacagcga

SEQ ID NO: 48675 - DNA, 1501 bp, Oryza sativa
tccgtatattcaatgtgacatgcagaggcaattttttttttgccaactaaataggctcttaggccttgtttaattcgcgagacgaaaagtttcgacatatcacatcggatatacggacacatatttgaagtattaaacatacactaacaaaataaaatacagatttcgcttgtaaactgcgagacgaatttattaagtctaattaattcgtcattagcaaatgtttattgtagcaccacattatcaaataatggagcaattaggcttaaaagatttgtctcgcaatttcaacacaatctgtgtaattagttttttttcttatatttaatactccatgcatatgtccaaacatttgatgtgatagggtgaaaagttttttgtttggtaactaagcagggccttaaattcatacttcccataaaaatattaaccaaaactgatttggattatatattcacctttacatctgctcttaagtttttcttgtttttagtccttgtgttttccaggtgttgcctttcagaggcatttctattaaatgttactttaatcaaaacatacgtagctctcaacaaagttatgtatacctcaccgttatatctagaaaacatattctgcctacataagctttcggtgcaaaatatctcaattttttttgttaaaaaaatatacacgtacttccaatgttacaacacatatgtgcaaagtactatctttaaattaattatgttttagccgtacaaagaaatacaaaatacaaacaattttaagagttattttttttggttatgcaggtgcattactaagagcaggtacaatagcagcctataagccagctataaacatattttaaagagataaagaaagagagagaagagcagcgggctacatatttgtagctaactacaacacggactccaagacgtaatgtatgtatgacagataggaccagatattaatagtatagcaagcaactattgtatgaattgactattacagctatagatgatttagagctaacaatgggctatactattaaatttgctctaacaatagatttgttgacacaaactccctttataagcacgacacggtacgacatacgtatgggttaacattttgattggtggcagctgctgcagggcccaattcgaacacaagtcccacggcctgtggtaacccagcccactccaccacaagaccaataatcgattatttattactcccttcatattttaatgtatgacgccgttgactttttattcaacgtttgaccattcgtcttattcaaaaaatttatataactatcatttattttattgtgacttgatttattatcaaatattctttaagcatgacataaatattctcatatttgcacaaaaatttgaataaaataaatggtcaaacgtttgtcaaaaaaatcaacggcgccatacaaactaggcttccatccaatggcaatgggggttcgatcaagcacgacaaagcaaaaggaatc

SEQ ID NO: 48676 - DNA, 188 bp, Oryza sativa
gtttttgaagatgagggattcattatacccggttttgtggttgagggaggcaattcaatcaagcgcaagagatgagggagacaaaatggacttattccatcataaaaataatgtggcatctctaggcccagtccattacagttcttcaccaatatttattttcctttttgttttttatccacctaaga

SEQ ID NO: 48677 - DNA, 1501 bp, Oryza sativa
cctgcataatttgattgatcttggagaacatagagtctgtcatcgtcaaatacaatatcatcttctccataatttgctgcatgacatgtgacgaagataaatttaaagttgaaggttgtacaaagaaactagctaatgaagtagtgcattcgcgcggctttaaccaccctgtcatgtgctttgtatgatgaaatatatagaaaagtgcattataaattaagtaaccattcttgaccacaaaagtttttttttgcattaggtcatctaccacaaaaaaaacacatgttcccatacctatatgggtcatccttcagtggtgttatatataaagttcataatattaattttttggattgttttagtagtttctgatattaaaaccagctttatgaaataaaacttgaactatgctgattccaactatttagaacacatgatgtacgcttataaactttggagattgttgggctaatggctggttatcataatgagcaaataaaatttatagagccatttatgatcatcatttttgcacagtaccacataagagtatatatatgactgatggctgaagtttacaactcttgactaaaagcaacaactgattgacactaatagcaaagttgcaaagctctgtgttatgcaaagaagtaatattgggcttgttagtttatgaatttgttcataaattttgatcatacaaactttgctactttcaacatttatgtttctgttatttcagcagaagggaggatgggaaatgtgagtaagaccataacttgctttgcattaagattttgattccatacctggctccatgtttagatgacaaatttcttgtgcactccggccattggagagttcaactgcttgcatggcagggtctggatgttcatcttcatgagcaccaaaacattggttgtcaggaagctcttcatcttcatattggaaggcatcttctccttgcacagcaggatccaggttaaggtcagggatcccatcaccttcatcttgtagcacttcttgcacaccaagatcaaggttgagatcaggaatctcatattcctcttcttccatggattagttgagggtctctcttggtgtaatgctggagtaggttgctaatatgagtgtaatatgagagctttggtttttagacctgtgagtgagagcaagggagtgaaaatggcgggttggttctgagcatcaagtttaaattttgaacagctaatgcctgtgtatttgtggcgctaatgtgtagtgcgtgtgaattttgggcagcaaagaggtgagtgggatttaattgactcttgtcaacatatgcattaatgtcattgtatactgaggaatgcttactctttctttgtgccaatcatttgctggcaagcttgtaaacccaaatagtctctcactgctagtgccagtactaagtaaatgaggggtacatgcatctttcgccaacctccttattttggatgaacagtgtccagtcccatataat

SEQ ID NO: 48678 - DNA, 953 bp, Oryza sativa
ctccacaagatgattctttgagaacacgctttatgacctgatcgttgtttccgccatatattctgatgagagcatgggggtaacccatttaacagggcgccgccaattataaaagaattagagcgctctaacgcccgcggtcgtccaggggctcccgaccaattcggtctgggttcctgtgacgggtggacccaacgggtgtcccgtcccggtagaccggcctccttaacactcgcctggggccaataagcgggggccctttcttttccctttaaaccgttaacctgtggccccgccttgtgcgcgcccttgtatgacgtcacccgtgaatattatggcgaataattaattaggcctttttctttataggtaaaaccccatttttttttctaaatacctaagtaattctaccgagctccgtttaagccattcatttccagtaaatcagaaaaatgcaaagaatctattaaaagtgttttgtttcctgtttcaatagtcttaaagcatgtttggctgttgtgctttgtttgtcgcataggtttgggccgtttcgtcgatccgcgggtttctcgaaagcggttgctaaggtctcatcagttcgaagccaaggcaagtcatgcaatacttttgatcatattgtacccaatttacaaatatcccgcatttctattaaatgttgcattcttttacaatgtaatgtgggatgggtcctattcctcagccacatattggttaccttatgccattgataacttgggtatcaaaatgactagatgttggcttaggaaatgcttagccatgcttagttcaactagtacacaaatggggatcacattattacatagactctgactattggcatagctttagattggtgccaccgcaagggtgtcagttaattaaaatattctaaatggcgggctgtgagtgcatggttttgctggtcgcaccca

SEQ ID NO: 48679 - DNA, 700 bp, Oryza sativa
  unsure (1)..(700): unsure at all n locations
aacggcctgcttttggccatgaatctaanctgagcccaaattgatgttcgtccaatcagtttctagggagaaaaaaggttcctggtcattcgggtggctaaaactaatttattagggcagcgtagtgtgcaacttttcttgtgaaagtcttgaactttttacagtccttctgtttttaactgacaaaaatccattactatccttctgctgttatctttcaataaaccaagggaattttagtttgttctaaaaatcaattttccctaggctacccagtcatcactcagctcatgatgtatcaaaaaaaatctctattatatttggaattactttcgtgattatgatattatattagagtcgtttagaataccaaactttttcctactaattttgtaggcttctaacataagttaacttcaaatataatcactctgtgaatataggtattgtgcatatgaaaatgatcacatttgaagtaacaaaaattttacaattttaaacttatgcaacaatttttcgatttatgctaagaatgaagtcatcaaagttacatcttattgactttttacagtctaaaatgatacatatttgtgactcgagggagtatatcatcattgcttaggactgtaaaaccactctgaattaaagcaagacttatgacatgcagtcacgcacccaagtcttttgtgtctctttcagg

SEQ ID NO: 48680 - DNA, 345 bp, Oryza sativa
gggtgtgtgtgcgagagattggagatggtgcgctgcttatatacaagctgagctacgcgcggtgcgttgtgttacagctttcaggcggcctggctagctagcttaatataagctgacgatcgagcggccgggcgggctgtcgcgcgcctggaatcgattggttggcttggcggctcggcgccaccagctggttcagttcatcgtggtgggagggagtccgcccggcgcgggatggggtcgttggcgccggcccggggcccgcaattgcgtcgctggagagcggcggaataattgattgcgctcgcggcgcggcgcggcaaggcacatggtgaattggcgttgaga

SEQ ID NO: 48681 - DNA, 1109 bp, Oryza sativa
caattgttgtgtgcacaacccaacctggttgcacatgagcgtatttatccaattttggaggtggcaaaaaaagcgtaactcacaacaatttttctttaaagtacaccaaaaaatcggtttaaaaacccattggttttttgacaaactttttccaacaattgagaggtccactattggccatgccaataaaaaaagcatgttcccggaattggtataaacctattatggacatatccttttaaccaaagaactacttggcattgctatggttaaaatcacccgcagttgacctaagttaataataatgcataaaatattttgggtttgaccattcgcatacaagtatttaaagccccaaaccaaatgttgttccgaatatcctcatataaaaaataaaggctcactctttggaccgagtttaaaataaaattgggagaaacttatgttgcttaggcctgtaagcctacaccatgtgaagagtgaaccatactatgttagaatatgaaaatacataagttccatggacatagttcgccatttctagcaagtaacatggttctaactttgtccaaaccccaaaatcattattaagaagataatgatatgtgtgtcgcatcagcactgatagactatacaaactctacaagtcatagacatgcaagatttgaccattggaacatcactcgcactatgtctgaaaaaaatgatacacgcaacgagttttgatggttcacacttaaaagagatgcaaaatttagggggatattttgcatgtctattaacaaaagcttgatctgaataatcaagtacccaaaaccaattacaaaaatcaaagcaataatttggatagattgtactctttttctcttggataagttttgtcacgcccggaatttctatccaaaattccaaacgcttacatgtgtgtgaaccctcgtccaggaatcagccgaggcacacaataacaaattgataatagagtacaattatcactctaattaataagcgaataaaatgtcattacagaggtagatagttcctctcaatcaataaagatctaagcagcggaaaaaataagataaacgacgcagacgactccactccacagg

SEQ ID NO: 48682 - DNA, 277 bp, Oryza sativa
tggatttatattagtttatcaaacgggcgcaatagaactgaggtaactctgacttttgccgatttccctgttcttttttcacaccatatacaggatcttagtttgtttttatgacaatttttggcatgctgaattttatgaagatttttgatattttgactttttagtataattttaatagtatatggataaacttatagtgtgtatgatcaatgtattgttggagagaatgtgcctttctctttatactagagcgcattcctcaagtcaggaaaca

SEQ ID NO: 48683 - DNA, 1086 bp, Oryza sativa
agtggatccccccgtgtttataataaggttgaggttgcctagcttcctcacttctcagccctattgcatttgcaggcctgatagatagttttagcctgtgtgggaatctctcggcgacgggaaggattacaatatgatcattgctcggtgtgttcggatgggggaaaccagtatttatattggtggaggttttttgggtgatcgatgtgatggcccacctcgtagaaaagggaggaataatcgccgatcgagatcgaaagttccttgttttgctccgtttattttaccctcttccatttatgtgatgatgtaaatccttcctgtaatatatgttctttgatccaccgtttcggttttattacctgttaatactataaagcaagctgtttctcctactccattcaatgaaaaggtactatctcgtgccgttttccgttcaaaaaagaaaagaaaacgagctgtttattttccttcttataaaaaaagagggggaataacttatctgtatgtgtggccgcggtcaataataaatagaaaaagatgaaatggagtgagttcgttgtttgcagctggtccttaggggccggccgttatgtacactcgctgttccttgactgagaactcaaaagtatgccaaacctcgtaggttccatcaagaacactgaccctgttgtttcttattactagcagagtccataaagaacaatggcattagcattctgcatttggcagcattattaacactttttcgtgtacttcaatataacttgatcacgaatgattaattgattattcgttatcattaagtaactttttttgcggggatcattaagtaactttacaggtcatgtatgctaaaagggttgtagtgatctgagtagtaccccaaggttctgagttcaaatttcctatggagcgaatttcagattggattgtttgcggggctaagttccctatttcaatggccgtatatatccggttaaatgtagaggccggttaaaaaatatccttctctaaaaaaaaatgctaaaagggttgtatagagcccaaattacaagagcagtattgaactgagaaaggaagaca

SEQ ID NO: 48684 - DNA, 234 bp, Oryza sativa
catgatttttaattttttatagtttttggtatgctatgggataagcttgacacttttatatttacttgctgaacattttgttgtgattgaatgcttgtgcaagcatgtgctgctccatgttagaatgtctgcatacattttttttcttgcaaaattaactgtaactttaaatattttttcatgtaatttttttcagtttcttcatatatgtaagttttgtactattactgcagt

SEQ ID NO: 48685 - DNA, 172 bp, Oryza sativa
gagtcaagtttgagataacttggtctcggaatatggtttctttgtttatttcatgtgtaggtgacttgatacctcgggagaatatttgcggtgatggaccggaagtcggcttggggataagacgacgtccatggtggtcaaagatcatgcgggatacttaggctagagttga

SEQ ID NO: 48686 - DNA, 358 bp, Oryza sativa
atgtctatgggacttcgttccctagattttctgatggtaaaaacatcttcaatttttataatagcagaggatagagatatattaagggaaaaaaatatgaattatccccctgaactattacggtcgattgaattacccccccaaaaaaaactcaaataccatacgttttataccctcaattattcaaaccagataaataacccccctgagcactattttaggttgttttgacctaagcttgcacatgtgacgccaatgtggcaatccagtcagcaaagaaaatagaaaaaaagcatgggcccacatgtaatctcccccagtcaagccatccctcccttgctctatctctctctgcagt

SEQ ID NO: 48687 - DNA, 655 bp, Oryza sativa
  unsure (1)..(655): unsure at all n locations
aaacccggcggaaagaagttggagaaattcctccgggcgaggttaaaaaaccgccccgattcttaacatgtttttccccccccctaaattncggcgcatcgctgcatcccggccnaaaaaaaagagttgtgggggggtcggctgttaaaaggcaaaggaaaacaacaattttttatttccttcatctaagcaccaaggtatttttatcaacacttgacccccgttatgatctgaccaanatattgtgggttacccaattatctgggcaaagtacaataaattgtctttattcacttttcaactcactttaccataactttcaacccacttcactttcatcaacatcattcaatacttatttagtgtactaacaaacttatcgtgctctcttttaacgtggtacttttttagtcttgtgtcatatatagtcttaacgtgtgtactgtgtagggatttatcatagtgtatagtgtatatacatgtgagtagttgtgacgttaatggaaaaaancgactatttcttaaacnaattcgaattgccggtaacgncgaccagagcaaacttcacgcaagcgaagtttcaattttgaaaacgaaattaaaaaaaaaaactcacgcgancacaaccaaacccgcgacctgcgcgagaggacaa

SEQ ID NO: 48688 - DNA, 1501 bp, Oryza sativa
tctactaaccatacctttcaactagatctgatgacatcctttgctgccaccgccgaccctacccaccaccctcctccatacccgcagttccggtgcctcgtcgccctcccatctccgtaggccaccgccgccaaccataggtaataagccaccctaaatatccctctaaatccaccctaaccgccctcctaccctagaacgctaatacataggtagcatgtcggtgtttaggcatcggtagcgtaggcttgccaaggaagtcccgatcaccggtcgataagcaaactccctcctcccttcctttcctctcttcctgcctcccttggtccaatggtgtagatgatgccctggccattgatccaacggccaagcctaggtgattgaaattccttcttatttcaatcgcctactcagcaaaagcggctaaattatagaacgaaattaacttatggtgttgttaaagtaaactagtaactttcgatgctatatggttaaatttaaaatagtgaaaatattgatttttcgatattataagtctctgttctctagtagtaaagtagtgaaaatagtgatatttagatgttatcattaatttcttttagttgtgtgctatagttagacaatgtaaatcacatggttattgaacaagcaaaaatattcaactatcatcgtaggatccatcgctggggataatcactttactcccggttggcaaccctttgtagttccagttatgtaactgggacacacaatgcgggacttatgatgggtatttttagtctcaattatacaaaccgagactaaaaatcatctttagcaccggttagtaacacattttgcttgtttagtgataccatacatttaagttcttgtttaatccgctaacaaattaagggtaacagaattcttatttttcttgttggcatatctaattaagggtaacagaattcttatttttcttgttggcatatctggaaggagacaaatggttgtattttctaaggtacaaggttagacgtggaatcatgatttgctttgttcaagaaagtagttctccatagttgtaggatgaaagattcattgcaacaaacagttcttgaatggttgcaaagtttgtaaaatttgttcaccctttttttaactccatttatatagttttccttaatattgtacaaaattttaacaaaagcctggtagtgtcttaagtaaaaaaatagtacgggtattttgcaagtaaattcaatttggtcctaacaaatgtcgtgaccttggaattgcaggaaaaccgatgatttccggggtgaggtgactgtgttggttagtgacattgttcttactccggcgtgagtccgagaccgaatcggaatccttcggcaactttcttttttattattattttttcaaatacaaatccttcggcaattttcttttttatatattttttcaaatacaaatcgttcggcaacttgtgtcagtgttgccgtgacaatggctgttcgtc

SEQ ID NO: 48689 - DNA, 1501 bp, Oryza sativa
tgttcgtgtctaggattaacaaatatgatagtaaatcacttaattattgtggttatatggcttaggctgtgttcgggaggaggtgttgggaacttctctccttggcacggaaaacgagatagccgattagctcctgattaattaagtattagctaaaaattgaaaaatagattaatatgatattttaaagcaactttcctatagatattcttttgttaaaaaacatattgtttaatagttcaagaagcgtgcatgtgtaaaacaagagagtaaaagatgagaacttgtagttctgaagacagccttggagttggtagaaacagttacataaaagtttattcaaatcaaaattaaaatctttagcataatatgattgaatcttatcatgatcaaacggtaataattattttccaaaataatgctcaagagtgttgtcacatgaccgattggttttatacacatgtcttttgcttatgtgacattaaaagaaatgagttgcctttagtagcatcgtaccaatccaagtcaggatgaactccgtaccacaaagtgacaaaaatagcagctccatataaaaaaaaaggcaacaaatcggtgggtactctttcggacagccacccataaaagatgatcttattcttattactccactatctcaattaacgtgtgacccatcaacccgaccgcatcgcataaactcatatcaatatccactccctagttctcggccttatcagattaactccaaacatatccatcgatcaatccatcctcctccaagtttagcatagtatttaccactgcccccacaccccctccatccatagcatcaaaatccaaccctagccagtcacaccccttccaaaacaagaaataaacacaccccaaacacgcagttgacaaaatcaacactccctccaacaagagattcaataatttaacactcatttaaaatgataatcgattattcaacatcctagcccgctttcattcacctaaatggtcccacgtatcatcgtcacaagcgccaattaaagcaaaattgaccacgaaaaaaatgtgtcaaatttctcatctgtgtcacccaaggccgtgtgaaaaatctcggattgggttatttaagggctaagttctctatttgataggctaagtttctaatttaaaaaggttacatatatccggttagatataaagaccggataaaaatacccttctctaaaaaaagcctaggtgaaaaatggtgtgggttaagctggaccttcgccagtttggcaccatggctgtggctgggctgggattggaatttggaaaggccatcaaggccttccttactttaaaaaaaaaaacgtgtagagagagaaaatcagacggatgagggggagagagggagagagagagtagcggtttgagcacgcggcggcacggagacccacgagagagagagagagagaaggtggcaacggccctctcgcccggaaaccagcccacccacaccaacaca

SEQ ID NO: 48690 - DNA, 1501 bp, Oryza sativa
attaagtaaataccgatcttgaattgagttctgatggataggttgcaatggcgaaataacaatagataatacttgctatctcttgcaagatcatgagtctatgatcatgtcatcgtttataaatgacgctagttttatcgaacacgcaagaaaaaaaggtttaaacataagatccccactactgtggtgccaaaaaaaaaagaaaggagaaaaccataagaatactcaagattaaagaggacgcgaccacagacaccaaaacaactctagccacccgctacctctagctaagccaagcccctaactcttgctatatactaaaaaaaaccctttctctgaaatccaactacacgcaaggagaggattcgttaaacacacaatttttttgtgtatgcttccaaagtaatgagaaaattcaggccatgcttgagcacctttggaataatagaattgacctttatccaccatttacaaaaataactatcctttggtcgtgatggaagatctgcacaaccataacggctaaagaggagataccaaacttgtcatgagaagacaacctatcaaaatttgctgaatggccttctcctcttgatcacacatcgaccctatttgcgagatttgatagtgtggcatccttttggaccgaaaattgataagtagacttattaggaggttgatttctaattcaatataaattgaaggatatataatcgaacttcacacattttatttttataagtcattgtattttttaaaacaatatttcagattaatcatacaattagtgtttttaaaaaataaattccagtataaatgaaaccatataatataattagtttagaaaaatcataaattctagtataaatgaaatgatacaagcaaaatataataattaacaaataactatttttctcacaataactaatttcctacaccatatacaacgttttctctttttttatcatcacaaattgttttcttccttttttttacaccaattgttttttttctagtagatggcaatccggtgctccttgtctgaactctctcaatctcaacttctcaagtggcaactcttaacccccttcaggtgtcaaaaaaaaaaaaaaaacctctcaagtctcaaccccttcaatcccagccgccaattttaggatccaacggctcctagatagcgtacggcaccacccgtaaaccgtgaacaaacccagcccgggacacaatctgcgccgcacatcaaaatcgggctcgagtcgacacacgagcgaatctgacctaaaccctagctcgcctcctcctcctcctcctcgccgccgccgccgccgccgtcgccgtcgagcaccacccgagcagccatggcgaatcgtaagcgagacgaagaaccgccctaccctctccctctcttgtgtcctgctccgcttccgactctgggggcgaatgggtggtttgtttaattggttcggtttggtttggtttgcagcggcagcagcagcagggc

SEQ ID NO: 48691 - DNA, 1501 bp, Oryza sativa
  unsure (1)..(1501): unsure at all n locations
aaaggccccggttgcccgccnccgncaaagaaggttctagggttcgggaagaganacgaatccgattgaagatgaattccacgaatttccaaccaatttaagccgacgattccaaaaagggaaaggtagagatccgaagattcatttcccctctatggatttcaccggaaccggaaaggcgtggccgaatttggaagaagatgacgccggcgcgacgatagggctcggncgccgncancggcgcgaggaagccgaagactgacaggtgggccccacctgtcagcggncgnacgcgcgcgcggncgnctgctgccggattgggccgactgggccgagggagagagagaggttttgggccgactttcggcccaaagccaaaagacttttaaaaacctttttcaatttaaattattcatgaaatgcaattccatttattaaaaatacttccttagctcaaataaatcccagaaaaatctaggaattatagaattaagcaaagtatttaatgaaattttatctggcctcattttatattggaatttattaattaaaactagatcttctcttctaggctttttaaaataaattctaataattccaattaaacaacaatttatatatttaggatttttagggtgtgacaagttttcctctagtttcttattaagggttttaatgaggcaattcgtgcgacatactcccttcgtactcgtaaaggaaatcgttttagacagcgacatggtgtatagaacacaactttgacttcttgtttctataaaaatatttattgaaaagtgatatatgtatacttttatgaaggtatttttcaagataaatctatcgatataatttttacattttcaaactcaataacttgagagttattcatgatttatattcttaaggtttgacttaaacattgtactaaacgacttcctttacgagtacggagggagtatatgcgtacgctatgtactatttctccaatttatccgactgggtttttttgaagctttaatagggcatagacatcacacggtgagtgtcaagggggagtccatgaaggcctagtctaaatacactaattggacccatcaccgaaccttgcatatttgcgaatgcattatataaaaagaggaggggccagtcatttgtacacttggtgaatggattgaataagacaagagagtctcacctctagactttgtatctccactttatacactgaattatacaaccttgttggactactctgtagcatggggttatataatatgttgaaaaaagaaaaaaatagatgaaattattaaattaaatggataatagttgtacttatttaagacaaacggtacgtgaaaaaaaataaatctacgccgaaaatagctactccctcattgctttctactacgcgtttgcgccgttgcatactctccttcacgtccctccctgtctccctatttgccaatttgccacagcatacaaaactcgaaccacgacgaga

SEQ ID NO: 48692 - DNA, 699 bp, Oryza sativa
  unsure (1)..(699): unsure at all n locations
tatggaacgtaagagggatgtgtaatattaagaaggaatcccttatcctcttcatttttgcattcaacattaaggaatttaaatnnccccccnnnnnnnnaggctgacacttgtancagcnnccggaaaaagtacaagtcttacaaaagagagtagagctactagaaccatacctgaatccttccgaagacttctaggactaagactcttattctattcctactgcactaactttagaacactagtaaactagagagagagcttgattcttcttgcttgaggtgtgtgttggaggaagtgaggtgaatgccttttatagctgagttatgacggttggaaaggtcgataataccctccaaccgtcatagggagtccatctgagccgtctagtcaaaacctgaatcgattggcgctacggctgggtaggttcggccgaacccaggggtggcccaaccggcccacaatttggtcgatggcctccttttctgttcctcacttgagactcgtgaattttggctcagttggtcatgtcatttctgagttcttggcccatccatccatatgtttgattctcgataacgtccgattgaatgatcgtcaaattattgtcgattctcctccattttatgtttattctctacaaaagttttgaaagcctagtgctagtggaaaatatttttattctaacacaaatcggca

SEQ ID NO: 48693 - DNA, 215 bp, Oryza sativa
gcgccacgcgtgtgggttaggtgagcacagcggggctcacctacccgcatttatagcgggattggacgagcgcgccacgccgcatttaatgcggcgcagcgcacgcttatccggtccgcgactggtcgcggtgtgtgaccggtcacagaccggtcagatcgcgggttaggtggcaacaggcggcctgtcacacgcctcgccccgtcccgtcggaa

SEQ ID NO: 48694 - DNA, 1060 bp, Oryza sativa
  unsure (1)..(1060): unsure at all n locations
ccaaaaaacggggggaataactgagtccacccccgcttttaatgcgcaagtgccgcggtaattttcatctcaataaaaagccccgaccattttccaattttaattnaaggggacggtgacactaatgtnaactaatgaatggaagctaaaaatttcctaantggttntgggaccttcccccttcnnacntagtttgnnccntgcttatacaagtgtccatgatgtcanttgtacaagatagctttcgtggttggatccatggncacatcagtttgangagcttttacttctgaaatgcatgccctcgnagacctattnccatgagatgtagnaagannacatgttgagtnntgagatgaatatgtgaatgtagtcgatgagcagnacttgtagttttcataatgtttagaataganttatattcggacntcatatcataagcactncgattaaataaagaggcaacacctaacggtaagtgcatagggactatagcataggcgaaggaatgacttctggcaagcctaactggtgaaatgtcctagttggggattagcatgtaatcaatgctgtaaaacaaaagtgtgtcggtccttattttaaatgaccaattggcatttgatattattggttttgatatttgaagattattagcgaagtggttttggagatgattgatttgtaggtgatgaacaggaactgctgctgactgtttggaccggtcagatcggagctatgcgtgcagtcagaccggccagcccacggtctgaccagccaactctgtgtcggtttcggtttcggattgtttcgctggatatccgtggataattcatgtttatcacttctagatgggtactatgaatatgcaatactgttgtttgctaacaatgagtcaggttggtgagaacttgtgctcgaatatggtttcttggttgatgcatgtataggtggttttgatgcctcgggtgagtgttgccggtgatggatcgggagtcaacttgggagaagatgacgtccggacgatcaggatatcatgcaggatgcttagactaaagatcaa

SEQ ID NO: 48695 - DNA, 1093 bp, Oryza sativa
aaacttgttccataagcaattatctaaatttatatagctccagaaaacataccaaattggataaagtcctaactcctatcagtcattaagatatcctttagtaagattaaattctggacaacaaattagattggtatttggagatattttgtaaagctttacagatatattacctgaaccatatgccatattgtacagttacagacttatagttaaggcgactttttcttttaccttttgtgatatcaacaaaccaacagaagttacacctgtaatggagatagactgatacaagtgtctataaaagatagtaatatgttaatactaaatatcctcatttgtacttatccattgcagcagttaaatgttaatggtaaaaaacccaattcatacttattcaataagttgtagtggttagtacatcaaactcaatacacgtctgacatttgacatgttgattaggctaggtcagcaacttgaaatgcagagtgatctgctacctccttttatttctcctttttctcttttcacctctgaaagctatactgagaagagaaaatattggggacaacctttagttaatctgaatacaaaattgcaagtggaaaatattgtttcaataaaattgggctcacctatctcatgtaaagttaagttattctctgccttctgatgcaggtgacaactaagcagcaaaagttgcttagtgaagaccagtaaaaaaactgaaacatgtaatggctgtaaacaaaggatatatccattaccaaaataatattgcagattgcaatctaactgtatattagtaggtaggaaaaccagcacttcgtgtattataaccactatatgttccaaagagcccattggagctattgctcaaaacagtttgtgttatttcctattattgctagctgccagaaattttttatgaaacccaatagatgaaccaggcaccagcttggtacaagatgaaaactttgcgatgcaatagctacaaaaggcaagaacgtaagcatgagcgcaatcattcagataattcgtataaggatcaggtaatctcacgaagtgagaatccggaacggtacaatatata

SEQ ID NO: 48696 - DNA, 826 bp, Oryza sativa
  unsure (1)..(826): unsure at all n locations
aaaaatagagagagaggggggggcgccaaataataaaaagggtccccccttggggtggggggggggggcacggggggggnnncnccccggngnccccncnnngtggtctttcagatgaataggtatgttttctccaccaacaaggtgtttttttttttttnnnnnnnntngttggggggngagaagagaaaagaaaaaaagatgaggggagaagntgtttgccggccccattcaaaaaaagggggatctattttttttttttnttagagcacccaaaaaaaaaatatttttcaaaaccggggtgcttctctttagagagggtgtctcatagtgttgtgaaaaaagagtgtgaacaccacaagagagacaagggggggttttattcaacaaaattttcttatttttttagggacaagggaatttgtcaaaaaagcgtgggttaagatattaaatccttagtggcaaaataaagggacaataaagtggattacttatgttncatccagtccgcattccttncgttaataaaaattctaagcaattttctgggagggtactggtcngtatttagcnccagttgacggccatgacgaggtgtcgtaanaactcgcaaaccgggttgtctctcgagccctagnaggcactgtaggggtatggtcaataacttgtcacagcaaatgtaactaagttgagtgtatatagaagtaaggaatgattatnttctatttctctttcacatagcnntaganttattaaatgaaagaatctaagtccttctgcttcgtgtcactctaccatataattaaagtaacccatgtttagactt

SEQ ID NO: 48697 - DNA, 1438 bp, Oryza sativa
ctttattatacccataaaccgggggggtcttttttaaaacaaccggcccccttatatttttttccccggtgttaaattcaaccctttgggccttgggggcgccaaaaagggcggctttgaaaaggttaacctgtacaagtggattacccccaaacattttttcttaaaaaaccagtgccaatcccccgggaaagggggaaacaatcaatgttcccacccctcctcccaaaccaaagggccggccaaccccctttggcgggaccctgggaaaggcagccgtttgagccctaccccggaccacgccctggccaatgattctggaatccaaacccaagttggtaagcttcaatggcctaaaatggccatggaccccggatttgtcattctccaaccgggaccttttgtttataacaagctgagtcacaaattaagcttaaccacttagacttgtgaaagtagggtattgctttgcaacaaaaggccgaaagaccggtcctaatgtgcccgaggtgctactatcaaaaccatgcaccccgagcccagcctaaaactattttgagggttttgaatagagggggaggtgtgaatccaattccacaatagtccaaccattccacaatgtccaagtgatatgagaattcccaaagtctaaggttataaaaccacctaatgttgcctaattaatcagcgaagcatctacctaagttcatactagtggaaccatgaatagagtacccactagttggggttttgtttatcctagggtgaataagctaataataacaataacaataataataaggtcataacaaaggtaaataggcatggctaaataaaacagtgataacgcgggaatttaaataaagcgataatgcattaacttaaatcaaaataattttataaactgggattcaatatgttcaaggatgatgtgacttgccttgctcgctttcccaaatgtcggcttcaacctccacgtagagcggatcttccgaagctgcagcgtctacacgaccaacggaaaggaaaaaggcttttactctaataaactccatataacaagcaggaacaaagcacaaaaatggttcttgacttcttaaggaaaaattagagacttgaacggtccaattccgagttcaaatgaccaagttatggccatttgaagtatatatgctctttaagtgaatatttgcgaatttctttatttaaattttaatttaaaaaagatttattgcgtcagccgaggggagggggcgcgcggaccgggtccacgggggggtggcgcccacgcggcagcctcacagtccacggtggaccgggcgcacccggctcgcaccggccggcgccgtgggccccacgcgtcagccacacacgaggacgcgaccggctgacggctgggccccatgcggcggccacacggcgcgcccgtaggtggcca

SEQ ID NO: 48698 - DNA, 344 bp, Oryza sativa
ctttattatacccataaaccgggggggtcttttttaaaacaaccggcccccttatatttttttccccggtgttaaattcaaccctttgggccttgggggcgccaaaaagggcggctttgaaaaggttaacctgtacaagtggattacccccaaacattttttcttaaaaaaccagtgccaatcccccgggaaagggggaaacaatcaatgttcccacccctcctcccaaaccaaagggccggccaaccccctttggcgggaccctgggaaaggcagccgtttgagccctaccccggaccacgccctggccaatgattctggaatccaaacccaagttggtaagc

SEQ ID NO: 48699 - DNA, 172 bp, Oryza sativa
tgggccggcccatcaagtgcagatttacgtctactttgaaaccccaaacaagctatcagcatccacacgactctgcttttttttttttctgaacaatcactttcttttccattgatcgtttataacctgtttaagaactgacttgtgaaatgttgtaacacacttctgcagg

SEQ ID NO: 48700 - DNA, 192 bp, Oryza sativa
aagaagattttaaatatcccccactttttttagaaaaatttaggggggggaaaaacgcaccaattggcgttttaaagggacacaaattattatcctgtgcgagatgtgttgcattaatgataccggtccacgagaaaattcggacacacctccacttgccggccccaaaaaacgactttctcgccttccagt

SEQ ID NO: 48701 - DNA, 1501 bp, Oryza sativa
ctttttctttttccctccacaggcatagtcatgtctggctgattgtgttgtgtaataaaaactcttgctttcttctaatatattgacgtacaattcttttacgcatttatgaaaaaaagaaaatcattttttctgggagtaggtgtattaccctcgcccatcatattttgtattttattctctcaaccatcattatttgtaccatgctttgtttttttactacttcgttaacttctaaaaagaagctcataatcgaaattgattttttctaggaggaaaggtttattggtttattaccctcctcacccatcataatttatactattttattctctcatccatcatcatttaacaaaaaaaaaagctcataatctcttagggcctctttgaatcgcaagattgagaaaacatattaataggaaaaacgtaggaattgaataccacgcttattggattcctatgggattttgaaacacaggaaagtcttcaaactgtcgtttggttagcatacaggaaaaacgcaggaaccttagacacatgaagaggaaaacatgaggtgagatctcatgcttattttcctccaaaattgctctagtaaggttcattccataggaatttcaaaggaattgataggaaacaatcctttgttttaaaggactctgtaggattatttcccataggataaaatcctctagaattcctatggtttttcctttgattcaaagggggccttatattcatatacagagtagtacttttgattagacacatgtctactttgatgaaaaacaggtctggatccaaatcactttttctttagagaaaagagaacgcttttataccagtagtggtacaagtagtcaatactgtatatcagatttgctatttgcttgacaaatagggaaagccacacgtcatacaacactattgtgtattttggttgtgtatagctcagtacaaagtttggattttggttgaaattggagatgatgtgactgaaaagttgtgtgtgtatgatagattgatgtgatggaaaaggactaaagtttggatctaaactttaaatctaaacacagcctttgctaattttgcactttgcctatttggtgtgagaatcaccgagacagtgagacgtacagcatattggtacgtgtgcatacaaaaaccactccaaccgaccggaccaaacttaatcaactacgcaacccatataacctagtgcaatcataatagttgcacaacacagggttgatttaattttacaacacacaaggtacatacgtaatgcaaattagtagtagtacgcttgtacgtagtatacgattcatgcaaaatgtagtagtagtagtagtagtagtatatccgaatccaacggcctaccgatagccgtggacatgcgcaccgcgactcgtcatatgtatcgaccgaaccacatgtaggatcgatgcgcgcctgattaattaattagatcaaaacagcgtgtcgacgtcaggtttccgtc

SEQ ID NO: 48702 - DNA, 745 bp, Oryza sativa
catgcagcttgctaaactgacgcgtggtggacgagagtgaccggtctgtgactggtctgacagctgtcatgtcatcggcaaacaaccgtgcttccacgttgcacctgcttccgacggagtggaggttggtatgacccatcccatcggagggtcattcaaacagcaccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagggagaaaaaaaaggagagaggggagctcgtagaaaggacgaggggaaaaatagtagggagagggtctctagagttcaaaggctcttgctcttcagctctttgtaactccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaactggcaaaggggggcccgcgcggtctcccggtgaggagccccacgctccgtcatctggcgcgccaggtagggggcgcgtgtgtttttctaagctctcatcctctttcgtgtgcgccaagcttttcccgttcagcccaa

SEQ ID NO: 48703 - DNA, 1501 bp, Oryza sativa
gcatttattgcgggttggacgagcgcgtcacgccgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtcccggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcatcggcaaacaaccgtgcttccacgttgcacctgcttccgacggagtggaggttggtatgacccatcccatcggagggtcattcaaacagcagccattgcaaatctccgcccattaatgagggaggacagggctatcccggtgtcagataaaagtacgagccaaatcttgctcaaagtaggatgggtccccacccaaaagaagggtaggtagaaatggtatatgtggtatccccttgagatataaaaggaggaccatgcctaccaagaaaaagagagaaaaaaaagaaggagagaggggagctcgtagaaaggacgaggggaaaaagagtagggagagggtctctagagttcaaaggctcttgctcttcagctctttgtaattccttcagagacagatccgccagaacacaggagtagggtattacgcttctcagcggcccgaacctgtctacatcgcccgtgtcttgtgcgtttgctctctcgcgaaccattccacagatcaagggcttagaacctcacttagcgcccccggccgaaccggcaaaggggggcccgcgcggtctcccggtgaggagccccacgctccgtcatatttaataaaacttttaaattctattaatataatcttttaaagtaacttcgtttagaatacttttacaaaaattaccattcagcagtttaaaaagcgtgcgcgtggaaaatcagaaaatagaagtttggaagagaacaaatcctaagttacatttgtaaatttttggatgagttttctatggaagttgtatatctagtccttattttctaagcccagtaattattgcagcagacatgaaataatgcaattgcccctgaaaaacaaacattctctggaaactcaagctgaaggcacatacttgcgattatgttggagtccaaagtgcttggatgcaaaattccctttgtctctactcgctcacgtagcgcttgctagcattaagaaaggactcgctgtacggtcgtagataagtccaccattccgcgttaaagcgttttcccgcacgggctgagctggtgcacctcccacgagccttctcatcccctccggcccatccacctcgcttcgctagctagctgctctcccca

SEQ ID NO: 48704 - DNA, 1501 bp, Oryza sativa
cctcttttcttctccagtgtgtgaaatcttcctcgtcggcgtcgacgtatccgtttccacgagcccaacgacgaatccactcctcttgccaacgacgacgagctgtagagcaggatgagctgccggtccaaacgacaagtagctccgcggccgccgccgtcgtcgtcgccgccgccgccgccgtcgggatctgcgactgcctctaggtgcttcgatgctgcctcgtctgccttctttcaggccagtactgcaatggctcctcctctaggaggccaaccacgtactgtaccgtacactcaaacctgatggggattgtagtggctctgccttgcttgcttcctggatgttggagtagaacaataagctgatgatgctctcaactcctttgaccctgcatcctcagattggtaagaaaccaatttgcttgtgtgttgtttctgcaagaaacaagcaaattcctttttgttgagactatttagattgtagaattaataatgttttagcacagataggaaatgtgttgtttcttcctcgctcatagtcatgatttttggctcctgatatttcagtggtatggatatacatccacctggtggtttcctaagcatgttacaaactggccaacagccattagtcccacctcatgttttgttcccagcaacatggccacctatgccacctatggcaccagcaactaattcaggcactacgcatgctagatcaaggtcaaaagccaaacctgtcatcaacttagatgatggtgacaatgttaggactgctaagcgtcttacatgggcatcagatgaggacttgcggttggtgagtaaaattttagacaacttgcagggatttgtaccatcattctaaaactttactaatacataatgctaaatgtaggtgagtgcatggctgtaccactctaatgatccgatcaatggaaatggcaagaagaatgagagctaccggggagatgtagttgaattatacaacaacactacacctattaaccggaaaagggaagtaaagcatctcaaagatcaatggcaaaggattaagagatgggtgggatttttctgcgcctcctggaagaaggctgcattagtttatactagtggatattcagatgatcagttgagagactttgctaatcagttttatgtgaatgactatcctaacgaaggtccattcacagttttgcactattggaaggttcttcatgatgaacccaagtggcatgctgttttggaggagcttgaaaagccacacaagcggagcttggatgatggaagtgacacactatcacaaaaagatatcggagaaaaggagcgtccaatggggaggaatgaagctaagaaacaacgcaatggcaaaggcaaaggtaaaggcaaggatgatgatgacagtttacatgaagatatgaagaagtacatggatgttcaagctgcagctagcaaacgacatgaagagtttttagggactcagcaccgtatttcagatgcaa

SEQ ID NO: 48705 - DNA, 1501 bp, Oryza sativa
gaattataaaaaaaatttatataagacgaacagtcaaaattggacacggaaacccagggtttgccttttttttttggacggagggagtacaatacattattgattttggctgcagtagctcaagattcaagagtcaagatcatatggtgtagtgacctctaataagatagcctttttttttctttacgagacccacaccaatcaaaggactggtcctaccctaacatatttgggtgtattccggagagaacgttaagaacttctcccctcacacataaaactaggtgacttacatgattaactaagtattagcttaaatacttgaaaatggaatgatatgaatttttaaagcaacttttcaatagtttttatttttgcaaaaccatatcgtttagcactccggaaagcgtgagaacatgtagtataacacacccttaaaatatcaaatttgttcatccgctttcggagtgacttgctaagggcatgtacaaggtgagagagcatagcactagtttctttttaactcgtcgccgcataagggggtgctaagtgtctacagtggtggggaccgactgaaagtgaagtgtggcctgtaataagtgccaagtaaatatacaatgataagaaatcagaaaacaattttctctgaatgccaaatatatatttttaaacgaactataccaaacaatgagagttttatattaatataataggaaaaaagaatacaacactactatagcactagaataatcaggaaaacaaaaacaaaaaccaccactatactatacgctgacagcacctacacatcctgaagacctagcacataccgcaccaactgccgctaagtaggatcgagcaccgcggaaccaagacaaggaaccaccacttaactaccgaccaacacacctccaaccagttaaaacaactagaccatctggacaaagcgataaggactacagaaggaaagcgcaatagagaagaaagactcactcgtccctcgtacacacccgtcgccgtccaaaatgttggtagggtcctgccatcgtcaacctccacaagccacggtccctcgtaagggccttcatccctccaccaaacagctgaactcctcctgggggagcgagcaataaccacaaaagctgccacacttggtgactgatgtagccatattccttcatgtccctatagcactagtagaaccctaagatgcgccaccaccctccagccagtgatctccttctaccacgcacacgtcgtggtcatcgctgcattgcactggtatattgcacgatgtgctccccggtcttgtgcacgttgtcttgtgctgctaatgtgcacaagacatttaaatgggtgttgttgctttccaacttcagcagcaacccctgagatgggaccccaagtgcacatcagcggcataagaggggaaacaattttggagcttaggaaatgggcatagccccatttagcttccggtcttaaaatggggactatttattga

SEQ ID NO: 48706 - DNA, 1501 bp, Oryza sativa
gccgccggaccgagcgggcgcaccacggtagatctgatcgacggctagttaattactggtgtggcgtgcgtgcacgctccattcggtagtgatcagcggagaaaccgagtgagagagttgcgcgcgcgcggtggaaatcaatcaacgtcgtacgccaccggtgcgccgtgcagatgtagtagtagctagcccagcgtacgtactatataccagccacatacgtcgcacgacacggcaggaagcgcgcccgtgggccaggtgcggtgcctggggaatttagggggttaattggaggagcctacgcgtcgggcgcccgattggagaggggaaaaatcgggcgctaacatcagcatgacatatgcgtgcaaaaccactttaaactattttttctcttaaattatttatccaaatcatgatccgattgcatcattaaattcattgcaattaatctttaaaacaagaccacacatggatatattccgatgaattttttttagcttattcttgaattatttttaaatgttgcacaatgttttaacaagtataccggaattgtttcactaagtagatcgaaaatgtttcaatcgtttaaatcgggtgttatttcgccttatatcaaaacaatgtttcagcaaatagcgaaatgatatttcggttcactgcaacatttgatccatacatagtgaaacattataagtacactaggtgaaacatttttggtggaacaaaaaataaaacgaattcccttaatagagggtttccaaaatatgtggatgatttgttgcaaaaaaatgtttcaattcattgcaacattagatctatacatagtgaaacattgtgagtacactaggtaaaatatttttgatggaacaaataatgaaacggattttctttatagagggtttctaaaatatgtggatgatttgttgcataagaatgtttcaattcactgcaacattagatctatacatagtgaaacattatgagtacactagatgaaacattttttgtagaacaaggggagggatatgtgggtgggcccgggggtgcacgcgtgggagggaggggaagcgaccgattttctccctccccccagttgaccgattctaagcattatcggggttaattagttagggatgatcgatgcgggcatggcgcagccggggttggccgtgtacataccacggccgatgcatcacaggcgtacggacttttttgaggatttaattggtctctctggcagagttgcatggtggtgcgcggctatggtatcgatcgatcaatgatcaatctatatccccgattgacaggacacgatcacacgattggtcggaacgtacgtggctagctgttttagtttagtgtcctaccaaattaccaataatatactacctttgtattttaatatataacgttgtcgacgttcgatgtcgcgattccggtatttgcatagtatggggatcgttggtactagaatatacgcgagactgaggtaaaagag

SEQ ID NO: 48707 - DNA, 980 bp, Oryza sativa
cgaagatagtcactgtccttggcctttcccttgcctttatccttaaaattggtagtagcctttggtttgacatcaggcttgactttcttgttgttgttgttgtgggatgcgtgagggttcttcttttgcaccaaattctatccaaattattgctttgatttttgtaattggttttgggtacttgattattcagatcaagcttttgttaatagacatgcaaaatatccccctaaattttgcatctcttttaagtgtgaaccatcaaaactcgttgcgtgtatcatttttttcagacatagtgcgagtgatgttccaatggtcaaatcttgcatgtctatgacttgtagagtttgtatagtctatcagtgctgatgcgacacacatatcattatcttcttaataatgattttggggtttggacaaagttagaaccatgttacttgctagaaatggcgaactatgtccatggaacttatgtattttcatattctaacatagtatggttcactcttcacatgttgtaggcttacaggcctaagcaacataggtttctcccaattttatcttaaactcgttccaaaagagtgagcttttattttttatatgatgatattcggatcatcatcttggtttggggcttttaatacttgtatgcgagtgctcaatccaaaaatatctttagccattcattatcaactataggtcaacttgcaggttgattttcaaccataggtcaatgccaatgagtttctgttgtatgaagagaatattgcccataataggtttcattaccaatttccggtacctagtgctttttctcattgtgcaggtgccaatatgtgtgatcttgctagattggtttgggaagagcgtagtgtcaaatagacacaattgcagctatttcataagcgcattatgtatcggatgatcctttcaaaggactaaatatgtatgtgagtattaccgtttctttttcgagc

SEQ ID NO: 48708 - DNA, 643 bp, Oryza sativa
  unsure (1)..(643): unsure at all n locations
accatttgttataattaaaaacttaggggcaatttaatttatttttttctcgaccgatgaccccccactaaaattttaaaagagccgcggtgtgttcctcttagacatcccggggtaaaaaagtttccccgttggggcagagttaaaactcttttggaattggtttcccaagaaaaatttcaaagtcagtgnaaaaagagccatccacctcccccctggagtggtgaccatttttatgatgtttggcgttccaataaatagcagggtggccnatacaggnaccaggtatactattgtgctcgccgctcatgtacttatgtgactactagantatatgnatagccatgcttaataccatagctccagttgatggnanatacagtatgagactttttagtatcagatagagctgcgtgctcgagactctgngccatgcttcatggtcgtaattatccactaaattgcgactgaatgttggcctgtgggtgcatggttttgctggtcgcaccatgggtagttagggacgggttcgcggaatgccttgaaagaactaatcgtacttcccacaagccagcgtgggcacgggctgggcttgtagtgtagcttacctctagctgacgcatccaggcaagggtgggcgtga

SEQ ID NO: 48709 - DNA, 167 bp, Oryza sativa
tgtggctattcgagaactgcatttggtttgataaagcgggcaagttgtgtagtagttatgcaaatcattttttttaaggtttctttcagtcgcacgtacttctattagattaactgcatcgtcaattgtaaatatatttctccttttgagatgttaggtgaaggcca

SEQ ID NO: 48710 - DNA, 423 bp, Oryza sativa
atcccagtttataaaattattttgatttaagttaatgcattatcgctttatttaaattcccgcgttatcactgttttatttagccatgcctatttacctttgttatgaccttattattattgttattgttattattagcttattcaccctaggataaacaaaaccccaactagtgggtactctattcatggttccactagtatgaacttaggtagatgcttcgctgattaattaggcaacattaggtggttttataaccttagactttgggaattctcatatcacttggacattgtggaatggttggactattgtggaattggattcacacctccccctctattcaaaaccctcaaaatagttttaggctgggctcggggtgcatggttttgatagtagcacctcggccacataaggaccggt

SEQ ID NO: 48711 - DNA, 399 bp, Oryza sativa
ctctcttatggaatgctggttggcatcaataacctttttcccacttgaaacccctccaaaacggcctggaaaccctgaaatcgcatgagatctcgccctatttggcatggggttaaaattccccaggcgaaaacgggtgccatgaactgtccctaatgccccgtgtaaataaaaacggcggaaattacccagggttggtgttaccaaaacaatatttcatcaaccccttggggatacggcgagttttcccggtcaaccccctttctgtgatttatgtggataaacccgcggaacactgcggggtatcactctcagacgggaaaaacgctcactctgtccttgacaatcgggtgactccggtgataactctctctattatccaccttcctcgtttctagc

SEQ ID NO: 48712 - DNA, 355 bp, Oryza sativa
cttccagatctctgcagggtcatgtactcatgcggcctgtagccacaggacacattcagtactgtatccctgtagcattcagtagcatgtagggaaaattttctaggatcgctgaagggtgctgttccttcagtaacatgagtacatgcattctaaatttggctgcaatgtttacattaaattttcctttaaaaaagaagcattgctttgcctagtgaccagtagtgtacttttatgcaccgttacctgttctgtgttccttccatcctcagtttgacatttcttggttttccatatttcatatatttgctttgttcttgtgtacatttgcatatatatataaccttgattgatc

SEQ ID NO: 48713 - DNA, 183 bp, Oryza sativa
tttgagagcactaatcttcatccttggctctgataactcccaggttctcatctctcacttttgcttctttgattataggcctgaagtccagaaagtcctttggtcatgtgctgctctttccactctgagaagcagcagccacgagactattaaaccaagggaacatctgttacggttccttgg

SEQ ID NO: 48714 - DNA, 1501 bp, Oryza sativa
tgtgattcatattgtatggctggtgtgtggaaatttcttgatgtgggatctatgaccttttgaaaacagtatgcaaaggtaccactaatgaaacatatcctgggtagctgtcttcttcaatgtaccagtcatagtcaactatactctatttgaccatcttttgatcaatcaacagttagtgtgaagctcaagtaaaggattactcatttgtattgtcagcctttcgcttaaatcaatcataataacacggttcacactatttcaattatgtttgaatcccgagtcaaaaatgcaaagtagttaaaaattgtcctttcagggatcaggtgttcattgtatacaataaataggtccattcggatctcaattgatattacaatcagaatttttaatttttaaaaatgcaaaagcagaacagagggtgacagcatccttacatgtttcaggtgatgtgagcacggtgatgaagctaatacgagagtccatttcgaataagtcaaaagttgtacatcctgatcatgctttcagatagcttttctgaaaagagagccccaggaagtgggattgctgaattttgccgtacaactttcattgatgaccaacacggtatctccaaagtccagattgctactccacaatcaaaatacgagaaacttcccagcaagcagtacggagtaatcctctagcacaagtgacaaaccgacagttagaaactttcatggcacagggcaatcacacgatttgaaatacagtcaagtgacacatcattccacgagctcattggtaaatcgtcattgtttataccatgacagtatttgagatgatagcgattccatatatgattttcttaatttgagaagaaagtgattctatgattttctaaagaaaagaggtacagaagacgcaccattcctaaaataagctccacagtgcaacgcagaccatgactaactagatcagctccagggtgcagcatcttgcgggctaatctacatctgtttggacattgaaggcatacttcatcaagaagtttttgacaaagcgacaatattctgagttctgagcatcgtaaagtagtacaactgtaaactgtttgcagtacaactgtttggacatcatgaatttgtatgactagtaaagatttccattaaaaatgcagaaatttcacaagaaatttcagagaaacagttgaattcccacggagagatgaacattttcgcacctccaaaaacccctcaccacggacgaagcagtaataaaacacatagttcgttatcctcgatctcctgtttcctggtggcataagcatgacatggaaattccatctaggttttcagcatcaaccatcgatgctggctaacaacaatctctgggctaaaattttgggaatcgaagttgctaaagcggggcaagctttgggccagaaccggcaaggtcagtgctgggctaggctaaacagaactggaaccgagacggaggagtaagaacctgcaacaaggaa

SEQ ID NO: 48715 - DNA, 1501 bp, Oryza sativa
agccactaccttgatgcgtcgtgtgtactcgtatagtatgctaccacgaaccatcgtcacaattcgtctgtggccatccgacctatttgtggtaggaaaacagggttcgtcggatcgtggccatggggagagaaaggccatcaaggcatcaacctcttctagatagtaaatgggctgaaaatgcaaggacatcagatccgtgtatcgcacgcgataggatttagcccatcaaagtaatccttatccgcaggaataagttcaacagccgtccctcaacttcgcgtcgggttatctatagccctcaactatcacaaaccgtgcaaaaaaaaaaaagtcccgagcagtatcgatccaattcttcttcggtttcgctaacgtggaatatatgggccccatatgtaagtgagaaggaaatatgtggggtccgcatctcttttctcttcttttttctttcttctcctttcttctcttcttgggcgaggctggagactggtgcatagcggtcaggggcggcgagcgagctgccaccgtgggatggcgtcgggggagctatcgctgccaccgccatcctctgtgacaacagctctaccgaccttcgcgagctctctcacaaagatgtcgaggtctacgttgacatcgtccgcagccacagcagcgccgcctcggcttgcgttgggatgggacggaggaggtcgacgaagaacccgccgccgaggccgagggcgtgccgatgttgcggcctgctcctctgcagcgatagggagcggcccctcggcgaccatgagttctccaccgtcgtgagctaactcgcatccgttgtctacctcagcgtcttcgcgcaccctgacgtccccgcaaccaccaccaacgacgatgaccagcgcggctcccgctaccgccaaggccaaggctacgctgatgcatggtgttgggatgatggaggctaaggccgtgccgttgcatggaatgatgcgaatcgcaacaaagtgccacccgccgccgctctgccctcagccagcggcggcctcccagccttccagctcgctgagaaagagaagagaaagagaagagaaaaaaggatatgcggaccccatattttttccttctcacttacatgtggggtccatgtataccacgtcagcaaaacaggagaaaaattaggtcaatactgctcgggaccttttttatttttttggcacggtttgtgatagtttagatgtagtgatttccagtgaacttattcctatcatcaatagttgggctgggtggtaccagcaacattgatgggccttcaaatgtgagggtctcgtacaagtacacaccaaacagcaacactcatttcttcgttctccaaacgtaaaacactaacatgattgaacgtcgagcacttcacaatcataccctaaacaaacacttccaactgttccatgctgctagaagaaaccaacacatgtcatgtactcatgtatgctgttgaagcccggtaagaataatgctgaaa

SEQ ID NO: 48716 - DNA, 1501 bp, Oryza sativa
gcatgtatgaccagacagctaatagcgttcttctgcacccactccatttttccgtacgattcatcaagaatataaattatgtctggatcatcaaagaatgtacagtacaccctcttctgtgatagtcccatataaatatttgactcctcgtaccgttcaatctctactggtggtttaattattcgatacttgccatctgacaaagatattctgcaaatattggaaaacttagaaatattaaaacatgataaaattgagtgatactatttgttaataaagaaataaattataatacttatcagtgagactacctcattacaaagttggtttgacagcgtacataaagtactccccgacagtagacagcattgtgcagaaaatttggaaaatctcgtcgtatgatagccaaagatcctgcagcctccccttctcgaacaaatgatctctcctcccattgccttgtccttgttgagaaaacatgcagaacgcatgttgacggtggccattctattccctctattgcaggattcaactcagagcgatggcggaagacatcaacataggggatttgaaatacctcaaagtgtgacgacaaggtggggtcaaaggcaaggtacaaattgtctaagtgcatgatcccaatatcaggccttggaggtggaggcaattgcacccactgtcttgtagccgggttaaccacataaaactgcttcatgccgggacgactgatatggctgtaaagcaagaggagcccattgcagtggcccctaactatggatgtgagaggcaaatagttgatgttgccagatattgtggggcctgtcgaggggcgggcgaagaattctgacaagcctagatcatgaaagttgatgaatatgccgcctactgagtgtgggaggaggtccacacgcagcatgcgatgagtgtcgatgatggtgcaccagagtttgcagacacagcgagacatggcaaggtcatgtggcgcaagacaacggaggatgattgtaagcacatcgtcaggcagaagctttgccatggactcctgcttttctgacatactaaggtgatatgtttactgcaatccacccaatcaacacaaccccaccagcatgtatctgcacaattgaaagaaactaagtaagcttggctaaacagaatggaagaaacaactaacaagagatgcccaggagtttgggtgagactgacttttggatggattcaaattgtattgcgctcttgtctggcgagtttaacggcgttctgttcattgtttgccaatatacgagcactacaaattggcagttattcatgcagttgcagcaactggtaatgttctaggacataatttatcagtcccgggtactagcacatttccagaccagaccccgctcagaaacagtagcaccatgatataccagaccagaccagactagaccagaccagtaaagtaatgaataatctgtatgtataaagcagtccccctaacaatacagtaatatgt

SEQ ID NO: 48717 - DNA, 1501 bp, Oryza sativa
cgtcgcgacggcctcccacgacttggccacggcccacgggcagctaccagacgatcagttggaggcggcacagttacacgcagcacgagtgattttgccgttggccttccatttatataagtctggtgttgcagttcgcagctcgcaccaatgcaatagcgaaactcgtcattttggatccagtgaacagcggactggagaacgacgtcggcgacggtgcagagcagagtgcagcactactagcagagtagcaggttgttcaatctgtactcttttctgatctctttgatgtgtcttacaggcggatcatagaaactttactactgtactagtactgaatactgatcagtactatacataactacatataaactactccatcagcaaaagttactggctagtaatatgcagacttgaattatacttgttgatttggtcatatggagagcatgtcagcaaaaaggaccatcccctgcatactgacagccaggagatcatgttgttaactaccctgaacattttgagtttgttgcaagagcactgtcagatcaatcggttgggttgggagaagaggacggtatggtctgcacctatgcatggctattatcggtgcattagaattcagagatgtactagtcttgcactaaaggcttgcacctaatttctattgattgatatctcgagcaggagtactagaaaatagtactactagtagcaatcacctaccatcagaagataacgaaatggattatggtacatgatggaattagttctgttcgcacgaacctgataatgcccgtttaagcctgacaaaaccacgtatcatggactaatgacgtatgcatgatctatgtaaaaccaagtgtgattttggtttattcgtgatggaaaattggcaacgaaatatttaaccatgagttggtttgagtaagaaatttggtttggattgttggcgattttaggcgacaatgcttatgactaacgtaggtcaggttacgatatctgtgcccagaatcggatatttgatttacgtgtgtgcaggtgatcgaagtcaaccgcggtcaatggcgaggaccgggactatactcagggaggagcagaggtctagcacggtcaagaggccatgtgacaaggtgggactgacgtcatgatccctgatggtcagcctgggtagacggcggattgggactagactcagggggagttgaggtccagaacgatcgacgaatccgtgtgacaaggttgagatcaaggtgacgcacggtggacgaacaccgtgtcgggaagacttcacaacgggcttcacaaggtcaagtgtgcaagtgccgggttcacgaagaaaatggagaatagaagaggagctacagtactaagtactgtagcatgcaggcatgcgctggcgtgtgcatgagatggcaagtgcagctagctgattggctagctagcttgcacatgggctctgttgggacggaagccaagccaacgcctgattggctccagg

SEQ ID NO: 48718 - DNA, 1161 bp, Oryza sativa
tattcttagtgctacaaatctagataaatacaagagtctagaataggatgatgcattcttaatactatgaatctggatgaaataagttcttgtattttgagacggagggaattctgaataagattcgtagtattaggttgtgactaatttagtatatatgttgccatattttatgatggatgaagtatattaatattggttactattatcttgtgctatttaatgggtggctaatgggcgggtgatcgcccacagcgatcacccgcccattagccacccattaaatagcacaagataatagtaaccaatattaatatacttcatccatcataaaatatggcaacatatatactaaattagtcacaacctaatactacgaatcttattcagaattccctccgtctcaaaatacaagaacttatttcatccagattcatagtattaagaatgcatcatcctattctagactcttgtatttatctagatttgtagcactaagaatacgtcatttggtcctaaattcttatattttgtgacaggggagaagcaaccagctacactagattgtacaccatctagcactatgaatgaagtaatgctaggttatctaatacttaatactttaatactaagttgttatatattaggacaaataaaatagcaattcagtcatcttggttaaccaaggtatggccgaataagaccctgtttagatgggactaaaacttttaagtctttatcacatcgaatatttagacactaattattaatattaaacgtaaactattaataaaactcatctataattttggactaatttacgagacgaatctattgagcctaattaatccataattagcatatgcgatgctacaataaatattctctaattattgattaattaggcttaaaaaatttgtctcgcaaattagcttttatttatgtaattagttttgtaagtagtctatatttaatactctaaattaatgtctaaatacagagactaaagttaaatccctgatccaaacaccacctgaactcaggtagcacgaaaagcttgaccgaattagtttaaaaaatcggtctccatcacttatgtatcggtctggaaaaagcagtccggtttttcaatctcggtcatttttctcccaccggcacagt

SEQ ID NO: 48719 - DNA, 1501 bp, Oryza sativa
gggtcgcgctttcgtttactcacgcattccgacgaaccagccgttaacgacctcggcctcgacccttgtattccggatgatttaccttgctgccatcgctctttttgcgacctgattggagtaatacccggaccccaacggcaagaattgatagtttgaacagcatacagcaacagtcattggccaaaacctctcatcttttttgcttcctcgtactccgtttccgttctgggagaagcccagcgaaaatctcacaattgggccatgggccaggcagccagcgatatttacctgtccaaagcctacgcatccgcagcacaaccacccccagaatcccgtggaatcagtcgagattaggggcaaaaacgtgagaaaagccacccgtttcctcaccgcgacagctagacggccgcgcactacctgcctgcctcctagtagtgggggagcgcgcggcgcgccgtcgtataacctcgcgctgagagcggagcggaatcggaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactaaaattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgata

SEQ ID NO: 48720 - DNA, 1501 bp, Oryza sativa
cgaggtgttaggggctgtgtaaagacagttttgtccttgtgtacaataacccatcggagccaccacttttcctcacccgggaaatcgccggcggcgagcccctcgtcctcctcctccggtgacccgcagcctcccgcgatgcgatccgtggcgaggctgctcgccgcgctccgtcgtgccccgccgcacccgatcctcctcctcctccccggccgtctcttctgcggcggcggcggcggagatccggcaatcccggtgctgccttccacgccgcgacgccccagcaacacatcgctaccatgccatcgccgtacaaaccgggggcgcatcgtggcacccccggagcaaacaccgccgccgccattttagccgccgccgttgcatagccgtcgtcgcccgccgctttgccgccgtctcccattgcttccaccgccgccgcacgacgccgtgccaccgcccgccgtcgtctctctctctctctctctctcttcctcccggccgcctccctcttttgcctccccggccgccgccgttccattcccggcgtcgacctccggccgctgtcaccgacaagcaccagccgccggggctcctccctctcctctgctcacgccctctctccttctccctgtgtgcaagaagaaagaagagatgaagaggaggattaaaggaggaatagagctgaaaatccttcaggggcaaattagtcattttccccacatgtcagagctatggaactgttaagttctaacagaaggtggacggaatggcacacgggtcaacgaaagtttttctcatgacatacaggtgactctaaacttttttgtggcacacatgtaagtagtaacttttttttaagttgcataggggtcttggttctccttctcctcgcgccgcctctactcactctggctcaccgcccccctggatctggttctcagaaggcagacgagagagcagacgagaggggggagagttgcggagcagcggaaaggggtcgccaatcacgaccctatcttcgatccgtacggcgacggtcatcgcgacccccgcgaattgctccgtcgcggcgtcatcccgtgaaccaggtgacactgaggtgaacttcccttctctctcttcctcccccgttgtccctctccctcccctcctgtctgccaacaacagaatcattggggttctgatccagggcattatcccgatatcaaggtgcatacctaggaaggatcatgatctaagtgggtttgttttacgcgtacttgatcagttcatatgatcgattgttattactagtagttcatgacttcacgagatcagatattctcgacatatcaactaattttataaacggcacacatattactgtattgttagggggactgctttatacatacagattattcattactttactggtctggtctagtctggtctggtctggtatatcatggtgctactgtttctgagcggggtctggtctggaaatgtgctagtacccggg

SEQ ID NO: 48721 - DNA, 466 bp, Oryza sativa
ctaaagttagtggagtaggaatagaataagagtcttagtcctagaagtcttcggaaggattcaggtatggttctagtagctctactctcttttgtaagacttgtacttttaatagaatattcttctttataatactttggtattgtatatgaataccaactttattatatatccaaattatattgattatgatgctagcttatctgggaaatgcaatggtgtgggtataatgatcgtgtatacgattattctatgtcatgacgatgatattatagtagtatttggtaagttaagcgtggtgtttagattgctggatattattatttggggttatataatgcgaatttgtcgaggtgggctgctaatggtgacagctcagtatgagtattcctccacgtgtatatataatcctaagttactttcctgcggagggtactcctccgtgtttagccccggttggatgatt

SEQ ID NO: 48722 - DNA, 1501 bp, Oryza sativa
  unsure (1)..(1501): unsure at all n locations
ggaaccgtggctttaaccggcgcaaaccccgaagagagaaaggcggccgtgcgacaatgattgtggatgccacacgttggggaacgaattgggatccaccgttgtggcggcgcgaaattgaagaagggccgcggctatcatgatgggcncggtacgggaatatggggcggcaaatgttcggcggcgcaaaagaaggcgcgcccccctggggtggcgtcgttgcgccccacgcgggggaagaaaggcaagcgccccctgggcgtcccctggggggcgtcggttgcgcccaccggcggcatcggtagcaccaaaaggccggcggtgtccgccaaaaagggtgacggtttaaccggcgaaaacggcggcagcagcgaattcgtgggggcggttagggttaaaccctacccccccgacggcttcccctgcttttttgctgagggccggatgggcgggcccaccgccccccttgcctgccagcctagtgccacacggtggtaggccgaatcctttagatttcggcccacacccaatttaccatttaattttagtttttaattttattttcagcagcaattacattttagtccctaatgttttatgtaatttagtcgaagcagttcatcagttgtacaaacaattatgtaatggtcctatagaccactgatgttatgtgtttattaacataggtgtttatttaaataccctgtttcactaaatttatttgttgtcttaataacatgccttttgcatattatttcaagacacgctctactttctcgctttattaatttacaaaattctataaattctgtattttgatttagcaaattctcttaattatgtacaacataattaatggaggatttaatacatgttccacttcacactttgacttggaaattaatcacatgtcgatggagtcctatactttggtcatatcgaccataacttaggcaacgagtatctcgcccatcatcaagtggtctacattttgagatgattacccgatggagtcctacaaattgaccgcactggtcataacctaggcagcgagcatttcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctggagaccgtgttttaggcagcaagtataacttgcccaccattaagagatctactccactgtttaattacttggatattatccacattgtgccacctaacattacagaatatgaagtcttacatttcgcattgagattacaaccacaatatcatgtttttattaatttacctctgtaaattaataatgttaaccatgattgtagggacatggcaacaaaagagttcgacgaactcgccctcgatgggactaactatcccatctgggcttctgatatcaaaatca

SEQ ID NO: 48723 - DNA, 1501 bp, Oryza sativa; identical to SEQ ID NO: 38651

SEQ ID NO: 48724 - DNA, 1501 bp, Oryza sativa
  unsure (1)..(1501): unsure at all n locations
aataaccggccagaggggggcatacgaaaaccttgatgtccgacgaaatcgctagccgatgaaatcccctttctcccctactctccctgatccaatctccgtctttcttcgtctgtctccctcctccacccgagttgtcgccgaccagatcgaccaccggctctaagccatcgttgctgcttgtgtggatccgccgtcggcgcctgtttcccgttgtctctccgcctctctctcacgcagatccgccctccctgtttttgtttgattttgcttaagcgggggaggacaatgtacggactctcggacttacgaccgaaaatacggaaaaaaagagaggtgatgatcagaaagttatggattttttaaatatttaagattaagattaagataatttttttttgaaaaaaccgacatctattatatatttatggcaaattttgctacagaacacttncgacttcgtgcttttagccgtaggatactgtccgaactcatttttggggaaaacattccatanacgtgctaatttaccaatggacaccgcgccgattagaaatataatttcagttgaagaggagagagaanatcgtgtaaaatgtcaaaaatgcccttgggcccacatggcagctctcctatctctcttctcttctctctcaatcttctcacagggagaatgtcggtcaccgccgccgcgcggcgctttcttgaaccgcacccacatccgcttcaggtcgctcgcggacgggcgggagaaaccaatcgatagacctttcataatgcttcagcttggttcaaatcataatgtatactccaatagaatctggtcaaaattcatgccaagttcaggtttaccaaatagaataaattgacactttttttcaggaattaaaatcagtacccatggcaaataaccaattcagacatataaaatcagtaaataagtttacatgcaatgaaccgattaagttggttgacaactaaccttacatgactcgattgcaatgatgtgcacctgtaggatgaaggggtgcagggttgaggcttgcacacagaacggttgatgtgagggaggtatagatcagaggagaggccgggttgcagcggggattgcaagaggcctatcaagtttgcaagagacttatgaaagacaaatcagaataggcacatgaattatattaaccagtgcgcctcctcacccaattgatttggcggtttctattgtaaatacgcgtgattaagggatgaagtgaataccgcatgtaacgccgaacaggatgagggagggggcggttgaggccggcatggcgctagggttcccagctccggcgtggctggcgcgtgggggatgggggaggcagtgcgacgcggggaggggaagcggctgcatccgcggcaggtccaggacgcagctcgcgcacgcgtgcatggggggagaagcaagcgtggcagaaggagatggaaggggaagcgagtgggggaagtcgaagggagggggaagcga

SEQ ID NO: 48725 - DNA, 529 bp, Oryza sativa
tcagaaactaaaagtgtctagtagagttctgcactgtcacaccctaaaaatcccaaatatataaattgttgtctaaattggaattattagaatttattttaaaagcctagaagagaagatctagttttaattaataaattccaatataaaatggggccagataaaatttcattaaatactttgcttaattctataattcctagatttttctgggatttatttgagctaaggaagtatttttaataaatggaattgcatttcatgaataatttaaattggaaaaggttttaaaagttctcttttggctttgggccgaaagtcggcccaaaacctctctctctctccctcggcccagtcggcccagtccggcagcagccgcccgtgcgcgcgtccgcccgctgacaggtggggcccacctgtcagtcttcgtcttcctcgcgccgctgccgcgcccaaaccctagctgagcagcgccgccgtctccttccaaattcggccgcgcctttcctttcccggtgaaatcaataga

SEQ ID NO: 48726 - DNA, 1501 bp, Oryza sativa; identical to SEQ ID NO: 38655

SEQ ID NO: 48727 - DNA, 153 bp, Oryza sativa
tccaaacccactaggttacgtaaaagcggaagcccggaggccggagcagttggtcgccaccgtcacgcgcgttccccttccctcgccggagagagaaaccaccgacgcggccgcttccggaggaggaggaggagttggggtggaggggagcta

SEQ ID NO: 48728 - DNA, 750 bp, Oryza sativa
acatcaccaagaaatgcatgctgtctatggaaagttagtatattctgaactgatattggtttcctttggaatgtgctacaccaagtctgtatttgaggcaatacattaaattaggatatatataagagaatacttgaggtcattgttgtggccaatgtattgacaactgttcattcttcaatgtaatggtgcttactgatacagcgaatcgatgaatagctattcattaatctactggttgaactgcaaagtatatatgttacaactcaaatcagaggaaagctaatcaaatctccaattttgtttggttgcatgtatatacttttaccatttagagtcttgtaaaattgccgcactgcgtgcgccagttcctgaatcttctcccatcctggagcaatgaacttggcagtttaacattggactggttcacttgctgatggcagttccaatctcccttgataactagggatcctagtagggttcttgtgttactactttgatttttatttagctgatgagcaatggctggcaagacagtaaaaatcctctctagttaaggaccccaacatctgtgctttgtatgatctctttggttcaggacttagtcatttgaatattatctacattatacatgttgatgtagttaggtttgcctattatcagagctgtagactaaggtgctatattggaccagtcgatgtttggcgttccattttcaatccttaccttttttttttcgttttgcagaaa

SEQ ID NO: 48729 - DNA, 1501 bp, Oryza sativa
aaataaaccaacatcaaatcagttttattaaatatactattaaagatatcttgatagtgcatttttttaagatattagcagaattttttactacataaactcggttaaagttaaaagaaagtttgtatagtacgtacaaaactaaaacaaacaaaaatgaggaatgcaaccttgttgcatgaaaattagtgattctttagtttttctgccctttaattgtatgccagaaagttgttgttgttttcatattttcttttgttattcctgcatatattagttgtgggttgatcggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtgatggagaccgattttttaaactaattcggtcaagcttttcgtgctacctgagttca

SEQ ID NO: 48730 - DNA, 1501 bp, Oryza sativa
gtcgccgtttgccatcagagccacgagcgccgacccgaggtggtgggccttcgtcctcggtacaatgctgttgagaaagatggaaaagaggagtgaggagggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaaggccttcaacctgcactgagaaacaaaagagaagtactcatatagacaaaattaggcccagttcctatcgcaagaaacataccgaaaacatagcccaatacacatatcaagtctcaatgtgtactacctccatcccataataaattcatttttagtccctctaagttctcgcaaataagtttatttttaaataattattgtatcggagtttgtaaaagtatgaaataattacatcagaaatagataaagttgtattagaaataaataaagtgtagaataattacattgtgatttgataaggtagggtattttagtttttaaacttattttgggacagatggagtaaatgaatttgtatatatggttttgaaaacctctagaaataagaacgtgcatgtacgctcacctgaaaattttgtgcgctcacaccatgtgctacatttgtcttttctttcaagttatttattccacccatatatactggcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttc

SEQ ID NO: 48731 - DNA, 1501 bp, Oryza sativa
tctctatatttagacactaatttaaaatattaaatatagattacttacaaaactaattacataaatgaaagctaatttgtgtgataacttttttaagcttaattaatccataattagagaatgtttaatgtagcatcacataagctaatcatggattaattaggctcaatagattcgtctcgcgaattagtccaagattatggatgagttttattaatagtctatgtttaatatttataattagtgttcaaatattcgatgtgattataaacagggtctcattgcccatgtttttggaagcttcaaaggacaggtgagtccatggatcctcgcgcaaatgggggcacccctgctggagggaaggcagagggatactgttccctattccacagggtcaacggctgccaaaactctaccaatcatgaaacaatgccaagcttcaagtgatggttcagtactagtagtactactgtacaacattagcatctcttgattattttctgtacatcttttgtgatttactttagtcactggtgaagtaaaatacagtacccctaattcaagtacaaacaccctgctgtggcttgggctgttggtattgacactcaccagtacagtggagtcaaatctaccacacatttgaaagcaaaaatgttagagcaacactactaagggtgtgttcggacccaagggttcccaacacctctccatcgttttccgcgtgcacgcttttcaaactgctaaacgatgtgttttttacaaaaagtttctatacaaaaattgcttaaaaaaatcatattgattcatttttgaaaaaaattagctaatttctaattaatcatgcgttaatagaccgctccgttttccgtgcgaagaagatttgttcccaacctcccccagcaaacacagccttgtttgggtgatagagagtaagaatgcacatcgttttccgcgcacacgcttcccaaactactaaacggtgtgttttttgtaaaaattttctatatgaaagttgcttaaaaaaatcatattaatctatttttaaaatttaaaatagttaatactcaattaatcacgagttaatggctcacctcgttttgcgtatcttcccaatctcctcaatcctcttatccttaaacacaccctaagaacatcatcattcattcagttgtatgactgtgtcacggtgtgagacgtcatatgcggcaccgaggcaatgcccacatggcaaaacaactcttccaagaaatggatcaaagaattgccgagaagcaacaaaatagccttgcaacctccctaaaacttcaagcaaactacaagcatttcacgatccataccactctttgctttctctgatttcttcccacctagcattacactatatgcatctcattaaaacaaaaaggaaaaaaaaacgcctagaaccgttcagaacagagttggcaagagacattaaaccagctcgtcctctagactatcctgaggactcctcaccagctca

SEQ ID NO: 48732 - DNA, 1501 bp, Oryza sativa
caattatgggtggaggttcacaaatagacttcaataaatgtgttctccttattttggcttggttaccattgtttttgtttagtgtgttctttttatctgaactacacttttttttgaagtgctactttataataattggttgtagcttttttttagcaaaggctgggatgttatatttcattatctaaaaaaaatcgtttattcgaggcctcgtgacgtggccctttaagcaatgcactcttgagtaatgagtagtgctcattacatcttgacgacaatcgatatcatattttgctatggatgttccttctgagtgaatcaaaagcaaaagtcctactccagataatgaatcacacttgcaataatccactctaagaacatggtagtactgctatactaaaacgatggagtaattagtgaaaccctaacgataatggtatttttcatgataagttggtttggataacaatatttgttgtacaaatcaacttgcatctctttgttaacctcatcacattttagcggagagaaattagtgaaaccctaacgataatggtatttttaatggtaagttggtttgtacaacaatatttgttgaaattgcgttcgtcgatagtatttttagaataggacgtttgccaatgacatttgttgcattttttacatatctaaactgaaacggagagagtgatggatttctaccgtctattgaggccttgtttagttcccaactttttctttaaactttcaacttttccatcacatcaaggatgtgtttagttctacgctaaaattggaagtttgaagagaaaagttggaagtttatgtgtgtacaaaagtttcgatgtgatagaaaagttgaaagtttgaagaaaaagttaggaactaggcctaaaactttcgtactcacatcaacttccaacttttttctttaaacttccaattttggtgcggacactcggtatattatagcactgttctgatttgaatcttcatcatcacaccctcaataatttgttcattgcatggattcattctgtcggtcctttttctttttacgtggctgtctttctttcattctttttttttttgccggcaacgaaacaaagtaggagcagtcgagcactccactccaggcaaaggtgtaattgagttgctcctgcaatacaagcatccttcaaccttactcctgttttatcctgagcatgaaaaaaaaagaggagcaaattgaaacatgtatcctacagaatctgaatataaagattcccaaacccaaaatctttgaatatttcccgagctcccagcttaatctttgaatatttcctgagctcctagcttagggtgtgttttagttcacgctaaaaatgaaagcttgattgaaattagaacgatgtgatggaaaaattggacgtttaacgaaaatgttgcgaactaaaccaggccttagcacaaatcgaaacggcgtcctcacaccaacaccaccgcaccacagcactgttgc

SEQ ID NO: 48733 - DNA, 1501 bp, Oryza sativa
ttcttttctgattaatttacgaacttcacttcctgtgctagttgcgcccgagagctcgtggctggtatcgagctcggcttagggggagaacaagttcttttcttaaactccaaacttcatcttacttatttttcgtcaatatatttttctaactattaaatgatacgttttttaaaataaaatatagaagttgtttaaaaaaattaaagaaaatcattttttaaatttataatagttaatattttattaattacatgctaatgagttttatcgtgcgctaaaaatttctgtagtgttggatggaacgaacgcagccatctcgtaatcttcattcaccattttccactgcgctccctttgtttcttaaagaatgaatcgtcatgtagtaccacagtatcatccatggccgcttccgcccaaggaaacaatctagcaaccgaaacatgcaggaacaacataagcacacaactttagccgcagaatctgatcaccgcaaattcacataacatgtcgctatgtacatggagatgaaatctcctctctctttcactgtcttataccaaagcacgagtgaaagcaaggtcaagggggttcggagataaaaattccgaacccccgtagccgggtttactcttttgggttctttctcgaacgatgtcactagggtttgaagattagttgacgagggcaaacgcggcggaacagaattttaatctccggtcatgtttttctctttcttaatcaacgactgaggctgtgtttagttcagcgcaaagtttgaatttttattgaaattggagatgatgtgactgaaaagttgtgtgagtatgacaggttgatgtaatggaaaaggactgaagattggatccaaactttggatctaaacacagcctgaatgaggctaagagcaaagtatagccaactactaactccaattcatctatagccaatctaatagctcattcatcaatagttgcatactacactattaatacctggtcccaccagtcatacacacactgcgtcttggagtccgtgctacagctgactacaaatctgtagcccgctgctcttctttctccttatttatcttcttaaaatatgtttgcagctggcttatagcctgctattgtacctgctctaaaggggttgtacgtgagtggctgcacctggctattattgtgccactagtactccaaacatgttaagtgaatttatacgcgtgctaaaaaagccgatgatatactctatctccatccataaaagttagacatgtttcacatttgagtttttcaaataagttgttcttatttgtagtctttatacatctaagacttaaatgaagagataaattaaatgtttgtgagaacccaatgagtaatctaaatattcattgattgcttgtttacatttactcgttgattttgtaacatccaagatgatttaatttctccttgatcttggtgacaaaagtaatatgtgcaacttttgtggatggagg

SEQ ID NO: 48734 - DNA, 1501 bp, Oryza sativa
gtggatatagtatatgatgcaaaaaatccactactgctcccatcaattcacggcctgccacaaatcgaacaattgtacagcagataactgcatatctttcgactccccaactacgtactatacgcttgaagtaaccataccctaaatccgacagcacaatacaatcgcattatgagattcacctcacgagtctatcaaatactaaatactactactacgagtgaactaatccccccgaagaacttcaacaaccaagacctcaacacggaaatataagaaaatcggcctttagcctgcacaacgacagcactaaacaacaacaatagcaggagaaagcttttgcttcgaagcgaccagaacagaaatccacggttttatggctagagagtcggggaatcaccggatcgaggctgaggtgcttgcagagcgcgtaggccatggcccgcttgctcgccgcgaagtccgccgccgccgccgccattagcacgtcgagagaggttgcgccgagcttgggggtgagatgggggaagtggagaagagggcagagatggttagggtcaagttgcagttggagcggccaatgggccaatggcccaatggatgctggccttcggagtgaattgggccgtactgaggcaatatttggagcgttttgagcccacgggcttcttttctgattaatttacgaacttcacttcctgtgctagttgcgcccgagagctcgtggctggtatcgagctcggcttagggggagaacaagttcttttcttaaactccaaacttcatcttacttatttttcgtcaatatatttttctaactattaaatgatacgttttttaaaataaaatatagaagttgtttaaaaaaattaaagaaaatcattttttaaatttataatagttaatattttattaattacatgctaatgagttttatcgtgcgctaaaaatttctgtagtgttggatggaacgaacgcagccatctcgtaatcttcattcaccattttccactgcgctccctttgtttcttaaagaatgaatcgtcatgtagtaccacagtatcatccatggccgcttccgcccaaggaaacaatctagcaaccgaaacatgcaggaacaacataagcacacaactttagccgcagaatctgatcaccgcaaattcacataacatgtcgctatgtacatggagatgaaatctcctctctctttcactgtcttataccaaagcacgagtgaaagcaaggtcaagggggttcggagataaaaattccgaacccccgtagccgggtttactcttttgggttctttctcgaacgatgtcactagggtttgaagattagttgacgagggcaaacgcggcggaacagaattttaatctccggtcatgtttttctctttcttaatcaacgactgaggctgtgtttagttcagcgcaaagtttgaatttttattgaaattggagatgatgtgactgaaaagttgtgtgagtatgacagg

SEQ ID NO: 48735 - DNA, 1501 bp, Oryza sativa
tggcgagctgatagctccactgagcgcgccggagaagaactctctcgtctcgtcccgaccgcccggccgcccctgctcaccgaccggtcgtcacgcaacgcagcagccaccggcggcgaatccgtttccgggcttctttggtttagtgccctactaaagtattaaagtattggtagtgcgaaaacttaggtatgttttggcactatcaatattttggtagggtagcattttagatgaatggatttgtattgataccaattggagaccaaattttatattatagttaagaaagttctagaattatgccggcagacagcgacggcgaaagcgatccggagaaaccgctggcaaaagatactgttatcactgtaaccgtcaacgacgatgacgacgcattccccctcctccctcccggctcctgctgcccgcaggctcgcctcgcgacctcagagcaagtttaatagctaactactgtctctaaatcatctataacaaatcaaatagtccacttataaaataggtaactataaaaatatactacaccattaatacccggtctcacttgtcatacacacataacgttttggagtccgtgttgcagctgactataaatttgtagcccgctttcttctctcttcttttagaaaatgaaaatgggttatatctccggcttctctcataagacacacaatcataaatttaatagtaataaaaatgtaagataaaagtaaatcaagatgagaaataaggaggtgggataattctctcccttaatttttttcttgatatgtggttatagctgacttatagtgctattgtactgctctcgcgccgccgcttctgctccatccttccagcgaaatcccatgcgaaaaccgaagacggcaaagcgtctagctagcttgtcgcggggcagcaggtgggggaggggaagtaggagagcgtgtgaaaccaagcaccgcacgggcaggagcgcgacgacgcttgatagccaggtagctcgtgaaccaagcccaagtagggatggcaatgggtcaggtcgggtacgggtagagcaaaaccatgcccgatccaatgcctaacattgcccacccgaaccctacccactagagttagcgggcaaaattccgtgcttgtacccatgcccgacgggtacccaatagatctcgcatgaataataacttgaaagatatgtaatttaacaaagagaaataaaatcaataatttaccaaattatcggttattgacaataatttgaattacatcacaacttagtatcagttagcatcacaaatgaaccaaaagaaatggtataagaattaagaaatgagtcaaaattagctaatacatatgtatcgggtcgggcatgtgttacctacgggtaaaaaatgaaacccgccagttgcccatgacgtcttcgggtctcgggcggacgtgcccatgggtaaaaagtcacacccacgtccatgtccatcgggtcgggtatccacagatacccgaa

SEQ ID NO: 48736 - DNA, 522 bp, Oryza sativa
cctccaccttggatgacggcggtttcgtcatggcgaaatcgaagttgagttgacgttgaacggatctccccagcgaagtcgccaaaatcgtgttggcaactttttgtgataagttgacaacaacgattgcaacaccttatgccttgcggtgatcctattgtcacgaaccacctcgatctagcaaagagccaaacctagatgggttttgacaaataaaccggctagcggagccaatttaagataattacccgtctcgtgggcaaaacggaaggttttcaggacaaacctacaaagagatgttgcactctcgcagcggcggcggacggtttacggcgcaaaccgacaaagatggacaaactaagagaaaactaaaagcaatatgaaaaacgattgaattgattgattgtagattggtttcttacaatagaactggccatgtaccttatataggggttggtcttgccctctacaggccctcctccatgtccaacttgggatagaaactaaaggaaacctgaaaca

SEQ ID NO: 48737 - DNA, 396 bp, Oryza sativa
gacttatcttacaataaacacaagaattagcatcagctacacgaaaaaaaatgcaatcccagttattgtactcaaggaaacttggacatctatgaacatatccagttagccacacatagttaacagcctatgatggcatatgctggaactaaatgtagagttttactggttactgaccacaaaccatatgacaaattccgagcataacaagtactacctccgtcccaaaatacttgtcgttttgagtttttgtttgtaatgcttgaccattcatctattcaaaagaatatggaattattatttattttgtttgtgacttgctttgttatcaaaagtactttaaatatatgacttatcctttcctatatttgcactaatgttttaaataagacgaaa

SEQ ID NO: 48738 - DNA, 317 bp, Oryza sativa
  unsure (1)..(317): unsure at all n locations
cagagtantagcccttgtgtgatggatgtgtacgtttatgcctgcacatgtattcggataaatctaaattcttaaaaaaatagatccactatatttaacgaatatcaatggttaaatgttttcttttttcatagaatttttaagaaacttttgaatttataagagtgtcacgtggcggcttagaagcgtttttaggatgcgacgtagcagcttgaagcgtttgtaagaagtttaatggactctagtatataatagatagatagatagatatatgatctgtttggtacaggtctagctctagctccatgtctcctaga

SEQ ID NO: 48739 - DNA, 1501 bp, Oryza sativa
accagccagggtacacaaacgacaattgttgacatacagatccacgtcttacaaaaatataaaagattacaaatgcagcggaaaaagataaaagcgagctaagcctgaaggcttgacttctgcagcgggcgactccattccacaggcatccttgacggcagcgacgaaaccaacctcttcgagacatcctcaactgagaaggacttcaactctggtgtgggggaaaagagagcaagactgagtactacccactgtactcagcaagtcacaccggaagaggaggtatgatgcaagatatatccaagggaggctaaattttcttttgcataaagccggcatttcaagcagtagttgaaagcagtaaaacagctgtagtaattaatctatattaaccaatcactgtccaacgttacaccacgttgcaacaggcccaaaccaccacctgaactaaccagttctaaaagctaactagggtgaaactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccctctctaaccgatcgcaccacaccttagggttcgcccccgtccccagcaggcaacgggcagcccccctttcgtgtcgcggtgaatccggaagccgatcaaccggacaccccggccgacccaactccatcacgcccaccctcgcctgggtacgtcggctagagaaaagctacactacaagcccagcctttgcccacgctggcttgtggtaagtacgataagttcttccagggcatcccgcgaaccggtccttaaatgccatgggtgtgactagcaagaccatgcacccacagcccaccatgacgtgtattttaattaaccaacaccattacggtggcactaaatcaaagctatgccaataatcaagtctatgctttaatgtaatccccctttgtgcactagttgaactaagcatggctaagcatctcctaaaccaatatctagtcattttaatacccacgttatcaatggcataaggtaagcaatatatggctgagtaataggacccatcccacatgatattgtaaaacaaatgtaatatttaatagaaatgcgggacatttgtatattaggtacaatatgatcaattgcaatgtatgacttgccttgctctcgcactgatgagaccacagcaacgtcttcgagaatccgcgaaacgacgaaacgggcgaaatctacgcgacaaacaaagcacacaagcaaaacatgctataagactactgaaacaggaaacaaaaccatttttaatggattctatacatttttatgaatttactgagacttgaatgggcttaaacggagctcggatgaattagttatgatttttagaagattatctgtgttt

SEQ ID NO: 48740 - DNA, 571 bp, Oryza sativa
  unsure (1)..(571): unsure at all n locations
cccccttcgctgattcagatttagagccgtaatctctcttttagcggtatgccgcatccccctcaactctctatacggtttcatattttnccccccccatgtccnctttgaacccttcagagcgcacgatcatacgtactgttggcaactttttgagataagttgacaacaacgattgtagcaccttatttttgcagtgatcctagagtcaccaaccaccttgatctagcaaagagctaaatctagatgggttttgacaaataaacaggctagcgaagccgatttaagataactacccatctcgtgggcaaaacggaaggttttcaggacaaacctacaaagagatatcacactctcgcagcggcggcagacggtttacggcgcaaaccgataaagatggacaaactaagagaaaactaaaagcaatatgaaaaaatgattcgattgattgattgtagattggtttcttacaatagaaccggccatgtcccttatatagaggttagtcttgccctctacaagccctcctccacgtccaactcggggtagaaactaaaggaaacccgaaaca

SEQ ID NO: 48741 - DNA, 359 bp, Oryza sativa
tagactctttgtaagctacatccttcataatcattgtgtgcgactgtgaagtctttgtatcgactggactttgtcgtgtgtctcttgagattatactttgtggtgcttctatccacaatgtttctcttcactttaagctatgcatattatctatgtaaataaattaaaacattattatttccagacaaggagtaaaacttcatcatagagcaaaatgaaagataatattggattgagaaaaatggccgattggccaaaaccctagccctaaaacccatttcctttcttccaatcccctttcttctactcctaatggcgacaacagcggcgaatcgggtgaggcatcggagtgccggcga

SEQ ID NO: 48742 - DNA, 1415 bp, Oryza sativa
attcttccgagcatcggagttgattgaaggctcgttcggctcgtctccatcatcttgagttgctccccactcgatcttggaatgggtgcgcttcgattcttctccttcatcatcacttatattgacgaccggaggatccgctagggctggggtaacttctttttccaccacacggacctttggcgccaattggtaacgagggacaaatagagctctcttccttgcggtaagacgaatcctggccttctgcggtggtgcttctcccttcaatgcggctagttccttctccaaacgatccaccttgtcctctagcttgcaaatcttaccacgattccgatcttcatgatcttgagccgctaacacagtctccgcacgggtttcatccatagcccacagcatctcaaccaaatgccttgtggtagcatcattctcaattccttcagtgtcaaggtaactgccacggtcacttccctgtggttggcgaggatggtagcgatactcagtgtcggccaactgatcactgtagcgatcgcggagctctcctatggcgatccttgccacctcctgacatgcatggatgtagtttcttcctccagcttcgaacatcactgaggggatatcttcactattactgttcaaggtgactttgactcggcacttctcttcaggacgatcatgaggaatctgggcataaaaagaggcagtcccaaatcctatgacaaaggacatcgtacgcaactcttggacaaatccctcaacaccaaacaagtactcaggcttatagcgcggcatctaaagacaagtgaaaggagggagttaagacatttatccaattaatagcacaagtttttggattaatttgaataaagttagaaaatcaaagtaaaaggtaagtaaataaaataaaccaagcttgcaagataagttgaaacagctggaaacgaggtcacaaattttgtacttttgaacaaccggtttcaaaaggaataaagttataaaatcaacatgctaaatttatttcattgcagcaagactaaataaaacaatattgtaaaacttttgctggtagatgagccattagtacagtaatagatgtacggtactaataacactggaataaattttgaatgagaaccactaaaagagattatgaaatgcatgtgccattagtttggtttaattaaaagagaaggggaggagaacaattctacttttccaatatttttagagggcttctatggataaccatttggcataacctagggtcaagggggctctgatactaacttgtcacgcccggaatttctatccaaaattccaaacgcttacatgtgtgtgaaccctcgtccaggaatcagccgaggcacacaataacaaattgataatagagtacaattattactctaattaataag

SEQ ID NO: 48743 - DNA, 1501 bp, Oryza sativa
gtttcggttgtgaaacattaaccgtgccaaccacaagccagcgtgggcaacggctttaccttttgtatagcatggttcattgcggagcaccagactgagaagtggcggagataaacccacgggggtcgctggggagtccatgccttgtttataagggggtgattatgatccaggaaaggtgctctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcatgataacagatgctataactggtaataatttgtttagctcctggtttggaatggtatattcctggtttggagatagatctgtacagccgggtatggttgttcagaaaggttgggcctatacaacagggtatgttgtatagcgttgaattaatattgtttaattattacttaactgttttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttctacagtgaagctgatggtgtggaggattaggtgtagccctggtcaagctgcctgtggagtggagtcgtctgcgccgtttatcttatctttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttagtatcagagcccccttgaccctaggttatgccaaatggttatccatagaagccctctaaaaatattggaaaagtagaattgttctcctccccttctcttttaattaaaccaaactaatggcacatgcatttcataatctcttttagtggttctcattcaaaatttattccagtgttattagtaccgtacatctattactgtactaatggctcatctaccagcaaaagttttacaatattgttttatttagtcttgctgcaatgaaataaatttagcatgttgattttataactttattccttttgaaaccggttgttcaaaagtacaaaatttgtgacctcgtttccagctgtttcaacttatcttgcaagcttggtttattttatttacttaccttttactttgattttctaactttattcaaattaatccaaaaacttgtgctattaattggataaatgtcttaactccctcctttcacttgtctttaga

SEQ ID NO: 48744 - DNA, 1501 bp, Oryza sativa
ctagtgcagaactaaccactagacagcttgtcaagctcaataattgtccctgaagctcactcttaatcaaactgcagcgtcaaatgtcggactggcgatctcgcatcgatgattcaaagactcagaacattgaacataggaatcaccgatctttgaataaactctttcatgttcttgccatgtagcaccagtattttccctatattttagtatggcaatggccaggtcattctggagctatttctagatgaaagagctgtgtgctccaaggaaaatttcttgttcaattcaacaatgagcaaaaagccaacacagtgacttcaaaacaagagatgccacatccttttcgcagatggcgaattaatctcttgcgttccatcgtcaatacttcaaactttcttactctcttcttcgattagaacaagaattaaaaacactgaaccgcagacggcaaggcaaataaactatgatccttcattgatgttttcgtttcgtccgggatcttcagacggcaggatagcgaataagcaagcagtggcaacttgtcaaacattcgaagccatcgcggtcgcattttattcgatctttctccctctgaaaagcaaaacaagaatggtagcgagagagaaaaacaactggagaacgatatgcccttttatcatgttagaattttgcacacgcagttcgtcatccttcttttcctgtcaagttgtattggtgaacaacctcgaccacgcatgcatcaaatcaatatgagcatcagaccataatcactcgaattgccttccagtttcccaattacacttttgcttatagtgatgatcaaagctgtagaacccaggctacatggttaaagttgatttcttcccaatggacgcttccacaaaactcttcgtgcttaactttgaacagaataattttgtgggcgagaaagggttacacaataaacatttttaaaagaaaaaccataaccagtggctataattaaccgtacaagcaatgtgttacccctatcaacacacagttgcgtcatcttgacacacgcactattcagaagaaaaaggaaaacctgaaacctgtttctgaaaatactggagcactgcagctgaatgttcatgagcaaaccacctttgtcggcttgtgaaggcaaaaaaaaaaaaaacaccatttgattttcaccgctttagaaaatcaccctgtgatgggtggtaccattaccaacacactctcatgtgcatcctgccccaccctcccattaccctacctttgcaaacgcatcgttagagcaagtttattagtatagccaactgtcgacttcaaattaactatagttaattttagagccaattcatataataagttacctataaacatatactatataattaatatattggctcgaaagctagcttatactagcctgctattgtacctgctcctaaaagtagttaattactgctaattacatggattagttgggtaaaagcggggttagcggggg

SEQ ID NO: 48745 - DNA, 1501 bp, Oryza sativa
atcatcattttgtactcagttcacatctgcaatctgctttttttgtgtatgagtttatagtactgaaatttctttcggcgactggaataggacaatgatcttcagacaagggtagtactactctgaagcattgatgacagctccaggtatcgttatgtttcttgaatcgtcagaagaattggtgcaccggacacggtttacttcagtttcttggtcgtcagtcctcgccatggtgcccggtggcggtgggtaagctgctctctttgaccggatcgcgagctaatcagctaactgtaactatctgaatctgatgttaccgtgagcgcgcggtggcctaatccaatgtaccggcagtgaatcatatgactcgattattcaaccgaaatctgcacagtttgttttgtccttggacactgtcacttttccctctctttttgctcgccatggctgtaaaggtatctatctgggcatgccaaggtccccgtccttagattgccatgattggatcggatggatccagcctaacctgatcggatattatcgatcaggaagatcagatcaggtaatacggatgattaagattttctaacttctctatgataaagttacaaatgttaagttagagaatttgcttccgatcatgaagaaagctacagaaactaaacactggtcacaagcaactatgcgacgcggattgtcacgttgcgtcgttgatcgatcaaaaattaaaatttcggtcgtcacggcaatttaacatgtctgctgttgactcacaaatcacacggctagttacatggcgtcaggtagtggaggtagtagtcaggtagtcgagaagctgcatcctcggcggcggcgccggcgggcacggcgcggccggctcctcgccccggcggcgccctccgccccacgcgccgccgatgccgagccagcagagcagccgcttcaacgcctccagcagccaggacctccgcgccggcgcacgtcccgctcccggtttctcctcctccttggcacgtcggccggcagcgcccggcggggcttcctgcttgtcctgcggcgcgacgacggcgagacgggacgggctcggctcggagtagctccggcgcaggacggcccggtcgagctgggcctcgatggccagccgctcgtactcgtcgagcagcgtgctggggcggaacgcgccgccgccgccaccgttcaggtcgaggctgaggctgagccgccccagcctggtggcgccggcgtcttcttcctcgactatctccatggcaatgccgccgccgtctagctgtcgcgccggctccattgacattgatcagtagtgttaggcagtggtgctataacgccattgttgccgttcgaaaagttgcgagttgtgggagtttgacgtggatagtgaggcaagcatcgccgcgtcgacgagctttatgagtttcgtttattgcactcaaaacattgttcaggtctggacctgtctcttttgttgaactttcatagtata

SEQ ID NO: 48746 - DNA, 1501 bp, Oryza sativa
gatcaaggagaaattaaatcatcttggatgttacaaaatcaacgagtaaatgtaaacaagcaatcaatgaatatttagattactcattgggttctcacaaacatttaatttatctcttcatttaagtcttagatgtataaagactacaaataagaacaacttatttgaaaaactcaaatgtgaaacatgtctaacttttatggatggagatagagtatatcatcggcttttttagcacgcgtataaattcacttaacatgtttggagtactagtggcacaataatagccaggtgcagccactcacgtacaacccctttagagcaggtacaatagcaggctataagccagctgcaaacatattttaagaagataaataaggagaaagaagagcagcgggctacagatttgtagtcagctgtagcacggactccaagacgcagtgtgtgtatgactggtgggaccaggtattaatagtgtagtatgcaactattgatgaatgagctattagattggctatagatgaattggagttagtagttggctatactttgctcttagcctcattcaggctgtgtttagatccaaagtttggatccaatcttcagtccttttccattacatcaacctgtcatactcacacaacttttcagtcacatcatctccaatttcaataaaaattcaaactttgcgctgaactaaacacagcctcagtcgttgattaagaaagagaaaaacatgaccggagattaaaattctgttccgccgcgtttgccctcgtcaactaatcttcaaaccctagtgacatcgttcgagaaagaacccaaaagagtaaacccggctacgggggttcggaatttttatctccgaacccccttgaccttgctttcactcgtgctttggtataagacagtgaaagagagaggagatttcatctccatgtacatagcgacatgttatgtgaatttgcggtgatcagattctgcggctaaagttgtgtgcttatgttgttcctgcatgtttcggttgctagattgtttccttgggcggaagcggccatggatgatactgtggtactacatgacgattcattctttaagaaacaaagggagcgcagtggaaaatggtgaatgaagattacgagatggctgcgttcgttccatccaacactacagaaatttttagcgcacgataaaactcattagcatgtaattaataaaatattaactattataaatttaaaaaatgattttctttaatttttttaaacaacttctatattttattttaaaaaacgtatcatttaatagttagaaaaatatattgacgaaaaataagtaagatgaagtttggagtttaagaaaagaacttgttctccccctaagccgagctcgataccagccacgagctctcgggcgcaactagcacaggaagtgaagttcgtaaattaatcagaaaagaagcccgtgggctcaaaacgctccaaatattgcctcagtacgg

SEQ ID NO: 48747 - DNA, 1501 bp, Oryza sativa
gcctgagccgatcccgcgccctgccaccaccgcagccggcttcgccgccgcgcgggcaagcccggccaccgatccctttttcccctccaccacctgaaccacctccccgccataccaccctaccggccgcctttttccgcctccgatcgccgttcgccttcaccccggctgccgctgcgacgcatcggctgcatcgccggcttcgccgcgtcccgctcttccccatccgccgcccggtcgccgcctttcgccgctgggagcccctcctccttgtcgacctgtggagcgccgccgcctccctccgccggctgctctcgccgtcgccgtgcccctcggtgagctccaccacctccctctccctcactgcccccgtttcctctcgccgcttcccgcgctgcgcgccgccgctccctgcgacgcccggcctgtgtgccgccgtcgctttggtcccggccgccgccgccgccagccttgtgtgcgcgctggccaggccgcgccgcccggccgtccccagccgtccgatcggccttggccgatctagaccgtcgggtgcgcggccgcgtggccgatcgccaccgtggactcggtccacggtgggccgtgccgctgacgtgtggggcctgccccctttgtggacgtggtccgcgcctcaccccttgctgacgtcagcgatgaccatttcctttgtaaaaataaataataattgcgcaataaatcgagtttaattctagaaattcatttaaatggcttaaaacttctaaaattcatacctaattcattcgaactccgaattgagccattccacttgcaaaattcatctaaaattgagctctacatgtttgtttagtttttatgtactgttttcttggtttttattagagttttttctcgttttgcgtgccagcgtgtagttcccgtcgtttcggaagatcgcgttcgcaaggataagagttcagaagatccaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgcaactgaatggtgggctgtgggtgcatggttttgttggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 48748 - DNA, 1501 bp, Oryza sativa
atgcgcactactatctaaacctagctagcatctaaccttcgacaaaacgaacccagcgattgattgttacttcccaaaaggccaaaacgaagctagctaattaactgcggcgagcggagtcctggtaagcatgcacgttgcctctctgataagtggaatggtcgaaagaccaggctaggactctagaactcacctgttccttcttttttttttttgcatatctttcaccctcaaaatgaataaaggctaatgcacgctcgcgcagttgcaaaagtaagttgcctgagatattgatgttgttttgaaaaagaaatactagtaaactgctctttcttttgtgctgtcttgatatcgatatgatctgcttataactgaacctttaacctttttaacaaatattgaggcttttgtcggaaaaggagaacacttctagtagcttcaaagcactcatcgcagcatctgctggccttcttccctcccaaccccccaaaaaagagagagttactaagtaacaaattgaactgtactttatataagctaatcatatctggctctccctaaaacttgtcctgtccgaccgacaagaagatcatgccccatactagagaggtataaccactggaatgaatccttgggctcctgtatacatctccaagcttgcaaacgtgacagcctaccagctgcaccgcaaatgccgtgtactgctttctgcctcctctaagcctacctgctccaaggtaggcacacgccgagtctcgtttcatctccatctccatccgcgcgcgcgcgcgtggcggcgtgggccgtccatccatccatttgcaagtggcaacgcacctgccgcccacccgcacagccagcaaccgcgtggccgtcgcgagccgctgccaactggcaaagcgccaaagcgggggcaaagatatttgtcacgcgagaggagagaggcctccgcttttggatggcccaccgtaaagtgacccggagccgaaccccacccacatctgcctggccccacctgccgccgtgcggtgtgccggtgttggtgttgcacccattataaatctctcgtggcatctcgcgacggatcgctgtctactgctactactactacggctcaactccacttgctgttgttgattctcctcctcctcctcatctcatctcccgaaatactaatccagctcgatcgtgtgggaaagagatcacagaaggtacttggctagctcactccatcaatcgatcgatcggtacagtttagcaacagttaagcttcacctttttgtattagctagtggcagtcgctactacgtccacgtccttttgtgttacggattggttcgcgagcgagataactggtgagtagtagtagcttttccactgacctggacctgtacattcggcgcataatttgccgggaagcttagcgtgttgttctaagttctagtaagttggggggaggccatgggggtgcacacgaagtcgatgagctggtacatgggga

SEQ ID NO: 48749 - DNA, 1501 bp, Oryza sativa
catcatcaacggcaaccctatagaaggaagccacggctgaagatgggggagaagaagatttgtcgccaaaccggcaatccatataggcactagagaggtggtgcgaatgtttgtgcagggatggacgtgggcggcaactaaagctagctactgtgatgattccatcaatgctagtactacagaaaccgacattttgtagcgtgttagtggcaagatttgattatgattacgtgaaaagaaaatttgattatggtgaatgacgctgtccatatacatcctaatcttttgtcccatacatttgccacttgaagagtactatagaggataaggagctcggatttgttctgatcccgtacagatcttaagacctgatactctgcgatcaagggaagatgcatctcaaattgatgaaattaacacgaaattggtggttggattagagttgatagatggataggaaaaaaaagctcatattgctgatgcgtgctctagcttcccgattagcttgaacgttaacataaaatcccggataatccagtgcctagctcatcgggattgtttacttgcctcttgatgacgagcaattccagctcttcaatgatctggtcaataggagtagttgttaaggattgctgatgccatgtcacaaaatccacgtaaaaccagctgcgatatgggagtaaaaaaaatgcaaatcctaaagcgatctatgcctgggtcagaggaggcaaagtggacatgtctaaccgttcgtgcaacaatgacagtagcaacaacagctggggatcgtcgaaccgtccgtgcacggatgactttttaactttgaaattttaaatccctaacaatacgacgcgtacatctggacgagccggtggtgaattagttggatttgtagttctgcatatgacaaaggttgctgatcttgccactggcttaaatattatattgcttaatgacttcgtgtcttggtgcatatgtattttgtaattaagctgggacaagaacccacgtttctgcatgaggcttttgtgatgtttaattggggtttaggtaaacgctggaacggccgaaatggatcctctgtatagcgggggtaaacggtaactttgaagttcaatttatggcccagttcaagctagcgcaacaaaagtaataacctctgtttcctttcttttcgattacactgaacacacagcacacatatatgcgcgtgtacacacacttctacacgtacttaaatggacaaagaccggcaataaatccctagcctcactaaaatattatcaagtgtgcatatgtatgtaatatctgtagtaccataattcaaacccttcgtaggtaaagtaaggagcagatcctctaacataattcaaactaaacataactgaacatgcaattaagtcactgatatgtaaatcccactttattataactcaattgtacaatagttaagtcaaaagaacccattacaggtaaagtaatacatatacaactcgctagc

SEQ ID NO: 48750 - DNA, 1501 bp, Oryza sativa
ccaccggagaaatctggtgagcaaaaaaaggagaggaaaaatttacagcaggtccccgaatagccgcgcgctattctgaaatgaatgacggtgcagagacatcagtggaaaatgtagcgagtagttcgcgtgcacttaattttcacctgccaacaaacttcttctatccactgccatgaacagctaccacgtaatcaacaacagtcggcacgcaccatacaggcatgcacacactattggccattttctttcccctgttgatcgcaacaagaacttgcttcatacagcgcatgtacgagacgcgatgttgcaatgttgcatgcatacgatcgagacgtacgcagtaaataaaaggcgagagctagctagctagccggctatcgcattgacgcctcctgctgctggcctcacagaccggggcagcagcggctgtaaatgtaatcagatggctctcacatggccgctgctcgtatagcttcataaattcgtccttgccacctacacaagcagagccagcaaccccgtcgtcagaagtgttggcagatctaaatctgtaaggaagcagcatctgatgaacccgatcgaccagcatctagctcatctagctccgccatttacgctcgatcgcagaggtgcaatggctttaggcaggccacgtccggggcaagtcattaaatcagaggtactccatggctccatgcaacagtcacgcgttacggactcgctgtcgcctgtcggtgaacgaacctgtgcaattctgcgtcatattggacggtctcgaattattggccgaacaatctggagtctgcaggactatacgtcggtccatgcagaatttgttcgtcgatctgattattgtagcaaaaaaccgagctagacacacgataggattaggatatacatcgacacccatagtctcttgcaacacgtcggatctcaattagtatctgcactaaccatattgatctaacaaaacatgattatagtgtaagatcaatgtgtgttttgattcttattctgtgatgaacaattgacatatgtgattatcggttttgatatttggagattatcgtcgaagtggttttggagataatcaattttcaggagatgaatagggtttactgatttgtcgggaccggtcagaccgggcggttgttgccggtcagacaggagctatgtgagcggtcagaccggcttgcccgcggtctgaccggccgacgctgtgtcggtttcggtttcgggttgtttctttggatatccgtgattgtttcatggttatggcttatagatggatactatacgtatataatactgttgtttgctacgaatgagttaagttggagatagcttggtctcgaaatatggtttctttgtttgtttcatgtataggtgactcgatgcctcgggagagtatttgcggtgatggaccgggagtcggcttagtggtaagacgatatccgtggtggttagatatcatacgagatactaagactagagttga

SEQ ID NO: 48751 - DNA, 205 bp, Oryza sativa
tgaagtgttctggtgaccagacatctgcgcgctgtatgactgggctagcaaacaccacttctggcagaccaacatcctgagtcccgaaagcctgcgtaagcagtgggacaagctgacaatgcagcgtaacgccggaggtgagcagcgcgctgtcaagccagatctggacttcaacaacactgactgggcctatggggtgatccga

SEQ ID NO: 48752 - DNA, 1231 bp, Oryza sativa
  unsure (1)..(1231): unsure at all n locations
tttaccttgaaaaccaaaaggggcctttgagcctccttagagaaaaaggaaaatgtggcaaagttaaaattgaaattttggtccctcaatgtgcccttttcaaaggccaaacctattttcccagggttttattttgagttactttgtgttagacgcctcaaattagtagaaaaggttggtattcctaacggctctaatatatttaatattcggaaggtagttccaattataaaaagattttttttgaaacatcatgagtgaagtgatgcctggtagctaagaaaaattgattttaagacaanctanatttccttggtttattgaaaaatacagcagaaggatagtaatgatttttgtcaagttaaagcaagaggcttgtaaaaggtcaagacttccacaaaacagttgacacattacgctgccataataaattaagtttttagcanccgaattgaccagnaaccttttttcctcctaagaaactgattgcgacgaacattcaattaggcatcagtattagattacaatgacaaaagcaggcagctgcgtagatttgttgtcatcattttagtagaagagacctaaaggacagcaacttggaagtaactgacagggccaccactagtatagtaccagtcaattttttttatttttttatttttttgcctttccatctacatcttgctttgtatacaagcaaacctgtcgcttgcgagcattaatgtcttttaaccccttcgttaagtttttggggctgttatttcttccctgctgcaaatggtaaccaaagatggtgacaaccggtggtctgagtcggagccagcaagaacggattacctaccctccttcccatcgtgttgtccctctcaaccagaagaattggaccttcatgtcgtggctggagatctgtgttgcaacctttcgatctactaacaggaaatactccagcaagaagggcaaagtagggatcttagaactcccatcgtcttcccctagctgccatagccagcactttgtatcttttttgctatccgtgatacggcttgcccaagctgaacttgttggttcctattaccaggggtgcagctggaacaaaaagggaaggggtatcattcgcttgctttactctattttagatcaagtttaagctaatatgagtacctgagtttgaagagtgatgctccgatgcaatatacttgaagtattctactccgagcagaattaatctgga

SEQ ID NO: 48753 - DNA, 172 bp, Oryza sativa; identical to SEQ ID NO: 48685

SEQ ID NO: 48754 - DNA, 165 bp, Oryza sativa
cagctgtttactgtcatattaccatgtttcttagttctatgcctatttccatatatcgttctcatattatatacagcattccattgtataacggttcatttttcattttattagtggctgccaaactgatggacaaccttcttgtggtgagcaacccatatagtc

SEQ ID NO: 48755 - DNA, 267 bp, Oryza sativa
gggagagtggggccgcccccctaaacggtgtgggggaaaaaaccccccctgtttttttttttctttttttttatataacaaaaaaaatttttctttttttgaggggggttttttaaccctttttttacggaaggggtttttaataatcccgcgggaaaaaaagcccggggaaaaaaaaagggtgccaaaaatttaaaattttaaaaaagcccctccaaaaagatgaatttttttagctcaaaaaccgccatgagattcatgaatagc

SEQ ID NO: 48756 - DNA, 509 bp, Oryza sativa
agattattatctgctcctctggatatcggttagaccgggccctggaccggttagaccggcgcaataataccgattcaggggatagatccaatgactaatgctagttatttgtatcatcttagaacatttgatcctcctgtatctactactgcaactaatccccgagttcccccacgtccatacctatactaattggacactttctaggagctctcacgttaatcagaaagatctagccgttaattaatttgttgaattatcataaccgtagatgaaaatacaatctacgtgtgatgtgggccacttttaaagtctatctattgacccaacagatcataacttgagagataaatgcatctactaaaaagaagatcaccgatcctatctccttaatgagatatacgaattcggctgcacaaagaaaaaaaaagagatatatggagcagctaaataagaggtccaactcgcggcacgacggatttcgctagtgacgggggacgccctccagg

SEQ ID NO: 48757 - DNA, 1501 bp, Oryza sativa
tttcttaaatctgcagtaacagataaaggaaatcgttccgatcatgatatactaattacactatcaattaagcactagatataatagttaagaggcggggatcaggtaccctgcggcggaagcgttccggaggcctgcggtccctccggttctcacgggagcggacacggacgatgtgagcatggattgcacaggacacacagtgatgcaccttggcgtaaagcttggggagaacgtatcctgcaacgagatagttgtattgtatgccatcaattcaacaatatcaagatagaataaaaatttccagcagtatgcaaatcgccagtgtgttatcggcgatcacaaatccaacctctactacgatttcgcatcacatacaaattcagcaaaagaaaccaaaagcgggggagaggaaacgcaccatcgtgcacgcacgcctcctggacgtccctgatggcggcctgctccacgatgttcctcacctgaaacctcttgatcgccttgtcctgtcccgcacccaaagcaaagattcccaaatcaacacagagatccagtgggtgcctcgcgcgcaacgagagagggcaaaaggggattcgcttcgccttaccttggggcagcacttggcgcagttggagcagcggatgtacttgacgtggccgcgaccgtgcttgttgcggccgccattgcggcgcttgaaggtctgcgccgatgcagcaagaagagaggtcagttcagcgctgaatcccgcaaagcaatctaggcgttaagcatagggaagcaaggccttaccatggcggcggatggaggaggcgacggcggcggcggcggggggttcgagctcagaagcctccaaggtaatctctcctctactagggtttgcgccacgagtggccttttatactagaaccgggagaagcggcaaagcatcctggccgttcgtgtgttggatcgacggtctaagttgtcaggtaggaatatataagggccatggcccacggggttcataagcgaaagcgtatttgccactttccgctttgcaacaccctacacgcttttatatcagagaagggaacagaacagccgacgtaacgtactactacaactacctccgtttgcaaatgcgtagcagatctgtgaacacttttgtcttttgtacaaaagtttggtaaatacttgaatggattttgtattatcaaagtggctcccttcatcctaaatataagcatgcaatatttcttcatcatagtctaaccatttaaaagtctacaagtgaattcatcatttttgtttcgacctacacgctttccaaaatactaaacggtgtgcttttggtgaaactttctatacgaaagttgtttttaaaaatcatataaatccatttttaaaaagaaaaggaacttgtactttaattaatcgtgcgttaatatttcgttctgttttgcatgtcgaagggattagttcccatccccaaccaacaaacgcattgtgcactttactcttc

SEQ ID NO: 48758 - DNA, 1501 bp, Oryza sativa
agcatgatgcacgcgcgcgcgaagcgagtacccgcctcagggccggagttaggaccacactctagtctacaataacgagcacctttctgagatcgccgagcactaagcacgcagccatcaatcctatcgacaccgtttggtgccggtgctggatccatctcccgtgttaagcatgccgatcgaggactcggtttttacgatcaaaagctccggtaccttcacccacgtccctcttttgggttgccacttgccagttgactctttacaagtgccacacaaccacactaatctaacatgcaagtacaagtttagtactgcgtcatgacaggattacggtttggttttgcgtgtgtgtggctttcgcgataagccgccatgcgtgcggccgatcaggctcgctgcattgcgtttcggtgctttgcattgcagcgcaagatttgaccattggccttggcccgaaaagctgcgcgtggcatcttaaatttagagcctctggcgtggtttaattctcaacttttttttcaaacttttagacttttttatcaaataaaattttttttacacacataaacttttaactttttcatcacatcgttctaatttcaatcaaaattctaattttttgtgtgaactaaacacaccctctcggagtctcggagtttttgttgtgaacgcaagcggcgaaggcaaatctcgcagactgaccgctcaagctccgagccagcgaccaccaccagtagtagtactgttgcttgtctcgcccaggggtgatggaaataaaaggattaaacaagaggtcccggacaaggatgcttttcgacgcgtaattaaaggcctgatgagatgagaaagaaagaaaagaattgaaggcagccaggcaaaggacgtaaccacaatccacaagcgagcgaagcgaaatttcttcagatttcatatcatatcctgtctactgtagtagtatatcctacgtgcagtgcagcgtaggcccattcttctccgaccaacaatacctgcgctttccatcctatcatcctatccccgacctcccttgaaacattttttagcctctcatgtcaaccaaaacttcgagagatttacagggattttcagataaaaatacaggcagcagcagtaagtacagtactgttgaaataatctgtaatggaagaggaggcctcaccgtggcgttgtctcactgatgagagctgagagagtgaagccatgcgaggtgggggcccacgccgcatagagaggagcgaggacaaaaggcgcctcacgtcccctcctctccgcctcgccgatcccccactctattacccgcccttttctgctccgcgccatctcctcctctgctcgcctctgctcctcctcgtacagagcaagctgcgcagcagcagcagcaagcaaccaaacgcagcccacacaaagctttgttcttcttgctcttcttatactcgagcagccgcgcattctgtggagctcagagcgcagcgcggcgcca

SEQ ID NO: 48759 - DNA, 1501 bp, Oryza sativa
gtctttgttactcccacaaaaatatgaacaaattatggctcgcatggatgctagtagtatttctgcttgctttttgctcatggaaattattaaaggactaggcaactgggcatttaaggagtggcaactgacaagtatgggctaactcaaaggcgcagacataatcaattggaagagtgcttaaccacgagcatcagttagttttacactgaggcattggggacatggcattacttatctccaatcgtgtggtgttcatcagaaagaaactttggttaaagctttgctcctagggggttgtttattgtgcaaacacacaagtaggctatttgatggtgcaaaatattgtaagtgtatgtggatgggcagagcaaattattccctccgagaaatctcagttatcattcaagattgaccctgaggaccactagatagcagtagaaacataaaatctgaacaacactgagcgccattcagcactgtactacctctcccaaattcaacttccaccaacccaaaaaattcttctttactgcatcgtgacacggcatgcaacaccgtcagaaaaaacgaaaaacgtggcgataccctctgaatattcccgctttctatccccatggtaaagatctggaatagaaggccagaagtcagatctgcagttacagtctttacagagcctaaaattaactaaaattaaatggcatagccgcatgggcagttacagtctttgcattgagtcagagataaatgagagattagggtttacctagccccgcttcctatggtcggccaagtccttagcatctggggattacaaaagaaaactgccccgagtgagtggctcccactcgccttcctcgatccacccttttttgttgttcgaatccattggagcccacgaggtctttgcctcccattctcccaaaaccacttggattctcgaagattcagagcagggacctcaccttcgctgcagcttttttctttcaggcttttggcttcttggatccgtgcaggcgcgagaattcaatggcggttattggagcttcttggggtggtcactgaaggtacactggttagtgattactgagtactcatgactgtgcgagaatatacggtgaagttgtttgtttgtttgcaatttttgatgtttttcttcttcttggcaatcggctaaaacccaaaaccttcagaagaaaggcagagactttatcgtgttcttggctttgatccggttggaatcaatctcttcgaagacccgcaaactctcgccttggaatccgcgcatgttttacttcctgtctcaaccatcttgaatcgttcttggagcctgatgctgctctgcctcgcctttgcagtagaccagtagtacgcagtcttgcgatggagtcggcgacggagaaggtgaggaggacgccctcctcctgcctgctgctgcgcatctccgacatctgcaaggtgcgctccgtcggcgtcgcgccgaccgtccgcgaaaagccca

SEQ ID NO: 48760 - DNA, 1501 bp, Oryza sativa
gaaccatgtttatgccgaggtctttaccatcctttgtcaagactttattcccatcacaagtttgacttcattcttgccaacatgacgatgtccttggcttggtgaccattaacccatggtgtcattcaatagccttatcgtagtgggacctattccttttcacatctcaacaaatcggatgtagtataagatattttagataactgtgtgtccagattcatagcaaaaagttgctatattttgggacggatgtagtataagatattttagacggatgtgatacatcctagtattagtattaggatgtgtcgcatccacataaaattctaggatgagtagaatatttatattatagtaagcataaaatttctatattgtacccctccgtaaaaaaaattcaattctaacaacgaaccgttattttctttttacggaataggacatgttagctactactcactgtagaggacatgcatattagggggtgtttagatggggctaaaactttttagcccatgtcacatcggatgtttggacgctaatttggagtattaaacctagactagtaaaaaaactaatttaataaatgagagctaatccgcgagacgaattttttaagcctaattaatccataattatcaaaagtttactgtagcatcacattgtaaaaatcatggcgtaattagactcaaaagattcgtctcgcgaattagtccaaggttatggaatgggttttgtaattagtatatgtttaatacttaaaaaagtgtccaaacatccgatgtgacagggacttggaataagtctctataaaccaaacaggaccttaatccagcagccggctcttgtatagatctagcagttactccagttcttagtgtgacaggtctcccacttccacgtgaaaattgcctggatttgaacaaagtaatctttacagctatccttaggttctgacgatatctagtcctccacatcttcgcctgtcctctcacaaaagccactctcaccgtacttttaactccactcgggtgcttagctcgtccctcatctgtcccaaagtcttacccagccgccgcacccgagagcgagatgcgatccgatcaaaaacgaaacgggctgactcatcatcactcatccaattcccatcccggccgtccatcgcgccacatccaacggccaccatgcgacgaccctgcccccctttccagccaatgcatcataatacattaatactatagtatgcatataagataatcctaataccatcacaaataaactaagcacatgatgcataacaatcacaatagaaataaacggaaaaaggcaaaatcagtctaggggattccttccagctctcaaccaactcgtcacgccacgcctaccgcctccgaagtttataaacctctctctcttttcgagctctccgctgcgtgtccaccatttccgtttggttttactccactaataagctaaggattttttcttttggttgtggtta

SEQ ID NO: 48761 - DNA, 1501 bp, Oryza sativa
taagctacatcaataacaaataaaattatcacataactaccccattattagcaccctaaacgtttataactagatacgcccacttctaacagtgagactgtgagagggctcggaggcagccaaatggttggacacgtcaatagtccatgtcaacacaggcaccgtagcggagtccggttacactgctaaggcctggtttagggcatgtttagttaaaaaaagaaaattttagggtgtcgatgtttgaccggatgttgaaaggggtttttctcacgaatgcaaaaactaatttcataactcgtctggaaaccacgagacgaatcttgcctaattaatccgtcattagcacatgtgtgttactatatcacttatggctaatcatggactaattaggctcaaaagattcatctcgcgatttctccctgcaactgtgcaattagttttttaaaaatctatatgtaatatttcatatttgatgtgatgttttgggaaaaaaaaatttggaaactaaaccaggccttagttcccaatttttttcccagaaatgtcacatcgaatctttaaacacatgcatggagcattaaatatagataaaaacaaaaaactaattgcacagtttgcatggaaataacatattattttcagtacatattatttttggctttggctttggccagccgcgccaagcacctaatgatcctaaaatttgcaataaaatgttatatccaatatgtgtcttaattattattttctactgcaacttagtaatctcaaactttaaattaatataaatatcaattttcactctttgaatttcatttttattttagtatttttatcaattaatcacactttaaattcagaattagtatttagcaagtcgtaggtgatgtttaattgatgatttgatgagctcatcttgcactctcaatttagtagtactacctctgtttcatatcatagaagttgttttgattttttttaatcaaaccattaatgtccaaccaaagttataaaacaatatagtaatatattcaacacaaagaaaacaactatcaaaatatatattcaatgttaaattcaatgtaaataattcggtgccacaagtgttactatatttttactataaacttggtcaacttttaagaagtttaactttacaaaaatcaaagtgacttataatattaaatggagggagtacttattaattaatgtaactctaagatttgaaattaatatgaacatgtcataaaatctgtggattctttttcaatccaagctgttataatccaaccccacataggtgaatgcccatataattgtggaaatgctattttttgccgcttccaatttgtgatggtatatatgcatgcattagttagattattaataagacaaatacaattattttttaaataactataggtacactgaatatgtaatgaatagacatgtatcttcataattcaaatttgcatgtggtattcgtgggctattcact

SEQ ID NO: 48762 - DNA, 1501 bp, Oryza sativa
tgttcactttgataaaaaaaaaaaccttaccaaaatttggcatacttgccaaaattttggcaggatttcttatatagtcaccaaaatttgacagcaaactaaatgtagccacttttttggtaactttaccaaaatttggtaatgttgaaaatggtatcaaagtgaataggccctttgatgccattttcaaccttaccaaatttttggcattgccaaaattttggtatagttgccaaaattttggtaggatttcttatatagttactaaaatttagcatcaaactaaatgtagtcacttttttggtaaatgtatcaaaatttggtaatgatgaaaatggtagcaaaatgaacaagcccatagtactgcatacaaccttttttttttcaaaatacaatacaagtactcgtatacacatccaaaaagttgagattcacgaatcttgaagttaccatagttaccttgcttttaggtctacatagtataggtgcttatataaatgctcgtacattcacccctcatcctacctgtacaataaacgctagcatactcaccacttaccttatccctattagcacatctaaaaattaaatcttgatattgacagagttatcataggcgtctagttgttgatggaaacatcattctagtaccatttaaaaaataaattatcgtaaacatgttaaatctattacttaaattcggatggacaaacacattccatcaccagcaagtttgcaaccccatgttcccaactcctcttcctcgttttccacgcgcacgcttttcaaactactaaacggtgtatttttttaaaaaaagtttatatacgaaagttgcttaaaaaatcaaattaatccatttttttaaaaaaatactaatacttacttaataacgtgctaatggatcgctatgttttttgtgcgggagggattagttcccatcccttctatccgaacacagcctaatacgcttctaactgttactagtattttgatatgacaacatcatgtgttaccatcacatcaactctcgaacagatcactgaataactcaaccagcaatggacttgtacacttttcattttgcatataatataacgccgataatgctggatctttcataaaaaggcaatgtgatatgattctagaaaatccaggagcgaagccactgcccgacaaagcctcgtcggttccctgagcgtttatgttattttagctgtttccgtgtatctattagcagttcccgctcggtgcaagcatcaaattaaacttgtgtgcatatgatcccgcttgtaccaacaaatatacggtatttcctcgcaaaatgatactacttatacggtaatattacaagcctgtacgtaactgtaagcgtcctgtacctcctaacctccacaacaactgcccttgctagccaagatcgaaatcgaatggacggtggactactgtgagtaacctacaaactgaacagacgagcgggcccacccgtcatcctctcaca

SEQ ID NO: 48763 - DNA, 453 bp, Oryza sativa
acggggcgcgtgttaatcccgcgctcgttgcgcccagagagatcactcacggatagcgcgaaagatattatcgcgagttatcgacccacgtgattttttctccagctttgaccagaatatatttccaagaaaagagtagcgagcatcgctcgcaagagtggcagagtcatctccagagaatgctccgcgcacttccggcgcggtgtcgcgagattactgcttaagacccccgaaagcccgagtgatacacccgtatccccaagagatgcgccatatatcagatgaatctcgggaaacacccagtatattgcctatgttccccggatacgcacgatacgcgccgttctccagagtttccggaaaattgcacgttccgccttgaacctaacttaccaaacaccccggattaagcgacccccgcagaggggcgtccacttgacatttccgggcagg

SEQ ID NO: 48764 - DNA, 295 bp, Oryza sativa
  unsure (1)..(295): unsure at all n locations
agagcgcggagtcgaaaccggtgtttgcgagcaagagaaagagtgtgtgtgggaatggagaagaggggctgcggtaataagggggaggcagttnccaaagagaggagattccagagttgtgattttaagacggacccggtgtcattttctgtaaaaggccatgggatagtgagccggggtcggcgaagaggagaggacccccgcgccgtagcgctataggcgacgattgagatgaatgaataagagcaataaagtggactttacacagaggtaagggaccagtagatgataagga

SEQ ID NO: 48765 - DNA, 290 bp, Oryza sativa
cagtcttgatgacaacgcgtggacagccccccttggggtttagagaagaatgaagacaaaaaaggaagaagatgtggatggaaaacgtgacggtagtattttgtttctaatcttggaaaagatcaggggcagggttgcgaatcgactaattataataatatttatctaattgtgcacccttgcaattgcacggatctaatttacctttttattaaaaagtaaaaactaggaaacggtacgaattaccccccgaactatcgcggtcgtccaaattacccccattaaccaca

SEQ ID NO: 48766 - DNA, 371 bp, Oryza sativa
ctgggcccgaggcagaccttaggctatattcttaaggcatatttggggtatgcttgggacccaagccaggtcccaagctacttttatgcttagagttttgagtcatatacgcaatattcccccttaggtagggagaatcccatatatgaaatcttaggtgggcccaggacactccagagtgggcccctagctacgtcaccctagggttactttttaatttttaaagacattctcagcatgctatttattttataatgatgcttttgccggataaatgggtacctcggttcctatttcaccgacacatagtataagatgttttggcttcttcatttctaatctagattcattaattttctatgaatttaaac

SEQ ID NO: 48767 - DNA, 1501 bp, Oryza sativa
actgggatggctcctaggcctcttgggctctttcctggccggtcctgctcagccaaatagttaataatttttttctgttgtattccttgctttcacttattcatgttggtataaataaacaggataagatacttacattatttatgataaattggataattttatcaacccatgagtttttcatctaacgtttgtgttgtgcatctttttcaccgagacacttttaactatttgttatttttctttcattgattcaccagttgaatatgtaatatttgtatttttatttaaaaaaagctggtacatctttttatttagtatttttcttgtttcttatttcccacgtgctagcttgtgtccgattcgtatctccacgtgttcacatatatgcccacgtctacataagagtaaggataatagtgagttataaaccaactataaacttatgtgaaagaaagagagaaaaatgaggagtgttgactctcgtgcaagagttaggctatacacttgcgaaattgctaattagcacaagtcgcgcgcgtttctggcctacgcagccctcaccctcgtgcagtctatctcttccctttttttgtttttcttgcttctctttttccgccgcggggagaccgtgaaacgtttttttgctgatttttttattttagaaattgaatctttcatctttaatttttgctgaaagttttgaatttgatttaaaagttttcaaggtttaagttgaaattttttaaatctgagttgaaagttttcaaatctttagttcaaagttttggaatcttgacttaaatagttgaaagtttttatgatttgaggtgaaagtttttaagtttgagttgaatgtttttgaatctgagatgaaagtttttaaatctaagttgaaagttttcaaatctttagttgaaagtttttatattcgagttaaaagttttcaaatctgacttgaaaattttcaaatcaagatttgaaagttccaaaatctgagttgaaaatttttaaattgaagttgaaattattcaaatcttgacttgaaaaattttaaatccgagttcaaatctaggcttgaaagttttcaaatcttagttgaaaagtttccaatcctgaataaatctgagttgaaaggttgtttcagtcagcaaaacaaagggaagaaacttacgcatggcgaatttttatccaaaaaaaagaaacccgaagaaaacgacactaagcgctattagcggtgaaagtgcgcgcccgccttcgctcctagcgcatacgcgcgaaacaggaacccccatacacttgcttcaaaacatgtacattaaatttgtgatgagaagaagagagaggagagaaaccatcaaccaaccttatagttaacttattatacacattagcttttatattaactaatagtcaatagttaattatactattaaactttctcaaagtgtgtaccgtctatgtatgtccacgtcagcccacgtgagagttccggccaata

SEQ ID NO: 48768 - DNA, 1501 bp, Oryza sativa
tttttgtgcgggagggattagttcccatcccttctatccgaacacagcctaatacgcttctaactgttactagtattttgatatgacaacatcatgtgttaccatcacatcaactctcgaacagatcactgaataactcaaccagcaatggacttgtacacttttcattttgcatataatataacgccgataatgctggatctttcataaaaaggcaatgtgatatgattctagaaaatccaggagcgaagccactgcccgacaaagcctcgtcggttccctgagcgtttatgttattttagctgtttccgtgtatctattagcagttcccgctcggtgcaagcatcaaattaaacttgtgtgcatatgatcccgcttgtaccaacaaatatacggtatttcctcgcaaaatgatactacttatacggtaatattacaagcctgtacgtaactgtaagcgtcctgtacctcctaacctccacaacaactgcccttgctagccaagatcgaaatcgaatggacggtggactactgtgagtaacctacaaactgaacagacgagcgggcccacccgtcatcctctcacagcaccaacgtcggaaaatatctcacggccatgggccatggcctggcccaaggagagatttttttacataggtccaaaacaagaaaggagattttttacatgggtatgttacactgggcccacagcggctgggggaagcgggggcccacctgccccggtcacgcgatgaccaccgtcacggcggcggcggcgggggcgtcgacctcgctccccggccgccggctgcccgcggcggcggcggcggcggttggtttgtgcttggtggtggcgccgtggaggacggagccccggcacgtggggcaggagtcgtgggagacgagccacgtgtcgacgcagcggacgtggaagccatggccgcagcgcggcagcacgcgcaccttctcgccgtccgcgaactcgccgaggcagatggcgcagacctccgccgcggcggcggggctccctccaccacctccgccgtacacctcgatggggatgctcctgagcgcgcgcttcttgagcccgccgccggcgcccgccccctccacgccgccgccggcgccttcccccgtcgccgcccgccgcgcccaccggatgatgagccgcgcgagcgagttgagcccgagcgcgaacagcagcgcgaagagcagcgccgcgaggatgatcaccatgttggtgtcgaagctggcgtcgctgccccctcccccgccgctgctcagtgcgtgctgcgcctccccggcgctccccggcgacggcgaggccggcgtccccatgtaccagctcatcgacttcgtgtgcacccccatggcctccccccaacttactagaacttagaacaacacgctaagcttcccggcaaattatgcgccgaatgtacaggtccaggtcagtggaaaagctactactactcaccagttatctcgctcgcgaaccaat

SEQ ID NO: 48769 - DNA, 1501 bp, Oryza sativa
ttgatcgttctgataattctggactctgtgatggtgtagtctgcaagatgcacttgctgtttgagctttttaacgtatgccatgctcgatttgacaattcggtaggattaaccatacaacttttgacggtgaagcgatgattaattcattttttttatgaatgtgacaaggaattacacgtcattctattagaataagcaaaagcaagtttttacacgacacggcagccggacaaccatcgcccgggattcgggaacaggaaaagaaagagaaactagaaacgctggctaagaaaccaataagctccagcaaaaggaagagaagcaaaaacagcaagcgagaactcactatatgtaagattaaatcacaagaactaaaccaaccagagaggagtgaatggttggtatacccaaaaacaaaaaaaatttagcgaaaataaaagttatcctcgaaatcgatggatcgcggtctgaccgaagtagtagcgccggtctgaccgcctggatatcgtcggtctgaccgaggttgtaacaccggtcgaaccgccgagatcaatcgccagctcctgtcgccgccgccggtctgaccgcctcgccttagccggtctgaccgccagtaggtcgccggtctgaccgccggtgagatgccggttagaccgccgaaacctggtgaaacacaaatcgaagaactctcaaagtagatgacaactttattgcttctctctgtgtttacaaagtgcaacaacagcattccttacaaaaatcttgactaaactcgaaaccctaactaaactatcaactccacgctttgaaaagcgataaaaaagcgataccggaaagcctcacgctccccctctatttatacatgaggtaggcagcctaaagccacgaaccaaactcatactaagagtcctaaacaccttacgaaaccctctagtacaagaaagaaactcaacataaccaatcgtaccaaatttggactccttccaaattcgactccgcatcccatacgcacacaatacctccatcgtatgccatatggaatcttcaccaaccacgtgcatcaactctagtcttagtatctcgtatgatatctaaccaccacggatatcgtcttaccactaagccgactcccggtccatcaccgcaaatactctcccgaggcatcgagtcacctatacatgaaacaaacaaagaaaccatatttcgagaccaagctatctccaacttaactcattcgtagcaaacaacagtattatatacgtatagtatccatctataagccataaccatgaaacaatcacggatatccaaagaaacaacccgaaaccgaaaccgacacagcgtcggccggtcagaccgcgggcaagccggtctgaccgctcacatagctcctgtctgaccggcaacaaccgcccggtctgaccggtcccgacaaatcagtaaaccctattcatctcctgaaaattgattatctccaaaaccacttcgacgataatctc

SEQ ID NO: 48770 - DNA, 1501 bp, Oryza sativa
tcctaaatcctaatagtatctgagcttatcattgggagttcgcactggtaattttggcatcaagcatgtatgcactagattaattgctgcactaatctatattacctagtcctaccaagtaaagttactcgcggctagtcctactattgattcttgtatactcctagtcctacatgatttacatagccgacagaaaaatctggggatagtcactttgcctgatggtgcaatagtggcttcaatcttcagcctactctgctggcgcattacaatttacaattgtgagaacggttatgccttttagagcaagtttaatagtatagtccactgctaactccaaatcatctatagctaacgtaatagctaattcatataatagttgcttactatactattaatacatggtcccacctgtcatacacacattacatcttggagtccgtgctgcagctggctacagatctgtattatagttagtttatagcctgctattgtacctgctcttacaacatcgaccggctccgatttttcggagattatccaatgaacgagaggttcttaaccgaagaatgcaaccttcgaatcttgcgctacgtcggaaaggtgcgagaggcatccacgaacatggttcacactttagaacgattggttgtcattcggtctctttttcgtttctcgcattaatctaccatgcatgcaacttgatcaacagttcaagaacataaacaaagtggtttactttagagcatttgagcaaactgtatcgcgtagtccgtgcatttgaccatgtctatcctggcacgtaaaaaaaacataaacctgcacgccaagtcatgtcatgcatgtacacttcgtgcatgaatcacacgagagacagcccacgacgcgcagccacgaagcatggccatccacgataacgtaccggcgtgtaatcgaattcgtgaagcatatgtctacatgatcacatggtcggtatggtcccttcacacctgcgaaattcgtggcccatatagcttctgcgagccatgtggcaagtatcaaagttcgccgatttctcgtttaaaaaaatgctcggtgatttttattgtttttttttcttttgctgcgattaactggacttgttcctgcagacacacgggcagttggtgtctccttgtgcgtgacgcgcgggtccgacgaggcgatgcgacgagcacttgcatgtgcggggctgatcgccctgatttgtatgtgttaaccgccgtcgtggctcgtggccggttatggtgggctcaccttcctctcgccgccttttgtctccttttccggttctctcctctgtcgttgggcaaaagctatcaacgattctaactgccaaggaggagtcgcctataagtacctgagcccgggagcaccgctctcttcacaaccaagcaaccatcgattcgatcctagcttaagccgagtgaagtagctagcaggacattgttggtagtgtgatcttctccctgttttgcaacaa

SEQ ID NO: 48771 - DNA, 1501 bp, Oryza sativa
cgaacacgtcgacgatgaggtcgtggtactcggcggcgttgagcgacaggtagcacgccaggaggtcctccaggtcggcggcggtgcggatgccgttctcggcgatcatctcctccatggactcccggaagtccctcctcgggtcccgcgacgacttcaccaccgcgaagctctccgccaggggcggcttcgtcgtcggcgccggcgagcgcgccgccgcgggtggtggtggtggtggtggctttgacttcttggccacgatacgcggggtgttggcgcgcgtcttgaggcggcgcgcggatgacaccgaccgcctcggcttgctctgttcgaggagggtagtgggttttttagccgacgcgcgtctcacgacgtcgatgtgtttctcctccagatcgcagccgtcgagctctctcctcgccggcttggtcacgataggcgggagcaccttgtcgggcctcttctcggtccgcaggtcgatgatgatgtccgtggcggaggtgatcaccttgccgtcgagctcgtcacacgcggcgacggcgaccgtcggcttcttgaattccacctcttcctcttcctcgtcatcgtcgtcgtcattgtagccgacgaacttgtcgcggcggcacggtggggtgtcgggcgcctcgaccacgacgagctccggcttgcgcccgcaccggcagccggtggacaccggcgaggacaggacgctgctgccgctgacggacggcgccagcttgacggaccgccgcctgtgcctgcgcctggacttcctcggcggcgacagctgaagaggagggaattgcgtgtcggagcacttgggatggagcggcgaccccacgagcaggtcgccggcccgcggcgtgtagtagtaggacgccctgtgcgggagcgacaacgcgccgtgcctgggcgtgttcggcagcggccggcacgccctccccgcccgcgacacggccaccgaagactgcgtgaccaccccaccgtggctggccccgccgccgccagcgcccgcacctccccgggcggcgcgcatgtcgcggagcttgaagaaccacgcgttcgggatcatgtcggacagcctgaacttgtgcctccccatggcgccgcgctgcgctctgagctccacagaatgcgcggctgctcgagtataagaagagcaagaagaacaaagctttgtgtgggctgcgtttggttgcttgctgctgctgctgcgcagcttgctctgtacgaggaggagcagaggcgagcagaggaggagatggcgcggagcagaaaagggcgggtaatagagtgggggatcggcgaggcggagaggaggggacgtgaggcgccttttgtcctcgctcctctctatgcggcgtgggcccccacctcgcatggcttcactctctcagctctcatcagtgagacaacgccacggtgaggcctcctcttccattacagattatttcaacagtactgtacttactgctgctgcctgtatttttatctgaaaatc

SEQ ID NO: 48772 - DNA, 1501 bp, Oryza sativa
gcatcaaaaggatcactgaaactcattacataatcgaagacatccagcgaaaggtactcctctttgtgccccatcaacatcatacaagcaaagtaggcctcaacggcgtaattcttgtgagaccttttatcatagacaacagaattgtctattggggatgttaagttgccaagattccaccgagaaagtttcatccaacggacgacgagttttgcaaaatcatggatagactttgtcgaaagctcgaataattccataaacatatccgttgatactcccatcccaattgcaaaacttccttctttctgtaacgcactttgaccgatcttctcctccagttccatgttcttcctttccagttcatccaactccgctcgcaaacacacaatctcagagtctctcttgcacatgccagcttgcaactccacggccaacttttgttgctcctgaattctagagcccacatagcactggtacattggatttctccatttgttcatgttgacatacagatccttcaacccggcagtctcttgaagctccgatgtgaatcgctcatcagcgatcgtaatctcttcaggatcatatggcacaagagcttgctgaaggttcacgtaactcaatttgaggccagaaatcgcgtcgagaagcctctcaacaaacgcttcctcgcagcgagcagaggagcattcagagacgctctcatggtcggacacatgatgcgggtggactttcaggtgcgcgccgccgtcttcgctgctctctccggtggcgctgccgtcggccttgggcttttcgcggacggtcggcgcgacgccgacggagcgcaccttgcagatgtcggagatgcgcagcagcaggcaggaggagggcgtcctcctcaccttctccgtcgccgactccatcgcaagactgcgtactactggtctactgcaaaggcgaggcagagcagcatcaggctccaagaacgattcaagatggttgagacaggaagtaaaacatgcgcggattccaaggcgagagtttgcgggtcttcgaagagattgattccaaccggatcaaagccaagaacacgataaagtctctgcctttcttctgaaggttttgggttttagccgattgccaagaagaagaaaaacatcaaaaattgcaaacaaacaaacaacttcaccgtatattctcgcacagtcatgagtactcagtaatcactaaccagtgtaccttcagtgaccaccccaagaagctccaataaccgccattgaattctcgcgcctgcacggatccaagaagccaaaagcctgaaagaaaaaagctgcagcgaaggtgaggtccctgctctgaatcttcgagaatccaagtggttttgggagaatgggaggcaaagacctcgtgggctccaatggattcgaacaacaaaaaagggtggatcgaggaaggcgagtgggagccactcactcggggcagttttcttttgtaatccccagatgctaaggacttggcc

SEQ ID NO: 48773 - DNA, 680 bp, Oryza sativa
  unsure (1)..(680): unsure at all n locations
atgtggttttggaancccgtctggaccaactcggactttgctcgttctggtcgcagccgattcggaatttagccgatccttgctctatttccggaatgattttcatcttgaattccaccccgtttctatcttcatctccgatactcagattatcaaatttggttattaaacatggatatattccgacgaaaaaaaaattagcttattattgaatttttttaaatgttgcacgatgttccaccaggtatatcggaattgtttcactaagtagatcgaaaatgtttcactcgtttaaatcgggcgttgtttcaccttatatgaaaacaatgtttcagcaaatagcgaaagaatgtttcagttcgctgcaacattatatctatacatagtaaaacactgtgagtactctaggtgaaacatttttcggtggaacaaaaaataaaaaaaattccttaaaatagcttagcttagctagcttgctcgtgcagccgagcggcgccggcaatttctcaccggaccatcgcttggcctcgaagcatctttgtacccaagtgataagctagacgcgctggagtgctggaccgtgtgggcgccctgccgtgccgtgatcgcgttgccgatcgcgagcggcaatctttgacccccgcgaccgcgtacctgtcgtcccccggcgtacgcgcagt

SEQ ID NO: 48774 - DNA, 1501 bp, Oryza sativa
aaaataaaaaagcaaaaaaaaaagtccgattgctcttataaagcgaagaaaaaaaaatagcgtataaccgattctccttaaaaacgaaaaaaagcccgagaaaaaatagcggaaaaaataactaaaaaaagtcggtttcccaaagtggcgaaaaaacaataaaaatctggttttcgtcgtcagtaaaaaaagcaaaaaaaaaaagaacatgctaggaagaaaagtcagaaagaaatgtgccatttctgaaaaatggtttgggaaaaccacacaagaaaaaaacacagtttataaaaagcatgccgctctgaaaaaactattagaaaaaataccgtttataaaaaaccgggttgaaaaaacaatcggatttaacatgagaaaaaatcgttgtttctaaaaacggtttgagaaatactgtctgacttaacaagagaaaaaaaccatcatttctaaacaaaggttagagaaaactgtccgactcaacgcgagaaaaaaaaactgccgtttataataagaaccgctccgaaaaaccgtccgaatcaacgcgagataaaattgatggacgcttgggttggataggatccatcaattttttttccatttcctatacgacttttgtttcctcatctattctattctcatgtattggagaccctgcacgtctctgtatgcaattactagactatttgtttttgttaagtatagctactattcttgataacatttgatatggaaataatattaaaatataaacatattttaaattgttatttagataagagtgcacaatgactctattttgtgtagacttgaccatgcgaggcagtgtaggatttgattgatcctattattggttgcaagaatgagattaaaagagtattttagattatatgcatgttgtcatatgaataatccaattattttaggtaaattaagctttggtaaggttgccatcgtcgaggttggaccattacattgaagatgttccaagtttctgattatcttagctataaatgatccatacaaacattgtcattgaaatagttatgcatagaaaacgtatattatgattatatttttttttcaccgattgcaatgcacggacattttcgctagttattataaaagttcaaggtgtttttgtctcaaatcttcgtacgccgtccgaatttttttcgtcgtcgcgtcggcttagttcccgcatgtcactcagagatgcacacacgctattccacacatgtgatagaggaaagaattttttttatttataattttttttattaaaagttttacaaaaataattttccattttgaaaattgacggaattagtcgcctaccgccctctgggagggcgatttttaaaaatcgccctcccagagggcggcgaaaatgacgtggcagccggccgttcgctctcgggcgacggccgtcaacgaaatttgcaggcggcccccttgccgccctccgctagggcgattttatactgtgcggggggccgcc

SEQ ID NO: 48775 - DNA, 1501 bp, Oryza sativa
attccgatgtttcaataaatatttttctgacatttcacaagtttatttgtgaatgttgcacgtggtattattggatgttctagtaagtattttctaatatttcactaactcatttataaatgttgcacgtgttgcttgggatgttgcaatgaatattttctgatctttgaataattataactcgttgtttctcgtataatatataaatgtttcaattagtaatataatcatatttataaattttatcagaaatatagctaagtgagaccttattgtaaagatttaattgtaatgaacacaatggtgaaatcggatggtacatcggataagtaatttagaaggaaaaatagtttaaaggtttattggtagagaagatgaatagagagacatgcacgagagtagggtataggcttggagcatagcagcttaactatgatggtttttctttctttcttttttttttttgcatgcagtcaaatagtagtatgtgggtgaacaacgtccgatcctttgctaaatatcggacgtccaatgtgtagcaacctctatttctccccctaagtttttattttgtttccatgtcagcatttcttatgccctgtccccaattgccccttccggaatatcgatttgaattcctgaatttgtcatagttttaaataacaagctataagtagcttttgttatcatatattcggtgttatgagtgtaactagagagtagagattgaagtgacccatatgatatgatagatgggctgatcaaccttgccattgataataaacacccttaccctctcttttttccatggcatgagagaagccaagataacctccgcgttgcaagcctgacatgagagaagtcaagataagctccgcattgcaagccgagttaggataagggctcctttgattcaaaggatcggtataggattttttccataggattcacaatcctatggattatttcctatggaggcctttaattcataggaaatgaaagaaaacattcctaaggattgcatccctttagttcattttcacaggaaaaaaagaaagaggtctgacctctttggaagagaaatcatgtgttttttcctatagcactattaaagggcacatttcatcttttcctgtgttttttattctcacggggttgaagaatcatactactttaattcctacgttttttctattcctatgtttttcctatcctgcgaatcaaagggaccctaaattccagcatatatatttggtggatgatgtagtcgttgtattttttcaacacatgattaattcaaccatcgtgagaacgagctcctattcgatgcttgaattgaagctcctagtagtgcacaagctgtgccacggccttcgagccggccgagtgtatcttagatttgcaatcggcagatcgcctttgagctctcccacggtgtcaagtgtgaactcctcaccgtcgaccgcaagcaccatcacgcgagctttgcttaaaaaaaagt

SEQ ID NO: 48776 - DNA, 232 bp, Oryza sativa
ctactaacctgaagatagtctatagagaaaaacgagacaatatattagagagctatagatacccatgtagacatactattgagatggtttactattaatttagtctattgctgagatgtacatgttttatagatagcaccttactttatcattttgggtgatctaagatgttaattgctcgtgtggttaatgcagttatgcttgtgtttggagttatctctgcttttttagt

SEQ ID NO: 48777 - DNA, 457 bp, Oryza sativa
gcttccagcagagtagctacgcactatgtgacccaacaatccaccatagaattccaagaacgagaacgaccttctctatcaatatattaaaaaaaaaaagggggcaagggccttctcttaggggggaaaaaaggaacgaggatttaacccaacactgtctttttcttatccagaccgagagtctggttaacctcgatttccacatataaattagatttctacaatacgatgggacctgaattatgaaaaagaaactgagctagttatattccttgaattggttcttgctaattttattgcatgcaatgacaagggttcccggtcatcatatttcctgtatttacagtcaaataaacttattggcggtatgctgtcggggatgtaatacgtttctattgtctaaaagtatctcacattctatgttatctgttactagtagggtatgcaaggatttgca

SEQ ID NO: 48778 - DNA, 1044 bp, Oryza sativa
  unsure (1)..(1044): unsure at all n locations
tgtgaggggtagaaacgtcatatcgtgtgtgtggctggatcaagacggacggaaaacgatcgagaattgacggaagtgttaaaaatgggaacatggtgaactttgggtgctataaaatgaaccggtaactttcggtgctataaaaccaaaagcgtgaactttngatgctatataaccaattttgcctttttttttcttttaacttgatgcaaatatatattttccctttctgaatttagaccaactcacatatttatccagaacatccgaacagaaacaatgtggttgtttggttgttttctttgatttaattgcatctccctatcgatctttaaaaaattgtgcacactgcaatgtgcaaaatatataacccttaatctaaacacactgatatggggcacgcgagttcgtgtatccgcctctgattttatgaagaaaacaaatcttctcaatcaatcactgcaacaatatatgtacttacttccaaataattttggttttactaaattatataagaccaactcatatatgtttaatcaactacttgtatatatttggccgtctataatcggcacgttcatgacgatatgtaccgtccggagaagatacgaaaaattccttggaaagaaaatgatacagaattctggaaattatttaatatgttataccacaccatttcagagacagcaaagaagtttccgttggaaagaaagacaaaaaaaaagaggaaattccagaacctcagtgccgtcgcagagccggacgatacccatcgccacctatttcttctcttcttcgtctttttttttaaaaaaaaagactaaattttactgtcaactatcatttaactaatattttcacttttttataaatgaatattttcactttggatcgagtattttttttaggcattgtcaataaagtttagctatggcaatgtgggtataccnaaccttgttgggccgaannnccgnngtcngttgctttctttgtttcattcataatcccacaaccagtacccaatatttggggatgagccttatc

SEQ ID NO: 48779 - DNA, 1501 bp, Oryza sativa
tactccctccgtctcaaaaaaagacaaaccctgtttttcgtatccaacgtttgaccatctgtcttatttgaaaaaattataaaaaaaattaaaaatacaagtcacgcataaaatattaatcatgttttatcatctaacaacaatgaaaatatgaattataaaaaaatttcatataaaacggaccgtcaaagttgaacacaaaaacctagggtttgtcttttttttaggacggagggagtaaaacttactgtattgtgtaacgccccgtcgcaccatatatatgtctaatagatctacgataggccggtgcaaaccagattaattgtcagaataagtggattatcaggacagagacgaggaacggaggagtataaggttgtcgccatcccgccaagctcctcgccccctgctatgtcggtcatcagttgttgtccgatctgaaccagtattcctcgtccctgctatcatcaaacactcgatctgccactggatccaacaagctcgatggcgtagcaatagcgaacttgaggcgacataataagcatgacaacgagtccgagcaaaactgatcgccgtcggcaagctcgtgggcgtccctgtttagttcccgaaatgaatttttttaggtgtcacatcggacgtttgaccggatgtcggaagggtttttcggacactaataaaaaaactaattttatgactcgtctggaaaccacgagacgaatcttttgagcctaattaatccgtcattatgacatgttggttactgtagcacttatggctaatcatggactaattagactcaaaagattcgtctcgcaatttcccccctaactatgcgattagtttttgtttttatctatatttaatactccatgcatgtgtccaaagattcaatgtgatgtttttggaaactaaacaagccctaagagaagaaaaggcggcgatgctcgatgatgtggtggtctctgacaacaaggaggatgagacggccacaacgataaaggctgtgtttagttcagcgcaaagtttggattttggttgaaattagagatgatgtgattgaaaagttgtgtgtgtatgacaggttgatgtgatggaaaaggactgaagtttggatccaaactatggatctaaacacagccaaagagtaggggacgtcggtggtgctatcgaggagaagtaggggaggtcagctagtggcgtggtgcatagtgcatgaaaacaaagtcatagattgaggggggttgggagaaaaaaatgagaggtggagtggatcacaggagtaaaatttatgttaagggtgcgtttgaaggtttaggttgggacttggaagcatatttcctccacacattaaaaaaagtactctttttttaaataccttattagcgtatgattaattaagtaggcaattatgtattagtttaaagttacttaaaagatagtataataatatgatttttttaaagtaatttttctatattttatctagggtgtgtttagg

SEQ ID NO: 48780 - DNA, 1501 bp, Oryza sativa
acagaaagggagaaaaagtgttcaactacacgtagctacttgccataggccactctggaattcacactgatacttctaccagtactagcatatgtagaggtaaaaatttggtactagtgctcatgcattcatgtgatgtggtttcgtgtgaggtgagctcatcagctcattcagttctcgggaagaacaacgagcaaacaacacactcgtttgcctctcctctcagagcaaagctttaaatctgaatgaaattcgtagaattttttttttgttaaaggccaagtttagtttcaaagtttttattcaaacttccaacttttccatcacatcaaaacttttctacacacacaaacttccaacttttccgtcacatcatttcaatttcaaccaagctttcaattttgacgtgaaataaacacacccaaaaccaagaaattttgtaataacattaaggacttgttcggttagtcccttctcaaatactactaagattgaataggatttagagaggataattaatccctttcaatcttttgcatatagggattaaccgaataagccataacaaagtttttattatgttttaacggtaaaatttatcaaagccctgtttttgattaagatacaatttttagtttggtttctgttagcacgtttttttaaactgttaaacggtgtatttcatatgaattttttttatagaagttgctttaaaatatcatataagtccattttcaagtttaaaaataattaaaacaccattaatcatatgctaatggttttttcatcttcattaaattcgaatgggtcgaaactgtttaatttgttactaagtactactccatccatctactttttgatagtcatatttcatcttggcacacagaccaaggataagtaattctacttatcatccatttaaacatgctactagtcattcatcgtaaacaagcgattcattaatatttacatttctcaatgtccatgtagccaatcatgtgtgtaagaatggagagtcatgcattaaatccgagaaagtcattaagatgataggttgttggattaaaatatgcctatcaaaaataaatttttcagatttggaaatatgactttcaaaaatagatgaaaggagtatttttgtagcggttatacgagagatgcacaccattattacacatgcacacaccacaattacatgctcgtgaatacgcctcctaacacacactctaaccttgattagaaaactttgatgatgttttgtcatgtctgaatgaaaacaacaaacaaatagacaatgccctggaaaatttcatacttgtactgcattaatttacttaatttaggagatgcacttaataatatattaacaaggagggtttagttttaatcctgagatcatgtgtttaattcgcaggatattcacaacttcttcttaaaatttttttaaagtatctcttcctccaaatctcgtttatttaaagttgaatttagctcggatacg

SEQ ID NO: 48781 - DNA, 1501 bp, Oryza sativa
acagcattttggcatcaataaaacaccatttgagacaacaagcaagagaacatagtcaactagcgtcattctggcatgaacacagtaacataatcaaactaaatgacaatagttgaggttcacatcatatgattcatcctcacatccaaaagacaagggagaattgcatatttgccactactttcactccttaactcgaaataaccattataaaatcacgaattgcaaatataccaccaaaagcagtgtgcgtggattccgtatgccatcaccgttccattccgtatgagtaagatgacaaaattaattgatgtaattaaattaaaaaacaaggcaacgcgataagaccatattgcccttgccagattcaaccttatccgtgttcttccccaactctaccgcatcagaactcctcctctcctcccgcacgacgaaccctaaaccccagatcctctcatcccttctctcaaactaggagcaaatcaaccaaaaatcggtcgctttgaagtattagatgccaatggaagaggtgcagatggatttcggcgagtagagcaagtcaagcagcagcttggggcgacggctgcagcgggcggcatcaggctgcggtgcttgcggcggcttggggcggcacctgcagcgggcggcgtcaggctgcggcgcggctacctcgcttgcggcggctccgtcgggcggcgtcaggttgcagcgcgcggccgcggcacgcggctgcagcgagtgtcggcatcgacggcaggctgcagcatcagctgcttcaagcagcatggtggctactgtgggcagtagcagcaggaccaccatggaaaggtatataatctatacttatgcttgtgacctacttgttctatctatcatgtagggatgttaccaacaatatatgtgtgtgttttgaggaattctttttgaatgtttttaatccttgttcaactggttcaagagtccgaatttgctggtttgctatgcaaccttagcatgtgcatagctaaccatatcttgcttgcgtatcttcaggatataatcaagcattagcaatatctctttgtgtgaatatgctgtgcattgtaattaaacaacggcctctccaccttaggtgcttatttgaattaatagatagtgagtttaataaattaatcatcaaacaatggtagcatgaagtaatataagaaagtagccatatgtttacaactttgttaaaagtagtttaagctggatatgtttttacattggtatgatatttctgttagataggtcttccatgcattagttattcagtccctgtatatttagatgtaggtttttcatctattcctcgttgagctgctagaatatttctccattgttttacttatcctgtaggaatgaccaaggcttcttgacagccattattaaggttgagtcttattttaccacatcgcttttgagtcaaaggacatatgttaagggaaacaatgtcaaaatttcgatcgaaagggataggtat

SEQ ID NO: 48782 - DNA, 162 bp, Oryza sativa
agagctgagtgagtttcgatagaaaagcgaaagtgtgagagtaagagaagacgaaaaggcgcgagattaatgaaataagaatagtgaatggatagaggagatagaaaaatacagatttgataaggaagatagaaaagaggaatcaaagaatgagtgaagaca

SEQ ID NO: 48783 - DNA, 1501 bp, Oryza sativa
cctttgactcaaaagcgatgtggtaaaataagactcaaccttaataatggctgtcaagaagccttggtcattcctacaggataagtaaaacaatggagaaatattctagcagctcaacgaggaatagatgaaaaacctacatctaaatatacagggactgaataactaatgcatggaagacctatctaacagaaatatcataccaatgtaaaaacatatccagcttaaactacttttaacaaagttgtaaacatatggctactttcttatattacttcatgctaccattgtttgatgattaatttattaaactcactatctattaattcaaataagcacctaaggtggagaggccgttgtttaattacaatgcacagcatattcacacaaagagatattgctaatgcttgattatatcctgaagatacgcaagcaagatatggttagctatgcacatgctaaggttgcatagcaaaccagcaaattcggactcttgaaccagttgaacaaggattaaaaacattcaaaaagaattcctcaaaacacacacatatattgttggtaacatccctacatgatagatagaacaagtaggtcacaagcataagtatagattatatacctttccatggtggtcctgctgctactgcccacagtagccaccatgctgcttgaagcagctgatgctgcagcctgccgtcgatgccgacactcgctgcagccgcgtgccgcggccgcgcgctgcaacctgacgccgcccgacggagccgccgcaagcgaggtagccgcgccgcagcctgacgccgcccgctgcaggtgccgccccaagccgccgcaagcaccgcagcctgatgccgcccgctgcagccgtcgccccaagctgctgcttgacttgctctactcgccgaaatccatctgcacctcttccattggcatctaatacttcaaagcgaccgatttttggttgatttgctcctagtttgagagaagggatgagaggatctggggtttagggttcgtcgtgcgggaggagaggaggagttctgatgcggtagagttggggaagaacacggataaggttgaatctggcaagggcaatatggtcttatcgcgttgccttgttttttaatttaattacatcaattaattttgtcatcttactcatacggaatggaacggtgatggcatacggaatccacgcacactgcttttggtggtatatttgcaattcgtgattttataatggttatttcgagttaaggagtgaaagtagtggcaaatatgcaattctcccttgtcttttggatgtgaggatgaatcatatgatgtgaacctcaactattgtcatttagtttgattatgttactgtgttcatgccagaatgacgctagttgactatgttctcttgcttgttgtctcaaatggtgttttattgatgccaaaatgctgtcaatattacaatttcatgggcaggggcattcttgtcctaattttcatgaaa

SEQ ID NO: 48784 - DNA, 1501 bp, Oryza sativa
cttatgtattggagactgtgattcggctaaaaggataagtgaaaaaaagatcatctttgctccctcttatttatcccaaaataagatcatctttttaacaatcattacattagagttgatgaaattagagaacaaatacattagaactaaaagtgggaagcaatgcattgggatttaataaaatgtggatttttcaatctttttttctattggtatgtatgggacgagtgaaaaagttattttgggatggaggtagtattcaacaaccttcttgtgttaaatccgaaccattaagaacttgagatgccgattctcactaatcttggataaattggcacattttgagtaatttccagtaaattgaacgaattcgagatgacgattaattgacacattttgagttattttcgataaattgaagtcagctctagataatcaaaacttatcaagattgtaaaccatgcttggcacagctccagcagagctggagttactgcttcataatttcacttcagaaccaactcagagttaaatttaggagttaggcactaccaaacaagccctactcattactgtacttaggagacgactctcggttgggcgcccgatcgggagggggtaaaatcgggctgacgttagcgccgatttatgtacaaaaattactttaaactgatttttctcttaaattacttatccaaatcatgatccgattgtaccattaaatttattgcaattaaatctttaaaacaagaccacacatggatatattccgacgaaaaaaaaattagcttattattgaatttttttaaatgttgcacgatgttccaccaggtatatcggaattgtttcactaagtagatcgaaaatgtttcactcgtttaaatcgggcgttgtttcaccttatatgaaaacaatgtttcagcaaatagcgaaagaatgtttcagttcgctgcaacattatatctatacatagtaaaacactgtgagtactctaggtgaaacatttttcggtggaacaaaaaataaaaaaaattcccttattaggggatttccaaaatatatgggtgtttttttgttgcaatggagtatttcagttcactgcaacattagatctatacatagtgaaacattgtgaatgtactagatgaaacatttttggtggaaaaaaataaaccaaattatcttaatagatggtttcaaaaatatgtaggttttttattgcaatagagttatttgtgtgtgaatacgtggtgggccagctggagggcaggcatgcgcgcgggggggaggggggggggggagcgtaatcattatcgtacttctaattttctctttcaagaatatgatgtgtcaatttcctcaggacctatcctgaactcgcgtagcgatggcttcttcccaaactgcccggcccatctggcccgcgctaagcccaaatcatttccagacaaccccaaaaaatccagcaccttctcgcaccgccgccgccgttcaccggagt

SEQ ID NO: 48785 - DNA, 289 bp, Oryza sativa
  unsure (1)..(289): unsure at all n locations
aaaatggaccagcctagagcagagtcgtgagtaaccgattccagtatagatcgtccacgacagtaatcgaaatgatatgattaaagaatgataaagaataacaacaagaaacaaagtaaagagacggtacaaagatgcagatcactaaagataagagataaaagagatcgatatatatataagaatataaaagagtcagaagtaactacataaaaaaaaaaagaatagccattaacatangggatcaagagatgagttaaccgaaggtgacagttatataaagaaagaa

SEQ ID NO: 48786 - DNA, 461 bp, Oryza sativa
  unsure (1)..(461): unsure at all n locations
tgggggggggtctctttncccccaaaaataatattttaccccccccgggggggcttattggggctacatattccgcgggcgggacaacacgggggcactatcccctggcgcgatnggggcttcctcccgggtcgggcacttccggggggggtcggatatggnggatcacttccctgaggagtggtcgggtgtctccttcttctgcggggctcaccggcgcgattcctgagcttcnctgtgcggcgcgtgggctaccgcgggaggattcttcttcatcgggcctgctttggcgctcctncggtggctcgaccgggctctgctcctgacctgcgtcttcatcttccggggcgagctcccaatcctgccgctgtcgatcttccccgggacgccatccatngacgctgcgctcgctgctgtccatgatgacgccgtcgacacccgcgcccccgacgccgtccagg

SEQ ID NO: 48787 - DNA, 1501 bp, Oryza sativa
ttgcatcctatcatatccatcgtccgtgctggtgaatggtgatgcctcccaagtgccgttgttggatggggttacgtcaacctcacaggtgaatctgacaatacaatattaccttttgtatatgtatattcagtatatttactaaactgcaaaagctgactttgcaactcctacactgatatatatcttagatatctataggagtattctttacccttatatgagtactaaccatgattaaagaaattaattagtaacccaactacggagcagggaagaatatattttcaaaaactaatgaactgttctagggattaagtttgatggcgagcatgctgagttgccaaatccgtatgaatagatttagatcagttaaatagctcaattaatactttaataaagtgtttagagtagccttaaaaaataacagttagatgtagacatactacactactaccactagtagtagaaggcagaaggtcctaggcatcaacctccttcgaaagttcaaattacggcggtagaccacctacatcagtatggccacctgtggaacatgatacaaacgagtgcgcctcactgactgaacaaagggactccattacctagaagccaacgactagtggaatctactcggccaaatccgcatatagattacaattcatcggtgcaacaagaactatatacattagagcatctggaaatgttgagccccacctaaatacaagttcttctcttggctaatagttcaaaacagagtttggatagcagatcgactacaaaagagggggtgggcaaaccagctcctctatcctctttgccgcacttcggctgattcagctttacaccttctagcaaagtgtagaccatccaaaagcatctgggtggaggtgcaaagatgggaaaaaacatatctcaaactgtaataatgggaggattgcacatcgatggaggacttgtgatacaaaattacgcatgcggcccacagcccgaagaaagccttgaaatcagctttggtcgtgtttagttccatttctaatatacggacacatatttgaagtattaaacgtaaactaataacacaacaaattacaggttttgcctgtaaactgcgagacgaatctattaagcctaattaatccgtcattagcaaatatttactatagcactatattgccaaatcatgacataattaggctcaaaagattcgtctcgcaatttacatgcaaactgtgcaattaattttttttccatatttaatgctccatacatatgtccaaacatttgatgtgacggaaaagttggaagtttgaagggaactaaacacagcttttgctagttttactctttctctattctctatcaatatacaaagtggtaaagcttttgcccctccttaaaaacaaaataggactgtaaaaaccaaaagaaaaaaagtacgaattacccccccgaactatcgcggttgtccgaattaccccccccccccccgaaccacaaa

SEQ ID NO: 48788 - DNA, 1501 bp, Oryza sativa
gacaatcaagccgttggatgtttgatagagtggtagatatcctatataatctaagtcaacgtcggtatttaacctaatcggctgccttctaatgacagacgttagccgattgaaagttagatagcaatattgccagagattatataaaacatataataattcgatgaattacataaacaagattagagtatcataaatatggaagcactaatcccgagaacgcaagccgccataacaagttttacctctagttgaagatcgaaactgatgcagctcaagccaaaagcaagaactcatcgaaacaaaacaaaagtaaaagggtggcgatgcgccgagattgtattgaacgtgtgttgtttaattacatggggctcggggtctatttatacccgagattacaaaacaagtccgtgtcggatacgactcttatctctaacaaactctaagataccataagtctttgtggcagaattttgcccaaacatatctctaaggaaattacatgaaatatcctaattaacagatacaattgccttctcaggactctatccatgcgtggcaatcctcatgaaacacattaactcaacccgacaatgtatgccgtgtcatattatcggatttggctcaatcggctaaccttgtccaactcggactttgccgattctggtcgcagccgattcggaatttagccgatccttgctctatttccggaatgattttcatcttgaattccaccccgtttctatcttcatctccgatactcagattatcaaatttggttattaacacagtgctattgccctgtcctttaaaaaagagcgtatttttgtactgcgtgagtttattttacacatggattgttggtgatagaaccatatagcttctattaatggagcgcctggcctttcctgattaaggagctagcatccattgggagcgtctcttcacactgatataaaccctgtttaattagtgccataacaattagattgaaacttttgtccttttcatttttaggatggaggggctttgccgatgctgatgcctgccggccaccttatgcttcctattctattatccttcatcatcctgttatctagactcccgttgttaaattattttaaaaatggttactcattggacaatataaatttgttttgctaagtctcacttcactacactgttgtgacctggatatgtatgcgttgagcatttgaacataatataatttattctgtttaaataactgtgagctgaaccgaccttgctgctacgacttgtttgatgctctaaattaatttgtgtgcttccgttttttcaaccacagcttttgtttaataccatgagcttaaccttgtttgatccaaaattagttcttgatatattaaactagtagaatattaggttttttttcccttttcgaaaatggcagcagcatctctgagacgggacccacatgcagggagacatactatcgatacccactacgagcaatttgctt

SEQ ID NO: 48789 - DNA, 361 bp, Oryza sativa
cactacaagacgttttggatttttaatggattcatgcatgaatttaatttatgtgtgtgcttcatatatgtgtctaaatttatagttaatccacacgagggatagaaagaccaaaacaacttataatatggaatggagcgagtactgccaccgtctcaaaataaatttatttttcatacatctcacacataccaatacaaaatcaaaaagactatataaaatacatactttaattatcaaatctcaatgtaactatttttcactttatctactcttaatatattccatatttttataaactctgatgcaatgattactctaaaaatgaacttgtgtcggcacaaatgtaaggagataaatt

SEQ ID NO: 48790 - DNA, 1501 bp, Oryza sativa
catcttcctcctcggctccatcgacggcaggtcgttcatgcggttcggggtctggacggcggcgctgctcgcctactacttcttcttcggcctgcacgcctcctacgacaccgccaaggcgctcgccgccgaggtcgccgccggcaaggtggaggaaggcggcagcaagccggcggtcggcggcgccgccggcaactgaaaaaaaagttactattatactattactatccactgaagttatctatgtgtagatagagaattagtaatatttgcattgtcattgttaattatcatcgggattgctaaaattatggcgctacatttttttactttcagttgttttttttcctcgtgtgattgtcatctctcctgtatgtaaatatgatctatcccattatcttttgcggttggttttatagtttaataatagtaatttatgtcatcatgtggcaaattgtggagtgatttatccttttcctttagtttatgttcataagtaatttcatccaaattaaatatcctggtctaaaagctgtgttcggcaatactatcacattgagtagaaagctcactcgttatctgcacgtacgcttcctaacttttaaatggtaaaattattttaaaaaacatattaattaattattcaaatttaaagtaattaatacttaattaataataagctaatgcctagcttatccagttttacatatcttctcctttctcctcttactctaacgtaggcacgtagcactgtagcagaagaattcgcattggtcacatttaggggggaatcgcgagacgaatcttctgagcctaattagtccatgattagttataagtgctatagtaacccatatatgctaatgacggattaattaggctcaaaatattcgactcgtgcttttcaggcgagttatgaaattagttttttcattcgtatccgaaaagccattccgatatacggtcaaatatccgatgtgacacctaaaaattctcttttcgtgaactaaacaggccataaatgaaaaggagaaatttgtgctattggaatttggacctgacgagatcacgagatgaagaaactggacttttgttgtgatagcctatttgaccacattttcctctgatgtgccgtagcgtggaccaaattttgttattgggcctccaggttaggttttgatcctgccggggcctcaatgatgggccatacagttcatgggctcgttataatgggccaagatgtttgtagacagatgctgagcttgaactgttcctttcttcttctttttattttttattttttaaaaacagcttgaactgtttcaggcttgtggtttgtttgatactctttttctggcagaagctttatttccaactagttgtttaccactttacccacgcgctttgcggctggttaaattgaagatagtcgcaataatattatgttgcagctttaataataataataataataataataataataataataataataata

SEQ ID NO: 48791 - DNA, 1488 bp, Oryza sativa
cggaaaaattgacggaagtgctaaaaatgggaatagggtgaactttgatgctactaaagtgaaccggtaactttcggtgctataaaaccaaaaacgtgaactttcgatgctatataaccaattttgccaaaaaaaaaatatgtacggaatagaagtgagtagtgaatagtgagtagtgagaagtgaatatatatttgcttctgatctttgttagaagtatacaagtgaagggaaaaaaaatcaaaggaagatattcatcacagaagtcatgcccaacttcagagttcagactaatgtactaggacagtagcacaatgcaaagtataagaatttcatacagcttcaaatagctagatggataacttctctcttctttttcttttttacttttcgagatcaattcattcctgacaaaatttttattcttccatatgtttgtttgtttgcttggatcaacttgttttctcatgatttttcatataataaatgattgtattagaaaactatcaagaaacgatatacatagtatcaataaaactatcacttattcaaacgataacatatttatgcattatgaatctatggtgcttcagatcgaacaaattgatcatacaaggatcagatcatgttacaaagattaaggcttcatcataacattgttaatatgaaaagcttaaacagttagcacccccatcaagttctgtttgaatccacagtggaggttttaccttaaaacatatcaacttgctgcaagtaacttgacactttcagtttgctgcagctgatgcaatgcctctttcagaacacccaacacattctgtagcagttgtgcttgccacagctgatccaaattaacaattctcacactatcacattcaaagatagcaacattgaccatggatcggtagcgcaggtttgaattgaatttcttctcctacatgtcactgaaaaaatatttagttcctgcaacgaaacaaaaacgatggaaatctttacaaaataaactgctgatttgcaatatatgataaagaataagaagaccattgaccaaaccaagggttgcttgttgcatgatttaattcttgacaaaactgcatttaaaagtcagattcttatttgtcgaaagcgcgtttttgttttcttggaagaagagagacgaatccctcagtttcagatagttaaaccaaaacaaaattgcatgaaagtcactgtacatgtttgcttacgctgatcccatatatatgaacatgcttggaaacatctctacatataactaaatccaactagtattatactccaaatttgcattgacttgggtggcaagaaatgaccaagataaaccagtattatcctgttgatttaagactgagcctgtgaggtatatatgcaattttaatattccctaaaaaataggtataaatatgcagttttcataccagtacactgagtaaatggcaaagccagtgaccacaaagcacccagccatgc

SEQ ID NO: 48792 - DNA, 1501 bp, Oryza sativa
gagaaggccatcacatgtccgaagcgcttccagggaatctttccagcttcggaggactacttggttaaagaatgactctgtctgattaatcagattatccccagatgtttcttctgtcatctcaagatgttcagcagcgcagcgtaggtagacgacattttctgaagacagctctatcttcagcccataacagaaccttgccactaactcgaatgattttgcgccaccagggatgtcagacaatatgatgacacattcatcgctgtctgaattctcctcaatcaatcttcccaggatggcactctttgaaagcagggggaactgcaagcagataaagaacaattagaggaaaggacaaattttcaaatctcaagttcataccaagtacagaggaaaaaaatcacttataaaagcatttttgcccctcttgagaatcagccagtaactgtgactgtaagaataactttcatcaaagtttcttgagtaactgggggtgcaaaaagtaagttgtggttgttcattaaagctcatttcttcaaaattctccataatcacaagcaaagttgtacatattgcttcatgcatctacaaatttacaatgtgtagcaatttaccttgtgaaggtggaaagacatctccccaacctcaacaagaacatcgctgggaagccctgttgtgcagtacctatgatgatcacaagaagaagacgattagtaaaacgaatcattaatcgtttacctcatacagtctaagttaaccaagtgagaaaatgcatttgctacagtggtgtaaagattcttttaagaaactatagattgttaaaaaaaaaaggaaaacagagtgattgtgctaaatattttgatacagattgctgatgaattaattaaacaaaccagtacagctcctgcataagccagtagattagaatcagaacattgctgcaggctaacaataaactattcaaactgagatacttgcactatcttttcccaacaaaaaatgtacaaccatccaattgagatcagagtgaggtatcatgtcacgtgtatattactatatttttcatgcaccataccgaaatatgtgctatcagcctaccagcatactagcttattggctggcacatgtgagtataatgcaacttgaaccgatagattagtttgaaaatccagaatctttgactaatatgatgcacaagagacacaaaggaaccctccccaagcattttaacactacatactcaaaacagtcaaccttatcttcgttattgatggaatagttaaatccttcttacatttaatattaaccacacagttcatcagtgattagtatgtaggtgccccaaagcttccattatcgaaaaaaaagtatgtaggtgagcataggcatgagtcttgaggcatctgacttgtgaacaagatgcgacataagtattgctcgtaaattctggagcttcacaatgtccttatgcctaaaatttagcagtttattcactgaagcg

SEQ ID NO: 48793 - DNA, 1501 bp, Oryza sativa
cccctcctagtttgattctttttgggacggagggagtagatccatatattagcttatgctgatgatgcttatcagcataagcagcctgatgcttatcagcataagcatttccatcaggtgtagaaaggtgtccggaaagattgtgtccactaccaatggctaatgcttattcagcccaacaagctaattgatgggcttttgctgaaaatagcctcagcaacagcaaatcggtgaggctgacaaggatgacagttaaagtattctcatgtccgatcaggacttttatcaacccgagggtataaatatatatttcccgggatatttgtaatctatctttcgactaatacataactttcggtacatcgctaccatctattccggagagttcatagtttcgagcgacgctgcattagttaagttcgatcttcggcgagaattaagttccgctaacttcgcttgtattagcgtggctagaactttatcagtgaattccaatattctattcaagttaatgcatgggttgtctatctaatatatagattttgtccttaactgcatcattgtttagagtcgtattagcttagttacgactttctcggttaggtttgctatcctgactaagtgatatttctataaatcacattattgttttagactgaccgatatatctatcacgtttgtgtagatctatcggctaaataggtttttcctattatcttcaatcatatattgtcacagttgatctattagatcatgtataataatattgattcagtcggcaacaagaatcactgcatgggtattgtcatacgtggaggatggaggaaacatgagaaataacagagcaagtgattctgcaagtgccggacgatgatacggtaaactaggcaagatgaaatattttagtttagtttagttgatcttttgtacatatgcatactgtgtggctccatgcacggattattttcatgcttaggcaggatgggccacttagatggagtctagttttgatcacatatgcatgcaacaattaaacccattcatgcttccctaaagccaatatttcgtactacttactttcgctattgactttgctcttagattgttactaaaaagtttatttatatgctgttagttgtaggatcgaactaatgggcacgctcgattgataggaactttattggagctccacgaatctcccaggccttcgcgtgaacgacgaatttcacgtcaacaagttgtatagtctaaaatgttcgatcaaatacttaaacaatgtctgcccgaagccattttgaacccaagaattggaatttcatatggctgttttaaaactttaagtgaacttcatattcaattgctatgtttagatagcatattcaatagaatggcccccactgtttggtatattggagaaaaaaccgtaatgtcaattttgcaaatgaaatattctatgaataaaagttttatatacgtattcttaacgttataaacgtactga

SEQ ID NO: 48794 - DNA, 1501 bp, Oryza sativa
taaattgttgacaaaatctgaccggaagtcaacgtttttcatgaaaactgagaaattttttgtcccgttttgctgcctctaacactgcaagtctgcaaccccaaagcttcaaccatgtggccatggcagatgctggcttcactccctgtactacttccatgtactcacaagtcgcagcagcagcagcaattcaccaaatctctctccaagagtagtagtgctccctctcccaaagtagattttgctcatgtaacctcgtagacatttttttatatattttaggactaatagagtactacaataaataagagcatgcttagtagggttttatcaaatttaactctagcaagttgggtctggagtgaaaatggagcagcataaacacattttcacccctctaatgtattttgtgagaactccaaccaattcactctgaatggagctggatttgggctctagttccattgagctgtgccaaagaggtcctaactcctaagggaagagaaagaagctgctaattactcccttttcataatgagcaaagttaactactagaacaggattcagatttaagcataaataatactgtggaactgtactgtactgtatgcagtaatgcactgtccttgctcctgcacaagtgcacaggtcccccacactctcactcagctcagccactctccatgatttcatttcactcccatggtgaaatactgagaaatgaaaaccaggataggactagtagagaggataggagtaggagaggatctctgtgcacttggccccagatttccagaacacacacacacacacacagagctttttgagcttttgagctttgagcccctacaagaaccggccacactctcactttcagtttttttttttcttctcttcaccctctctgcatgcggacaaatcttgcaggctctcgtcgtcgtcgccactcgccgtcactctcttgtccccagttagtctttttcttgcaagtcgctggctttcggtttcttggcaaagcaaaccccccttttcattgcgttttgttgccttctccattgctgccgcatttgagtcacaaccctccaaattgcagtcaagaacacactgccaagaatgcagctaagctgctagcccgaatcttaggagatttctactaacttgttttttcttttttttttttactgagttcattcattcattcacagagaggaagctagggctttgttgttcatcagcaagagagcccccacaccagtttggtcttctcttctgtctctggaccccattgaaatgatggtgtcttcttggctgctccggggagattgattagatggccagggggggtggccattgctgagctttggagtgaagtgaagtggagtgtactctgttcttgtgtgctctcttggtgtgtgtgtgtgtggtggctcttcctcttctcctctccggagagagagagagagagagaggcagcctagatccatttgcaggatgggttcca

SEQ ID NO: 48795 - DNA, 191 bp, Oryza sativa
ttgtcttttttctaataagccaaaacggtttattagagaataaaaataaatttataggtaaaacttttatatatatattcttggtgatttaaaagccaatgctgaaaaagaaactacattgaaaatatctcaaaattaatatcaaaattaaatttaaaaatttaaattttaattatttttttctgaatagg

SEQ ID NO: 48796 - DNA, 1501 bp, Oryza sativa
tatatatgtgcagttagtacttaccgttttcaaacataaacgttgcccctaaacgaaatcagccttgtgcctttgatttacgttggtctattttattttgattaacatatatttctagcatgcttttcaaactgatattttatgtaaaactttttgtacagaagttgttttaaaaaaaacagataattctatttctcaagtaaataataattaaaacttaattaattttatactaatattttttaaatttgctttaactttatcttcattttcattttcagtataaacgaataacaccattgttcaaatgttgtacacaccatggcttatcatcaaacgatcaagtcaaacttgcattagacctctccatgcaagtttcacgctttggacgatcgaggacgtcctgccacagtataaccccctattcgcaaatactaatgagtactgtacagtgcacaccatatggaaggtttgttgcgtcctcccaaatctcaccatttaattacctcgaaaagacagttcttcaatgtcactaatgacaaggacttcttgtgttattgatttcctcaactgttcctgccaaatccttcgactgtatagtactcccaaggcctgggtttagatctcaattttttcttcaaacttttaacttttttattacatcaaaatttttctacacacgtaaactttcaacttttccgttatattatttcaatttctatcaaacttttaattttaatgtgaactaaacacatctaagtatgtaggagtagtcatgactagtgctactacattttgtactccgaagtacagtagtaatcctatttgtactgagcagcagcagtgcagccagtcactctctaggcttatctttcaattagttgcgctgtctcgtttacctatcactgtttaccatcgatatcttaaccttactcattagtaggagtaacttttatacgattaatttgttattgttgacaaaagttgtatttatgacatgacacatattgctaatatgtaacaaccttttaagtatatactatttcttttttaaaaaaggacgagcagtcaaaactaaaagaacttattactattgattgatctacatcataagtcatggaaagataaagtaaacacataaaataatttggcaaaatttgtcagggaacacttagaaatactgattttgttaggagacatcacaacaacagtgtcttcgggtaaattcatgttggtgcagtgtctcttaacaaagaccgtacatttaagtgccacgtagtaaattttaccaaaatagattataggcaaacttttatatgcgtagcatgttctcttagcagttattactacggaaaagctaatgcaagaaaataatctataataaaacctcatcattaaatttgaaatttaaatttaaattttgggctgtagctaataaaatcaagcagatgattagaggccgagcactccaatttaagagcagaggtagtcaaaatcttca

SEQ ID NO: 48797 - DNA, 1501 bp, Oryza sativa
taacagacacagaagaatagaagaatatattaatgttctcattacccatttcccctcagagaaatgcatttctagatatatattatccaacactgttaatgccaaccagaatcctgatctcaaagtgtaccacgcctaatcttaaatttcacagttgggagtcatcgacaagtgttcctacaaccatttggccagttaacaaaagaattgcgcaataaatgaagtggtttagttccttttttacgagttacatgttccccatgatcgacgctgcaagaccaacatatatagctgcaggcaagacgcttccgaaacagcttcaactgtcaaggagatgtttttataaaatttagtcatctacgttagttcatgattgtagctacctatcaaggagatgttcttttaccttcaggcgatgtcccctcattcttagttgtcatccgaataattatatttttttaaaagaaaatcacaatatagattaatatgtaatatatcacttcataaaatgtaagtataaattcaattcagctattcagttaattaaaaaaagaaacgaatgtgattataaatagtgcatgtactagttcagcttttttttcaacttatcgtaggacatatttaaacttacatatgatgatatatcaatttttttatctaagttgtcaatttctttcaaaagcttttaatatataacagtttggatttcataccagaaatgagggtgtaaaatcaaagcgttttttattgttattctgtgatgaacaattgacatctgtgtttattggttttgatatttggagattattggcgaagtggttttggagatgactgattttttcaggtgataaacagggttactgtttcttgtcaggtccggtcagaccaggcagtggttgcctgtcagaccggcgctatgcgagcggtcagaccggtttagcccacggtctgaccggccgactctgtgtcggttttagtttcagtttgtttgtttggatatccgtgattgtttcgggtttatgacttctagatggatactatgtgtatgtaatactgttgtttgctactaatgagtcaagttggagatagcttggtctcggaatatggtttctttgtttgattcatgtgtaggtgacttgatgcctcgggagagtattgccggtgatggatcgggagttgacttggggataaggcgacgtccgtgacggtcagatatcatatgggatacttaggctagagttcaatgcacgtggttggtgaagattccatatagcatacgatggaggtattgtgtgccccgagtttgtaaagtttgtttcttgtacggaaaggtttcctaggtggattagaacttctagtatgagtttggttcgtggctttaggctgcctacctcatgtataaatagagagggagcgtgaggtttcccggtatcgcttttgagagcattgagttgtgagtttagttagggtttcgagtttagtcgagattttcgtgaggagt

SEQ ID NO: 48798 - DNA, 1501 bp, Oryza sativa
tgccacaattatagtaaatagagttatggcaaagttagcctccatccaaacagcgtttccaaggaacccaactccaaagaatctagtcaaagataccacaacccgaaaacaaaaataacccatttcaaaaggggcgacttgtaatttgtagcagtggtaagaaataaatctgacctttttcttttcatcagatttgttttactacctccaagaagctctctctccgtttttcttctcttcctactaaacccctcaaaacggaaagaaaaaaagaagaaaaaaaaaactcgaccaccacctccaccactcacacctcgatccggccatggcggcctagccctagcacctagggttcgcgcccccaccaccctccccgccgtctcggagaccgcgcgcccccagctcccgcctcgctgtcgcgccgcctgattccgccgccggcgccgaatgctacgccgtttggtggtggtggtggtcgtcgtcgcctgattccgcgatctcgtgagctccggggggtgcgcggttgcggcggcggcgcctgagaggaaggctggactcgtccgcggcggcggcggctgcgggctagtgtcggtggcgatttgagggcggcggtttgggttagccgtcgccgagagtgaaggtgctgtgttttgagtgcttgggatgagctgcgtgttgatctgatgaactcggggtcggcggcgttcttcggtttctccgctcacttgctcccgccgttggcgaaaatccggttcttcggatcgagttgcggtcgcctgggtgtttttcatcagttttgggtgaaaatactcgagctctgaggggggtgattggtttccaagtttgattgatttaaagagtttgtgtggaattttttcggggagatgaaggggaggatttgctgcgacggtccaggttttggttagttgttgagggagaaaaaaatggaagatatttctgggcgcaagagaggaaggcaggtgtttgctgctgctgctgggagcatgatgggaagctgaccagcagcttctccggtatcctggtgcggcggagtttcgtgctctttggcgacgggtgcactggtgattggagatgaagctctctccgccggcgtcggcggatatgccgcaggccttgccggagaacgacggtatatatccttgctcacaatttcgacattgtttcagttctgcactttctcagcttgtgttgatgcctgcattgtaaagtggattatggatcatggagctttgtgattctgcactttgagttgtttgtgcatgattacataatgcataaatgagtctccattgctgccttgcacacactccgcacatacacacacaaagaaaaaagaaagaaaaaaaaagaactactcctacattacttggctctgttcattgccctcatgttataacattatttgatactgactgaacctcctactgtctgtgggcaagtacaaatagtagcttcacatgaacttaactttctggtggtt

SEQ ID NO: 48799 - DNA, 416 bp, Oryza sativa
agaaataaaatgttatggttggatttattttttttattaaattttctatattaattacactctttgaaattttgttagaatttacatagcttaattgctaattttgataattagaaacatcatttcagcatttatttaaatggaaatcaaaataaaaatcattttatctctatgggccattttcagcccattttcttcttcagcccgcaagcgaccaaagttcaattattatccccatactcctctcacttttagcctgcaagcgaccaaagtttaattgttatccccatactcctctcacttgctgaactgccggcccacgtgtggctcaagtggtgcggcccatcgctcgatcgatttgagccgttcattttgatagacggctcagatctgttccaaattgatgaaaaccctaa

SEQ ID NO: 48800 - DNA, 1501 bp, Oryza sativa
  unsure (1)..(1501): unsure at all n locations
tccacggtgccagctcaataaaacgcagacgtggagggtgtcgcggcgcccctgcaaagcacctcgcccccacgcagagcgccgcacttcctcctctcggcgagtccgcgcgcgccgtcacgaggtgaagttccgcgcactgaggagcgcgtgtcctagacgcgcgcatgccctcgcggcggacggaaggtggaatcccggattcgccctccaaaatcgccctcccgccacaactatttggtcgacgcttgccctattccgtcgttgccacgctcgatttctccctcggattcgtaggtaggtctctctccggcctcaccatcgccaccctgaagtcccaatccatggcggcctctccatcgcctcccatgcttgctgcattcattgttcaagaatcaaacaaatccattgcaagctcaagaatttgtagcccaaaactacattcacgcaatcatcaagaaaataatctacaaaccaatccgaaccgtacgcaagaactccccgtcaactccggtcaatccttggttgacgaactcgagaaccaaggagaaaacaagaagcaagaaccccagaaacccaagaacacacccagcgaaaagttcgcccctccatgtggattcaagaaccaagaaccccaaaaagtagcacccggcgacggggcggcggcgagctcgctatcgcctcgggaggaggtggggggaaaaggagcgnnaggcatgtgtcccctcctgacgaccggagttgacgggagaccgcgtcgccacccccgaaagcccaccgccgcggacttcatgtctcccaccgccgcgccagccgctccccccggggatgcctccctcggcctcaccagccaccgccaccggggacacatcccaccgccgtgccagccactgccgcttgggacgcctccggctgccgtgccagccgccgccgcgaggggttggagagagcgaagcggtcgagggctaggcatccgcctgcgcgctgggttggagagaagggtaggtgagaaataaattttgctccgctacccgtgtccaaaagcatagggtcacgcccactgtgggcttcgtttccttcatcagtgtctccatccaactaagccacacatatattggtgcttgcactgtagggtgagtgtctttgggctaattttttgggctaggggtacgggccccatagcttgcacgaatattcatggggcacctaacctagctttgacgtctctaaaatcttcttttttttaaggcaaaacggtatgagattgcgtcttttcattgaatatagcatgagaaaaatataaccctaggggtaagaaaagaagaaaagctctatacactatacagagtagggcaaaaaaatcacgtaagcgttttgctcctaccatcgcccatgtccgtgtaaaatcaaagtgtgtttgattcttattctgtgatgaacaattggcatatgagattattggttttgatatttggagattattggcgagtggttttggaga

SEQ ID NO: 48801 - DNA, 1501 bp, Oryza sativa
tttttggggaggatctttggaatagaaaaattagatgtcagcagtttggcggtctttattctcatgcacttaataaatctgattctgtcaaggccataatgctcaaggaatttgaggattgttttcgtttgtctctttcagcacaggcttatgatgattttttacagctaaaagatgaactagataatctctctctgaatgatgtgattggagataattggtctttcatctgtaataattcagtctactcatcgaagaagatttatgccctgaactttgtgagtctctctccttctagatccttttcctgggtttggaagtcattgtgtatcaataaaataaaagttttcatgtggctgctttcgtgtgatcgactgaatacaagggatatgcttgattgaagaaagtgtgtgaaagaaaatgatgacttatcatgtgctttgtgtatgttgagtttaagataaacgagagaacatatgtttttcagttgccctttcactgaggcgtgttggagaaaaaatggtttccagtggaattataatttggaatttcagcaaatgattggcttagctaaaattagtttcggaaggaaaggttttatggaaatcttttccattgcttgttggcatatttggaaacagaggaatgcactaattttcaggaatattatcccagatgttcaagcctggtttagattctttaatcaggatattctcctacatttctgtaggatgaatggttcttcgttagattttgtttcttcctggttacaaactttgtaattttttttggacttttttcctatacagattgtaatttttcttttattttaattttttaaactactgggcggcgcctggtagtatttctactaaaaaacaattatgtaacaatgcagaacaagtttgtcagggttatggataccacatacataatagtagtcgactaaatctcggcaggacccaccacttaccatgtcctatacggaaacaacctgcggatataggaggagttctggataaggaaagacaaccagagttctacatggaaacgacaaggactactcggattgtatccatattggtttccctagttctacttagacaaggggacacctatgggtataaatacaaggccccctaggaggaaaggggaagaatcaacatacacagaacaacatagaagccacaacatacaagccaacatacgccaagacaagacgccggatatcgacttcagggataagcacggctagtcccctacggtgtctccagatactgttaggagagacgaaagcgttatctctgatctcgccaggcacatactcgaggaggaagactaccctgttatcgactacgagtcagaccttcagaccgccatgtcgacaacagttagataggctagcccacatattgtacttgtgtgatccagatgaataaagagtaacaacggcttcggccaacaggatgtagggttattacctgataattcaggggcccga

SEQ ID NO: 48802 - DNA, 630 bp, Oryza sativa
cgactgcctgccgccgccgcctcaaccgacatcgccgatccggtctcccgtcgttgtccctcggccgctgaagtctcctcggactgtctcaaccggcatcaccgccgtccctccgccactcaaatcgtcacgcatcgccggtctcctccgacaaactgctttggcgacctcctcctcggcctccgcctcaaccgccgcctatacggagccacgccgccgttcctccgccgccgaaaggtatcttgaaccaaaacattcagattgaagcacctcatgtgttttgtgatcttgtctttgagaattcgaaaagataggttggaacaactgcacctttggttggatttgattatttttaagatattttaagcgaaatttatatttttctatagcaactggttgcaattttttcctgtcacatatatatgtttggtcgacttaaaattcagaatgatgcggtgtgctaacaattttctactttctatctcagggtaaactttttaattgcatctgagactttgccatgggtctgaactggcaatattcttcatgtaatatctatatttcaggtgaccagacaccagtacatacgcaaggtgtagacttttgtataatttggcatatcgtagactt

SEQ ID NO: 48803 - DNA, 1501 bp, Oryza sativa
cattatgagatttatttatccctcgtctagatccattgacatgcatacgaatttggatatatataaatcgtctcttagcggggatacaaagcccttcttaaaaaagataaatgtattcaaaacccaaaacgtcttatagtgggatacaaaggaaggtattcctaatgtacgccttcagaatcaaagcatagacataaaaaatcaaatcatccatcaacatctaatgtttaatctatatctcattttagatagttcattatctactatcggtttcttataaaccataaaaaaatagctattcctatacatatgtcaccaaatagaattttccttctattttatcttgttcacatggcccaaatattattaggaggagcaacaccattattcattgtgcaaatcaacgatcagcagttaattacctggaatattatcctaatcaacaccattaagcttatgaggtatgcaccactatttctggaatactatcataatcaatttgcacacttcttaaatgaagttgattgttgaatcgataatcatgaggcaaacaattcccagaaaatctgtccactcaggaccttggctctgaaaaaaaccagtgaatgaacggatattgaagaaaaccattatgggtttctttggatgaatttagcattgttaacaatcatcgatgtttacatcctatattccaaagaacacaaatcagatcacttacaccaccatttgctaagaccaatgccatcactgttgctgcccaaatcacttaggacaaaggattccacataaagctgaggaacttgatgctcttgttctattccaaaaggaagtaaaaaatatgaggatttcagaacaggaatgtaggtaaacaatgatcagaaaaaggcagataaacttctccaatctgcttgcaccggacagctgcaagcgttctactgcatcttctgatgaaagccccacgtgaaatgtattcagctcctcaaaaaatgtctacaaggagcagattcacctgttattatatatccttacaaagcacagcattaagactatatgtttcagaacccgtcaaagtctacgatatgccaaattatacaaaagtctacaccttgcgtatgtactggtgtctggtcacctgaaatatagatattacatgaagaatattgccagttcagacccatggcaaagtctcagatgcaattaaaaagtttaccctgagatagaaagtagaaaattgttagcacaccgcatcattctgaattttaagtcgaccaaacatatatatgtgacaggaaaaaattgcaaccagttgctatagaaaaatataaatttcgcttaaaatatcttaaaaataatcaaatccaaccaaaggtgcagttgttccaacctatcttttcgaattctcaaagacaagatcacaaaacacatgaggtgcttcaatctgaatgttttggttcaagatacctttcggcggcggaggaacggcggcgtggctccgtatagg

SEQ ID NO: 48804 - DNA, 745 bp, Oryza sativa
cccgggcaaggacggcaagcccctcggcgccgccggcagcgccatcgtcgccatcgaagcctccaacttcatcgccaatggtgtcgtcttcaaggtcctcccttcaccttctcttcggttccataactcttaaccttttgaataagattctattagtatgtttatttaataaagatactagaataacgtatatagatttgtttacaaagtattataataaaaaagaaaaatatatttatttattatatatattatactctttacatttctggtcaaacttgcacgttgaatatttggctataatttcttttatatactacttcctccgttttacaatataagactttctagcattacccatatttatgtagatgttaatgaatctagacatatatattaacatttatatgaatatgaacaatactagaataacttacaatatgaaacggggggaatagtgggcatttagacagctatcaatgactcgtttttgtttcgcgtgccgataagtagctcggcctaaatgctccagagaattcagccttaaagagtgttttagactaaactactcagcgaaaagagctgatgagggttctgttgcataaaagcatctatcattgctgtagcagagcaatgttgcacattagcataacacaatgcccacagaaattagccacaaaatcaacaagttagaaccgcaagagttattgataaacattatctaaaattcaaagaaccgaatagg

SEQ ID NO: 48805 - DNA, 288 bp, Oryza sativa
catgcatgttttaatttttgttatgaactaagctagaaatatatcatatggtgaagcgtgcaaatggaatgataagtgatggcagaaacaaagattaattgagctgtggacacgcaatgaaatataagttaaattaatctgattgtacatatattagttattttagtcaatgaggagaagccaatatttgagatatgaagatattctctgttcagccctttggagttcatgtgtcgttacagatgggtagtagatgacagaacagccagcaacatgcaaagaaacaaa

SEQ ID NO: 48806 - DNA, 1501 bp, Oryza sativa
caaacgacaacaattgacaccagacagatcttactagctcccaaacaagccatttgactaaaatgttcactctatgcccataaatatggcacactttagtgagatgcagatgcagttaatttcagaatccaataggagtaacagaaagtaccaccaaacattgaaggagacaccgaaagaatccagacaacatacaaacacatgaggaacaattaagaccaacacagttcaagctcaggacacagctaaattccattcttctataaaaaaaaaggagttccaatctttcccccccaacaacaatatcaccctgattctgcatccacattttacctcttcagcgaattcctgcctcggcgccccaatgcgcttcttgatcgcgacgacggagccgtcaaggaggaggcccttgtacaccagcccgaagctgcccaggccaaccaggttggcctcactgaagctcttggtcgcctgagccagctcgtccaacgagaattgcctcgctccctggtgctccggcgccgacgagctcctgcctcccttgccccactccactgccaccacgcacattggcaccacacatcagcatcgaaatggatggaggatacaaaaggggccaagaactaagaaacaatggcgaactgagaggcacccagggtggaaggatcggaggagccggtctcgtcggagttgcggccccggcggcgggccatgcgccgcgcggcgcaccacagcgcggccacggcggcgagcagggcgacgcaggcggcggcgatgccagctacctcggcgaccggcagcgacatccgggcggcgcccgtgacatcgaatcggcaaggccacggtttgtggtcgtcgtcgtcagagcaagaagcagcagcagcagaaaacggagccccgaaaccatcccaagctgcctaagcagccggccaatccatcatcatcgtcatcagcgggcgcattgatggaatgcggggcgagagcgagcagcgagcgatctttgtccgaatcgggagctaatctatctaccccgctgccaagaagaagcggcggcgctttaaagaggagaggggagggggagtggaccggggtggaggaggaggaggaggagcgccacacccacacccacatggagatggtaagatagcggggggtttgtcgaaacatggattcggcaataataaaacggggtagcgcacgagacctaaaagtggatggatgtggagacaaaggatttagacaggttcaggccctctcgatgagaggtaataccctactcctgtttggggatttgaatccgccgggtgtattatagatctgacgatctagttgtctcatatatgctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgt

SEQ ID NO: 48807 - DNA, 372 bp, Oryza sativa
acccccccccccacccccccaaaaaaaaaaaaataaataaaattcctggatcctctacccactcactttttttctcctatttgcgttaaccttagcttctgttctttgaaatttgcattaaccttaatacttatatttggggattcaactgaaccccctgtcctatgttagatccaccacttcttacttctttttatatatatcgcaggaatcaatctgaattaagaagattagcgtgatgtctttcctcaggctgttacctcaaaggttgccgcaactttttaggtaggtattagctgcaaattttcggcaatcttgtactgagtgtaatttgtaggctgcatttgtatattcagatatccaactttgcca

SEQ ID NO: 48808 - DNA, 156 bp, Oryza sativa
tttatagcaaaatcggtatggaaagcccaaattggccggcgaacgaaaattgggccaggcggacgctattgggctttcacaactcacttagaaaaaataggccgtaggcccacatgtagcccccagcccaactacttaactcaatccccaccccaa

SEQ ID NO: 48809 - DNA, 1203 bp, Oryza sativa
ctgcagccctgcctaaatccagctccacaactccagtacattttgtgagagagctccacccaactctactcccaggtttggtggagctaaaactgtttggctaagctccatccctcctggagctgtgtcaaacaggccctaactctagatctagggtgattatgatctagagtaactctcaaccagcttaatttggcttgcctctactctaaacataatcaccctagagctgattttaaatttacaggtttaattttaggattatttttttggttgttttgtttgtcataaagctttcatgtttgctcgcatcacaagtaaaagatctactccctccatttattttatattacaagtcattttacttttctataagtcaaacattttaagtttaagtttcactaagtttataaaaaaatataataatatttttaacacaaaacaaacacaatatcaaaatatattcaatattagatttagtgaaactaatttaaggttgtaaatattgttatcttttctatgaatttaatcaaatttaaaagtttaacttaggaaatatcaaagcgatttataaaatgaatcacagtagtttttaaaatttaaaatttataaatcatttttaaaatttaaaatcacgcgttaattatataattcaaagttgaccaagcagaaccatagcagtatttttttaggatggcatccgtgttccaatctccaatcatttggcactataccaattattacactgagttgaattcacgtgtcatggctaacattttccattgcagagttactacaatacccttccatttctaaatacaagggattttggttatggttagttgtgacatatcatagtacaataaatctggataagaaactgtccagatttattataataggatataccacatttaaacaaaacctcttatatttagatgcggagagattattaaccatcagctgtatatgtcaccggcaaagcaagtaggctacttcggcacgggccctggatatgatagaaactccatcactctggatttggacaatctgagccgtctatggctgagatcacctctcctaattatcatacattagaggggtaaatattttctttttcagctttcctgttccattcacaacgatcgcgggcaggatttataaaaccgtgcggtaaagcttttgatacccacacgatcacca

SEQ ID NO: 48810 - DNA, 1501 bp, Oryza sativa
taaaatgagaagttttatcatcgctttagtatcctttacctacttatctgcattattgttttttctgataatgatgggtattttggttatttttactctccactaatttcaccttggaatgctaggaatggccttttttgactaggggagtagctttataggccactgcttgacacttgtggcaacactggttatcggctaaggccctgtttagttcccaaaacaaaaatttttacgctgtcacatcgaatgtttggacacatgtatggagtattaaatgtaggaaaaagcaattgcacagattgcgtgtaaattgcaagacatttaagcctaattgcgccataatttaacaatgtggtgctacaggaaagatttgctaatgatggattaattaggcttaataaatttatctcgcaatttcttggcaaaatatgtaatttgttttgttattagactacatttaatactttaaatatgtgtatgtatatctgatgtgacaaccaaacccaaaaaattttcccaactacacaaggcctaaatagccaatgtaatccttcaagttcacccaattgctcaatttggtccttaatattttattttaaaagaaaaaactcaactggtgagggaaagggaaagactgtccccatgcatgtctttgcactaagaagaagtctcaacaaaaccgatcgagaaaggtttaccatattatttatattatttagatcatcaggagtttatcatatactactccctccatcccactagataaaacatgcacgtattttaaaattcaactcttgaaatattagaccaacaattagtctaatacaaatagaaatttatttgatgaaaataaaatcattgaatttattttcttgtggttatgattgttgccgctacaaatattatattatagtatacttgaaaccaatattcaaatattagttttagatattgtggtaagtttgactatgttttattctgtggaacaaagggagtagcgtgtttgtatcaacaaaatcataaccttacataagtacattcaaatatcaattcaatgatgatattattgtcatcaaacagattttatttattagactaatagttgaccaaattttataatctatacctaattaaaaaatacgcaaggtttccgatcgtccgtttcgtccgtcgcctaaaaaatccttctaatgcgcgcgtgtgatcgatcccttatcaacccttctccgatggcaaaaaaaaaaaagaaagaaagaaaaaaaatcatgctggcaacctcaccagtactggccttcacagcctgcccccgtgcgccttaatccgagtacgcatcaaatttggacccaaatcctagagaaatcactactacaataacacaagaacagatttcatcagcactcatcaacacaagaacagattccatcaacacaagaacacaagaaaatgccgacacaggaagggcagggtgccgccgtcgctgccaccgtcgcagggccac

SEQ ID NO: 48811 - DNA, 1501 bp, Oryza sativa
  unsure (1)..(1501): unsure at all n locations
aagaaaatcgcttaattaaatttacaaatttaaaatcagctttatgatgattatctaaagtagggccaaaccaaagctatcaacatcttgagttactcccaactaggcaactagcttttagagtcgtatgctaaacagtggaacatggttctccatccgtcccacgaaggcgcacccacatatcttaaatatccaaatcttatattactagaaaaaatgcccgtgcgttgcaacgggtaaaaaagtttttgattgctatatattatactccttcacttttcatccactctcccataatatcatctttccgtttttatcaaaatcaaagagaatctttctacttttatcaaaatcaaagcgaatccataagagtcagataaaaacgacgacagtaaatccggtgaattaaaaccaaatgatgaggtaatagaaggaatcaattttttaattaattgaaggaggaaacgcatgtgagaggcaaatcgacagtggcgcgctaggggtcggcctggcgactttaaaaaaacgaatccttaccgcgtgccaaaaaaacgacttaaaacggatgcaaagacagcgacaaaaaaacagtggaaaaaataaaaaagcggattaaaaaggatggaaaaaatacctgtattttttaataattaggtatatggatatatatttacatttgcaaaatttgtcaaaccacacgaaaatcacaaaattatataacgtatattttttacgttaatgacttctatggtcatcccaatatgcaaatatataaaaggttactatttctatatcatatcagtgttgaaaaattaaaacttccaaggtcctgaacattaatgtgtgagtactaacctgggggtatttttacaaatattttgtatgtactgaagtataggataaacaatacttttagggatgaaaatgaaaaactgctggattcagatgccacgtgcatgttcgcatgtggcctttggcagcggtgcggtgactcgccgtccatctctcttcatgtaattcacgctccatgtactgcacatgatttcgcacagagagagacaaagggcgcccagcctaaccgctcggagcgagcgccgggcgcctcgatttttccgccctcattatctcctcgtttttccctgatcttttctcttcctctactcgtcctctccattgcgcatcttccctttccttctttttcttcttctcttctcagccgacgacgccctccatctcgtccctcccacccttccccaacccatggtggggtcgctcggcacggggccctccccccaagcggcagcgccctacccttggcggcagtgccttcgnctcggctcctccacctggccggcggggtctttcacccggtgagcaacggtgcgcgacgggccggggagcggcggccagcgatctactcctcggcgtcggcggctctctccttccgcgagcggcaacaggcggcggcgcctttccgcccctcgtctcgtctccctcgcca

SEQ ID NO: 48812 - DNA, 1501 bp, Oryza sativa
gacggtggcagcgacggcggcaccctgcccttcctgtgtcggcattttcttgtgttcttgtgttgatggaatctgttcttgtgttgatgagtgctgatgaaatctgttcttgtgttattgtagtagtgatttctctaggatttgggtccaaatttgatgcgtactcggattaaggcgcacgggggcaggctgtgaaggccagtactggtgaggttgccagcatgattttttttctttctttcttttttttttttgccatcggagaagggttgataagggatcgatcacacgcgcgcattagaaggattttttaggcgacggacgaaacggacgatcggaaaccttgcgtattttttaattaggtatagattataaaatttggtcaactattagtctaataaataaaatctgtttgatgacaataatatcatcattgaattgatatttgaatgtacttatgtaaggttatgattttgttgatacaaacacgctactccctttgttccacagaataaaacatagtcaaacttaccacaatatctaaaactaatatttgaatattggtttcaagtatactataatataatatttgtagcggcaacaatcataaccacaagaaaataaattcaatgattttattttcatcaaataaatttctatttgtattagactaattgttggtctaatatttcaagagttgaattttaaaatacgtgcatgttttatctagtgggatggagggagtagtatatgataaactcctgatgatctaaataatataaataatatggtaaacctttctcgatcggttttgttgagacttcttcttagtgcaaagacatgcatggggacagtctttccctttccctcaccagttgagttttttcttttaaaataaaatattaaggaccaaattgagcaattgggtgaacttgaaggattacattggctatttaggccttgtgtagttgggaaaattttttgggtttggttgtcacatcagatatacatacacatatttaaagtattaaatgtagtctaataacaaaacaaattacatattttgccaagaaattgcgagataaatttattaagcctaattaatccatcattagcaaatctttcctgtagcaccacattgttaaattatggcgcaattaggcttaaatgtcttgcaatttacacgcaatctgtgcaattgctttttcctacatttaatactccatacatgtgtccaaacattcgatgtgacagcgtaaaaatttttgttttgggaactaaacagggccttagccgataaccagtgttgccacaagtgtcaagcagtggcctataaagctactcccctagtcaaaaaaggccattcctagcattccaaggtgaaattagtggagagtaaaaataaccaaaatacccatcattatcagaaaaaacaataatgcagataagtaggtaaaggatactaaagcgatgataaaacttctcattttatgtgctaagg

SEQ ID NO: 48813 - DNA, 803 bp, Oryza sativa
ttttagaaattattagaaagaagcctgataggacaataaactataaaaactataagtttttaagatccaatttttaaaggttctaaggagaatgaatagaaacagtggtagattgagcaagctaataaaaaatactatgacagaagtaaggggtaacaactgatgtgtcttttaaaaactactacctccgtcccaaaataagtgcagccgtagatatccgtgcccaacgtttggccgtccgttttatttgaaaaatttgcgaaaaatttgaaaatatttagtcacacaaaaaatactattcatattttatcatctaatagcaataaaaatactaatcataaaaaattttcaaataagacgaacggtcaaacgttgagcgtgaatagtgcaaaactgcacttattttgggacggagggagtataaaattagaaacacgaagatgataaggtttggtatttcaaaatcttaagtcaacaagataactatttaataaattttaagtacactcatattaaaaaatatataatttatattgacatgcaatcattttgcgcgtaaaaaaaataattttatatgggtactagccgcgtaattgcgcgggccatccagttagttcctatatataattatggtgctaggctgctaataagctgccagttcgccacaagcccacaccaccacgtcatgacgtccgtgtcgtattctctaccgaaagtgtgcatgatgatggccatggccatcagctgcatgatgatgatgtcccaagcagcgtcgtcgaccgccgccatggcgcccagggacg

SEQ ID NO: 48814 - DNA, 1501 bp, Oryza sativa
catcaaaaacttttatatacacaaacttttaatttttccatcacatcattccaatttcaaccaaatttttaatttagtgtgaactaaacacaggttaattacctccacggtggtggcggacatggggcggccgacgggcggcatggccgcggtgaggaacacgacggcggcgaccctctctgggaaccgctccgccgcgagcgcgacgctgaacccgccctggctgtggccgacgagcacgacgcgctcctcgtcgtcgccgtccccgccggccggcggcagcgcggcgagcgcgtcgagcagcgggcgggagtagtcctcgaacgtgcgcacctcgtcgacgcgcgccgggtgcgcgccgctggcggccatgtcgagcgccgtggcgcggtgccccgcgcggcgcagcgccgcggcggccttgtaccagcaccacgcgccgtggcacagcccgtgcaccagcacgaagtggtgctggtgccgtcgacgacgttccacgctctcatggccgccgccgccgagctccatggcgccgccgcccgtggacatgggtgcttgggccatcatcgattgtgcatatgcatctgcgtagctcctatatatatatttccttctttaatttgcgtgttgcacatcatcagtagaaaattatttaatgcacgtttatatttctttgcgtgttgcatattttcagtagaaagttaataaaatagggtattatggtggtgggctgctgacaaactggcggctagcaccataacatttgtgtaacaaatgtggctaattaagtgttaaattacactaccttattttcaataacttttcacacaacatttaaccgtttatcttgtttaaaaatttaatatagaaatgtaaaagtgtaagttaaaattatattttatttgatgatagaacaagtccacaatatataaaagaaattatatttatatttttttaataaaataaatggtcaaacgttatacgaaaagtcaacactcatttaattaaacggagggagtagtatatgttttcttcgtttttaaataatcggcagcaatggctatctccacattatctgttctgtaagtttatatctatacagtgagatttatttcgttcaataatgtagaatatttgtagttttgttatggataatccctgcaggcctgcacgaaaaattatcaaacagtggtcaagaccggtctggcaattgcgttattctacgtttttacaaaaaccaaaaagatatatcgccacatttaaaataggtaaaattaaatttggtagccgctattattgttgatgttcgatgtcgcgattccggtatttgcatagtatggggatcgttggtgctaggatatatgcgagattgaggtaaagagatggggacaatgatttttatataggttcgggcccctgaattgtcaggtaataaccctactcctgttggccgaagccggtcgttgctcttattcatcataatcacactggtacaatattt

SEQ ID NO: 48815 - DNA, 1501 bp, Oryza sativa
acatatctaacagtagttgacgaaatctcagtaggacccaccacataccatgtcttatacggaaactgacctcggatatggagggagttccggataaggaaagacaaccagagttctatatggaagcgacaaggctctactcggattgtatccatactggtttccctagttctacttggacaaggggacacctatgggtataaatacaagaccccctaggaggagaggggagacagaacaatagattaagacacaatatcaacatacaagccaatatacgccaagatatgccgccggatatcgacatcaaagatatgcctggactgaccctatcccggtacctacagaggccggctgtagggatctagcgttgtctctgatctcgccgagcacagattcgaggaggaagactaccctgttgtcgactacatgatgatacttcaatctgctatgtcgataacagatagataggctaccccaaatattgtaccagtgtgattatgatgaataagagcaacgaccggcttcggccaacaggagtagggttattacctgacaattcaggggcccgaacctatataaaaatcattgtccccatctctttacctcaatctcgcatatatcctagcaccaacgatccccatactatgcaaataccggaatcgcgacatcgaacatcaacaataatagcggctaccaaatttaattttacctattttaaatgtggcgatatatctttttggtttttgtaaaaacgtagaataacgcaattgccagaccggtcttgaccactgtttgataatttttcgtgcaggcctgcagggattatccataacaaaactacaaatattctacattattgaacgaaataaatctcactgtatagatataaacttacagaacagataatgtggagatagccattgctgccgattatttaaaaacgaagaaaacatatactactccctccgtttaattaaatgagtgttgacttttcgtataacgtttgaccatttattttattaaaaaaatataaatataatttcttttatatattgtggacttgttctatcatcaaataaaatataattttaacttacacttttacatttctatattaaatttttaaacaagataaacggttaaatgttgtgtgaaaagttattgaaaataaggtagtgtaatttaacacttaattagccacatttgttacacaaatgttatggtgctagccgccagtttgtcagcagcccaccaccataataccctattttattaactttctactgaaaatatgcaacacgcaaagaaatataaacgtgcattaaataattttctactgatgatgtgcaacacgcaaattaaagaaggaaatatatatataggagctacgcagatgcatatgcacaatcgatgatggcccaagcacccatgtccacgggcggcggcgccatggagctcggcggcggcggccatgagagcgtggaacgtcgtcgacggc

SEQ ID NO: 48816 - DNA, 1501 bp, Oryza sativa
accaccacctccaccacgacgcacgcttcgagcgccgcttcgcctctccccgctccactctctctctctctccacagcgtttgtttttgctcgcgagaaaaaccctgcggaaaatcgaaaaatctcgcctcccctcttcgtcccctcccctcccctccccactcgccgccgaagcttccggtttttgttcctcctcctcgaaccctcgggagagatcgcgtggtgagcccgctcgaatcttttggtatatctttgttcccgttctttccatccatccctgcttttttcttggccgctttccgtgtaatgccggtgccatttccgcctctttggttttccccgatctgtggtttcggtcttgcccggtagagattcgggaacgggaagcgcggcggcggttgcgtgacggtttcttgagggttcttgagaggtcttggttcggttcgtgcttttatctttggtggggtgtgagtccgtgcgtgcgtggatgtttttcttttgcttttgcgaaagtgaaagtgtgcttgcgaaaagggggtaaagcgacgagcttgctgtgtgcgcgcatatgtagctgctggtttcttgcgaatggttggggtggggggatttttttgctcgattcctggttttcttgccgggttcagatctgatcttttttctgctctctcttgtgtgttttttcgagttgtttgtggttgctcacctcttgtgcaccggcaatggcaggcttgagcagcgtttcttgctcggcggcggcggcggcggcggcggttgctagatctccggcgtgacaccggtcggaatgggctggatgtcgacggggacgacgttcgggcgttgatggcaggtgaatccctggacgaatgtttttgcatttggtttggtctccctctccagatgtagatggggggtatatatgttgtcttgagttttctattactatattggagcatggtcaatagggagaacatgcttgttcttgccgcctgcgctggaaatgttaatgcttctctgtcctttcgagattattattattctttaaagtcgcctactttgcagtgcaagaactcatttttcacctcttggtttagtgatttacttccctcagtggggaacggcaaccgtcctttgttactttgagctagtaaatgcgcgagatttacctggtttgtccatgattgctccaggtgtggtgttcccatgattgatgatgtggagatactgggatggttcgagatgaagaaaatgcttgtgaggtgctctgttgagagaaaccttattacctgatgacttgttaattcgaaggtgccaggttcttcctgttcattttgatatcgttcatcatttttgtttccgacaaccagccattttaaaacttgttcttatttatgatgttgcagttattctagcacaccagttgctgctggttggatctttttctttcattgctgagtaggagcgtaggagttggttggttcaagaatttcgttcaagatga

SEQ ID NO: 48817 - DNA, 293 bp, Oryza sativa
gactatatgaagatactcaagcctacaatgggtgtctcggcactgaaaaaattcgaaaatacccctccctacagccactcctatctcacgcgtctcttcctctgccccttctccgctttgcgtctctttctctgcccttctccccttcgccgatttttcctccgccctctccccagccgctccgtttactccgctctcccctgccgatccttttcctccgtcctccccttccacctcgccggcgccggatcctctctctcttcgccgcctctttctccctctctcgttgcagc

SEQ ID NO: 48818 - DNA, 1501 bp, Oryza sativa
aaagaaaaaaggggaaggtggagaggccaaatgcacggatgaaaaagagttaagtggaggggtagctgactagctgttgcgtgaattgtaggcgaaggagagaaatgtccatatgggaaaattgattttgtcatgcggttctattaagaggcccacctacgaaaatagcctattatcgtaggtgggtgttggcggctgttaaatgtcgattctataccgccaacatctgcataaagatcagataataaaacatccaacatagagataggcacttaatctcacatattccacaggtgttggtgtatatttggatgcagataataaaccctgaaggtgggaggaaaatcagactaaagtgaagagaattatgtatccatgcaaggacgggttgtgaacttcatcgaaacatcagtaaatcagcccaaaataccaagaaatggatagaggaggaccaggggaggacttgggccaaaggccaggccagatgggcccagcccaggttcggccctggttcggccgaaccacaatctcagccatccaggctggggtttggcatggacgtcccagatgcatccctgatggcggttggagggcacttcggacatttcctcttcgccaaccgtcatacctacctctatataaaggcttcactccctcacttcacacacacacttccaagcttgagctgaattataagaggctctattgtactatattgtatactagaataggaagagagtagagtagaaggagtcggaagaattccggagttgttggtaatcttctcctatttcttttattttgtttattactctgaattcaatataatattcttcttgagtaatttagatttatcttgtgagaattatctcttggttagttcctaatcagcatacgggattattgttcactataatcaactaaaatatagtgattgctttggtgagttataaacactaaagtagatattaattgcttagacgtggtgtttaggtaattattatccagtaattgctgtgtatcccacagtatgttgaggtgggtgtagaggtggtgacagccctatggaatgtctcttccatacaagttttgaaggaattttaaccagaggtagaacctcatggaagaaatactccgtaggggaagtgctacatcggtatatccgtgcgcttgtggattttatctgtaaccgtatcaaataccaacagtgggcctcctgcaaaaatatattttcgcatgcaacccttgaaccactcctggaatagcaatttttgcatgagggtcagttatgtcccgcttgaaacctaggggggtctcattcagaaaaataaaatctatagtagtgccatattagctataacgtcccgcctctcccagaccgggcccacttacatctgccagctttcataggtcataggctgccctcacaaaccaacacaagtcttctgacccgcctgaaacctagaggggtctcattcagaaaaattaaatctatagtagt

SEQ ID NO: 48819 - DNA, 1501 bp, Oryza sativa
cattaatactcatgttagtgtggattttgtatctctgaccatatgcttgtttctttctttctgtagttagccggaactcagattttctcatgttctgtagatactcagatgaatgtgtgacctgggaaatctacatcatgagcttattgcctaaaattgtacatgtaactcaaatgccgacctccctgattttttatgaaatgtatatgcagttctattgtgggaaaccgtcaatctagatgactgattatttttcctacaactcgtgactataaaagatttttctacaactgttgtcatgtttcatttcattaacatgccacacaactacagattggagtagttgcttctgaataaaatcaagatgcttgatcgaaaccaggaattagcatcacatccattcagaactttgctgtgaatagacaatctgatcaacagattataattctactttccataaacatcaagactgttacatatccttttgcagagctgaacactgctcaagactcaacagtagtctgtccatccatccaaccattcattcattcatgcaccacagcagctgatagtgtaattgactataatttgactaatttaatccataaaatctgggaacgagtacgacaatgcatccaatgaatacctctgaaataggagaaccatcatttccctatggtgttcctaaacaaaatgcaccctttaacactgtgtctccactgttaaaaaaaaaacttctatgggaaatgtattcccctcggctactttcatcaaaagtgttacccctgcaagctgcaaagacaaatatgcaaatgtcatgttgcaagcacatatgtgaaagtttgagcctgtcaagcattttgttagaaccaaaatgctcttggcacacaatggtagcaactatgcctccaaaattatagtcacagggaattgtatttcagcatgtgttccctacccactgttagttgaattttctatggttacctataatctttttaccggaaaccgttactttcttccaagaaaatattatcggcccactggtttgggttgatgtgttgtttgcttcgagtctcccatttgctctgacattcttgcctagggaaagacatgttttaccattaagcaagcctgaaataatctgacatgttcactttcttagttttctttcattttacctatgtctcacatatagatctcacttcttgaatttctcttctattttactgtctgtttatttctactgggtgtgctctgtttataaaaattaagttttacatatggtattttgatcatccaggttattcttagagaacgaagtgacatggcagggagattggactttaatgatgtgcattccgatgcagaatcggttactgcaggtattccgaatcgacgagatcaatacaccacgcctcaaaagtcctcaagcactccattctgtgtaagtattattgcacacccattttttcaagttagtttaagcattcatgatatgctg

SEQ ID NO: 48820 - DNA, 307 bp, Oryza sativa
gggtgtgttatgtcattaccttcggtcctggatgtttgtgttttggtgatgggcaagtcatgccattcctgatactaagtcccggttatgctttaaggtgacacagtagtcctgtgtcttagtttcaggttatggcaggaaaggggtgggatggaaccctcatagtgccagaaaactgtgatagctgtgctgtctgttatcatgtaatggtgtaaaggtcgtgtgtaatgtaaagactatcccatttctggtaatgaaaatgggctttcagcccttgctcaataataataataataataataataat

SEQ ID NO: 48821 - DNA, 1501 bp, Oryza sativa
gactgcaaaaatcgttttttacaagtgtgaaaattttttataacgacgagagctcagtttgaaaactttggtaagtattttaatggacaaggactcaattttaaacttactgaaattaattagagtttcatctatatgatcggtaagactaacaagaaaacaaaataagcatatgatagttgtaattctaatcttcctttctacaaatgatacagattagattaatcaggttacacatgatagttataattcttatctccctccctacaaaatgatacagattaatcaggttacacatgatagttgtaattcttatcttcctttctacaaatgatattgattaatcaggttgactcaaacatataatctcatatcaatttgtacagttgttgtgataataagttttgaagttgcacatgatgatccatatacaacacaattattttgtttgagatcagatattatattttgtccaggatggtaacaagatgtaagatgtaaaatggtttcctacaatatctcagctaaatgcatagagcaggggttgttttctagatgatggataaactaactagctgtggtctgcttctgcactgaagcattgattgattctagttatcaaatgcagagcaggaacagatgttgttggctggcagtgtctccattgcgcagaagcatggattgattatatagttatgaaatgtagagcatgaatagggtctttggtatgtaaaagagacatatgaatgctatcttcataaaagtagcatgctacttaccggctggttcattcatcgtgacgggaaaattgctcaggggtgaaagagaggatgtatatgcatgaagcattgaagccgcaagagaaatggcatcgtattggaaacacagaaacaaaaatatactaccacgatttcatattaagctttgatttttttcaagccaaatttttaggtttgatgaaatttatagaaaaatataataatagttttaacataaaactaagaagctatcaaaatatattcaatgctgaatttaataaaactaatttaacgttataaattttggtatattttgcataaacttgatcaaacttttaagaagtttgacttaaacaagtcaaaagcgtgtgaaacggagtgagtagataatttctaatcatattggtgaaagatatgtccgattttttttctcgaggtaattaagtctattcttactgtattgctaactttgtttacttcctttcaatccaatacactgatacttataaaagcttgtgcctatctcatcgtattttttttaattgttgaatatatatacaccggtacttttagctgggggatctagtctgttcatcatggatgtttgaacgagaaaatatgtagtgaaaacctacacctacgttgtggaccactggatctaaaatgtgcgttccagattaggcgttacctacccagctcccactcaacacgttttatgaataaccccccgcgtcaggctttat

SEQ ID NO: 48822 - DNA, 1501 bp, Oryza sativa
taatgaaatgaaacatgacaacagttgtagaaaaatcttttatagtcacgagttgtaggaaaaataatcagtcatctagattgacggtttcccacaatagaactgcatatacatttcataaaaaatcagggaggtcggcatttgagttacatgtacaattttaggcaataagctcatgatgtagatttcccaggtcacacattcatctgagtatctacagaacatgagaaaatctgagttccggctaactacagaaagaaagaaacaagcatatggtcagagatacaaaatccacactaacatgagtattaatgttctaaagcaatatgcaagataatggagaacataaagcacgacggcaggccgtcgtcagcaacatcaattctacgcacggtcctcccatcgatgaataatacaacagtaacagctgcagacgccgccggttgctccacatcagtgggtagctcatcacaaccttacagaacagcagtaatggaggaacaccattactaccttttgttggccaatcgatgaggggctaggcccaagtggagggaaggacaagaagaacaagaagaagaggaagctgtagctgtctctacaagaacaccgacggcatagtaactctatttcatctgcagttgtcagtgttggtggcatcaaaaccctagttcatctcagcccctaaattgttcaaaccaagaacattccgctcattccgcggaagaacatacacgaactatagcagggatcaagaagagagaatgaccttaattcagtggatgctggatgagcaatcggcgaatcgaggccgccgttcgcagatgcctcgacgtcaccggagcagcatgggggttgattcatgttgccgcgaatcacgtggaaaggtggcgctgttgccgaccaccgccggcgccccaccccaccccaccgccgtgccgccgccacaccacccttcccccaaccccaccgtcgtgccgcagcagagagttgagtttggggatggatcccttctgaatccgagatgtgttgtggtacaatttgggggctgagattctaaagtttggaattaggcggggtgttttctgaacatttcattctgtggtgacgtggacatatctggaacctacgttttgcatccaagtgtggtttctatgtttgcactatagatagtgtttccactacatatcttctatgtttgaacggttttgcatgtttgaaactgcaggtcaatcccaaatccatttgattttcgctctcgtcggtcttcccacccatccatccatacctccgccgcctgctccggcgaatcctccgccgcctgacgcctccaccgctcatctcatccgccgccacccgcctctcatctcgctgctgctccacggcatcccccgctgctgctctccggctcggtggcgcagccgtcctctcccgatcgagccggcgccattctcctctcgttccgtggcttctcgagctcaccaccacaagcggttggatc

SEQ ID NO: 48823 - DNA, 1501 bp, Oryza sativa
ctagtttcgaactaagcaatagggaagattttgtagactgatgcaagcaaatcccaattcacaagtaaataacagtaaacttcaattttttgatcatgcactcaacatttgctacaggtggctacatcgatcttaaagtaacatcatgaagaatttaattattgtgctaacaagtagcatcttatttgggatgtaattgcactcctgccggatccaatgcacgacgtccagccattaatcctttgcaaagcccaaacaagcaagcatcaggcaggaatctagaggcagaccattagcaacaagaacagcaaagcagtgaggaaggaggggtgctagtgaatagtgatacattgttccaggaggcctccgagtcgtagtgccggacgagcttggagtggccggtgcctttttctgctggtgtgcctacgcgcgcaactatttcgataatggcttggccttcctcatctcggtcgacagcggcggtgcgggattcttgaggaggccggcgaagacgtcgacgacgaacgaagagatggaaacgcgtcacgtcgcgcatcgatggcgaggagtcacggtggcggcgtgatccttggcggcacgagagagtcatcggcggcgtcgcgacctgacggtggtcggcggagcagtggagggggcgcggggccgatgcgcggtcaggggcggatgggtgcgcagaggcagatccgcagatggaggcacggtgcgcagagaatccttgagggcgagggggtggcgtgattgacagagaagtgggggatggggtccatacggaggttgagggggtgcgtggtataatgtgatccgttggattggatgattctggccgttggatttgatgaatgagtaatgtaggtgtaagagtgggttggtgaattatagggtagatgaatagcatgatgatagtgatcagcctttttttcatttctcctgtagtcctgttgagctcgacattgctgtcatcagtccaacttctctgtactttttttttatgctttactgtcggcattaagctaccatagtcctgctatgtcatatctttgtaaaataaacttatctatgggccaacattgttctcctcctaatgtgctgtcattttctgtatgctattctatattggaagctttctgttgttgtgatcacctgtaaaaacttatcagaggcttgtttctggatgctgcaacagctgttctttggctgccgtgtctgtctgtctttttttttttgtgtgtgttttttggcattgattttaatcttttcttggggtcacaatgctcatcattttctcctctcaggtcatggagctaatattattaggtgaagatcaaatggtacagtgcatgcagttaccatcttcatttcttaaatttgtggataaatcagattttggaacctgggaacctagtttgtggttgtactcagtgttctaggtgttaatgtcacttgctaatcactagaatttaaatgcgtggagtacattggc

SEQ ID NO: 48824 - DNA, 1501 bp, Oryza sativa
cggcgaccacccgccggccgagtcgacggccaagctccggatctcctgcaggtagctgtgtctccgtgactgcagggaaatgttaggatcgctgctacgacccaactccatcgtgatcgccagctgtggctctagcttcatgctcgctcactcgagctcggccatgtttggataatgggtttgggatatgatttcccaccccttaaggcctcgttcggcacgtggggagggctttccctagggggaaacaccaccagtccaggattgggtggatcccctcccaccacccaatccacttccacgttgggtgttaaacccccatcctattcggatggggaaaaaaggggaaaagcagggaaagcagggaaaatgcatatctttgaataaaaactgagaaaaaacgagcatagatagcacatctcaacttaggaatagaatcaaattacaaaaccacacaaaataatctgaaatttcaaaaaaaaaagaaaagctgataactaatttctacaatggcatgtacagaagaaaaccaaaattaagaaaatagttcattaaataaagaaaatgaaaatactgccaagcttttaaaacgatagtaacactgctattcaatgtagcagttgacattcgcatgtggtaagtcaatctgtgccctccaaacaatattacaagcatatataatagttgccaatgtactccacgcatttaaattctagtgattagcaagtgacattaacacctagaacactgagtacaaccacaaactaggttcccaggttccaaaatctgatttatccacaaatttaagaaatgaagatggtaactgcatgcactgtaccatttgatcttcacctaataatattagctccatgacctgagaggagaaaatgatgagcattgtgaccccaagaaaagattaaaatcaatgccaaaaaacacacacaaaaaaaaaaagacagacagacacggcagccaaagaacagctgttgcagcatccagaaacaagcctctgataagtttttacaggtgatcacaacaacagaaagcttccaatatagaatagcatacagaaaatgacagcacattaggaggagaacaatgttggcccatagataagtttattttacaaagatatgacatagcaggactatggtagcttaatgccgacagtaaagcataaaaaaaaagtacagagaagttggactgatgacagcaatgtcgagctcaacaggactacaggagaaatgaaaaaaaggctgatcactatcatcatgctattcatctaccctataattcaccaacccactcttacacctacattactcattcatcaaatccaacggccagaatcatccaatccaacggatcacattataccacgcaccccctcaacctccgtatggaccccatcccccacttctctgtcaatcacgccaccccctcgccctcaaggattctctgcgcaccgtgcctccatctgcggatctgcctctgcgcaccc

SEQ ID NO: 48825 - DNA, 1501 bp, Oryza sativa
attcctagatggcattgcttcaaagatcatccttgcatccctgaccctgccacacttagcgtacatgtccaccaaagaactcacataaagatctttctttccatgtacttgtttgtaaagtggctccattgtccatgaagttaagcttgcttgtatgattcttacaacactagtaatatgcccgtgctaaacgctacggagcaattttatttgatcttcaaaaacttaaaatttcatgttagcaaaaaatatttttatatgatatgtgcaattgagtttcaattcaattcatatcgtacattaaatatatttaacacaaagtacaaaaatatgatattgcatggacacaataaatcttgataataattaattatatataatcacttcagtatacaatataaagggaaatatacatttaaaaaatatgttaaaaagtatagatttattccattaatttgttgcgggcataaacaactaaaaaataaagtaggtaaataactatcctaatatttagcatttgcaatacacttaagaaattctcctgcaccgctagtagcatgctcgtactaacactacggtgacatttaataatatacgtgcacgttctatttttgcaagcaacatatatgtaacaaatctctacttatatatatctctcttatctactattataaaaattatatatatatctcttctctactattataaaaattgaatatgtttctaaattttggtatgtcatccgtgtttgaatcggctttaattttatatttcggttttaatctctactattatctttacctattaaaaatgttgcagatgattacatactcaactaaattttcgtccgtgcctctctactgacaacacaactaaaataaaccggactatgatgacttgtgttcactactccagtttccccacgtgcacagtaaacatgaaaaacggagcggtccattagtacgtaattaattaagtatttgctattttttaaaaaaaatagaataatttgatttttttaagcaactttcgtatagaaactttttacagaaaatataccatttagtagtttgaaaggcgtgtgcgtgaaaaacgagcaagatgggttgggaaaaagggtttgcaaacacaccccgttcggactcaaaaaagaaaaggccaatcaagaaaacactaatgactctactaatgaaccgtgactaattaacctatcaacactgtaattgaaccaacatatcttataactacctcaaaaatttgtaactttcagttcttcacatcaatttttcgtccgtgagtccaatcgaacgatggcctccgtttccatacacacgagtaactcatcacgtaagatggataaaacacaaattcaaaaatagatacaaaattcaatcagataatccaaaaaaagagaaaaagaacaggaaaaataataaaaaaaagcacaaaccttatcttaattttattctaaatgctacctctgttttttaatagatgacgg

SEQ ID NO: 48826 - DNA, 1501 bp, Oryza sativa
acacaactatttagctaatcatgtgattatttagtgggtaattataggataggtgatgtcgttgaacgctcccgtctccaccacatattgcaggtctatatactcttgcatgtttagaaattaaaggaaaacatgtattaacgtgtaatacacggtaaactttttatgaactgtcatggaacatacttggctcacctcattttacatatcttcttttattatcccctcctcttaaacactgtcaatgttcattatgatatttcgttcctgctggattaacgaaggttatatgtacaactcgcataaataatactagtaaaactagggttgtaaaatatgtgcgcctacaaagtacgtatgattgtataggaacgagatcccctggcatagtgaattctacgctagagggtgagagggacgtcttgccctggatcgccgttctttgtccatccttcactgtaggcccataagcttgcttggtatagcccattcacggcaagcaatcgcggcgccgggatctctagccttcatcgtcgccgctatctctcactggtgaagcgcgttcacactcgatggtcctcgactctcacatgggggacgcgataccactgccgggatctttgggatgtggatgaaaatcttgctgaggccttcagtatgtgaatatgtgattgaaaatcttgctggtagaaaatctccccgagtagcctaaagaaaaaaaaagagcttgccaacagatactttttcccccttctgttaaaacaagagaccaagtgagtgcagacgatgttgaccaatgaaaggattctctgtatgcgaattgaagagaaaaggagtggtttttcccttcgatttgtcctcaatgctggctgacctcgtcgatgagcatgatgtggttgtctgaggatcatcgactgcgtacgcgctttaccagcgagagatcgatagcggcggatggcggtgagggcggccggagatcccgactgttgagcgccgtgaatcactgatgcaaatgtgctggaatcgagcttaattatgggcctacgactgaggacgtggaagagttgttgcccgtcggatgcacaaagaatggcgatccaagaccggacgtccctcttacgtagaattcactgcgtcagagaatctcattccgattgtatagttttgtgataattttattactaaatttgtagttttgtgatatttaaccttaaatttgtggttctgtgataaatttggcgtcaactctatagtcttgtgatacatcatatttaaatatgtagttttatgataatttagctaaagtgtcagtagtttcgtgaaatttactccatttaaaatttacatgctttggttatttcagcgtaactccccctcctcctccatccaaaagaaaagaaggaaaagaagaaaaaagatcctgtgaaccctacgaaactaccgaagcgaagcgaagcgaagaatcggcggcggcggcggcggcggcggtggggagaagcca

SEQ ID NO: 48827 - DNA, 1501 bp, Oryza sativa
ggattttggtaagagcagctgtaacagcggaatcagcacataattttgactgcttgttatcttgtgactggcagcataatgttttcaagattgatttatatagccatgtattggttaatttgcttgtgacaatttgcaaggttatttatctattgcatacatagaatgaagcgattaacttgtgagttgatgcgaacgttatctaggccattgacttcttttatttttccttcaaattcatgcttctaaacaatctattaaaatcctgcctgtcatgccaaagcatttgtcacctataagctcgataagttacttcaataagcttgtgggcatctcacctataagctcaccaaaccttcccataaccaatttgttcgtcaggtaaaactatattataagctctagaaaatataatagataaacaaaaggaattccacatatatgccaagaaaaacgtttagcattatcttttgttgcattagttggcagcccatgcatccacattcattcatgcttcacaaaagttttagtaactttgtttctcacttgatctttatagtatttgaattgaaaaaccttaagcaacatgaatttctgcacatttggatgacttatatgcgatagttgcatttgactaaaaaatttcttatattctatagtcctaactttattattattaatttattgattgttattttgttcaacatgctgcacagttcaagaattgatagtctgtacagacacaagaacactggtttcggttagaaaagtatgctgactggatttttaggatgctgtgaaatctatttgttcactcctagataaaatcatatataatccagtttatattcccttttatctcttttggggagtttcaagttttctgttattttcttgatcaccatagggtttttaactgtttatctttaaacgatataggaatttccagctttccttgtttaccatgattatttggaggggggtctagtattatgatgtatgaaggtgattatattgactgatagtggattctctgtcatgatgaatgcagtattatgttgtattttggatttttaattggatgcttaaaacttgattcagcattggaagctcttataatgtaattgtcaatttgttttgcggcttgatttgcctttgtctgtgttgtaacttgattcaccagtggttcagaaggacaaatactctactccatatagctgatgatggtttgcattctgtgtgcaagtttaattatcagtgatgctacttttggcatagggaatacgtaactcgtatagtttttgttggatccagctgtgggattttatctctgttatgtgatgcttctggacttcacgggtcggacctactgtacctttttttgtttggatggtgaggaattatagggaatgagttattctttctgcagtatggctgctgctaaatgctaatgaactccagatgttagatcttcaaccttctgtttccatatttattccca

SEQ ID NO: 48828 - DNA, 391 bp, Oryza sativa
ccccccgcacagtacaaaatcgccctagcggagggcggcaagggggccgcctgcaaatttcgttgacggccgtcgcccgagagcgaacggtcgtctgccacgtcactttcgccgccctctgggatagcgatttttaaaaatcgccctcccagaggacggtaggcgaccacttctgtcaattttcaaaatgaaaaattatttttgtaaaacttttaataaaaaaattaaaaataaaaaaaattccaaatcagcccatggaatgagaacggaaattctcggcccataaaaatatttaggctggagacgtgcggcccactatagttgatgtggttggtttgctcactgacatgcgggcgccttcatcatgtgggacccacttgtctgtggctca

SEQ ID NO: 48829 - DNA, 1501 bp, Oryza sativa
acctttgttagggaaaaaaactatcaaacatcaagggctgactttccaacatcgggaggcaccgctgtcttctggaaaatacctcactaataaccatggaaaccaaacgactacttaaaagttgtagttccttctataagcactacaatttactataactagttcaaagttaagactttttgcaacaaaaaaggacagcagacccgatgtggcttggttaggacatctcataagtcataagtagtaacaacaggaaaatcctgttgtaagctgtaagccgacactaccgtacacaccacgtggaatcacaaatccttttttggtaagagaaaattttggacttttaacttccaaacaaagaagctccaagtgcaaacataccaaaagcctatataactgaaattcacgcattacaccgacttaattggtatcaatacaaactatgcgtggtaccgctcgcccgcaacaagatcattgtcaacacgcaatcaggaagtaaaaaagggtgggcacgcacagcacaatttcaaccacaaacacggtgatattcagctcctctcacaacaaagaaacgaggacaccgaagctttaaaagccacaatcattcctcgcgacaagatcaaaactacgctacgcgtattcctaagctacacacagcgcgccagccacgaaggaacagagcgaggtacttagatgcaaagagcatatgccgcggaggagaggacggtagggagggaagaggaggaggagactggagctgctccgcgctgacctcttggacggcgggttacgggccccccggccgccggcgccggcgccagcgcgggcggcgggctggtcgccgtcgatgcggtcgtggatggagcgcttccggccggtggagatctggtccgcgtacatctcctcgcccgacgcctactagcagctacctctcgctctcgctgcctctccgcgagctcggggatggtggtggtggtggtgggtctagggtttcgggggggtgatgcgaatgcgacgcggagggagaagaaggagaagaatatggatttttatgatgcgaggatggaagaaggggggagggggatgtggccgtgcccgtgggacctacctgtctgtggcacagccattttcaaccgtagcattaaatatttatgggaacccggcccggccccggcctggctcggcccatcattgtttgggccggtctgatcacaggtgaacgtagcccgaaacgtttgcttggcttttctgttgagaagcttcgcctgacgctaattagagcgggtacaatagcggactataaattagctataaatatatttcgagaagataaaatatgagagagaagagtaacgagctataagataaatatgtgtatgacaagtaggatcaggtattaattgtatactactcgttccgtttctaaatatttgacatcgttgaatttttagcacatctttaaccagtcgtattattcaaaaacttttgtgaaatatataaa

SEQ ID NO: 48830 - DNA, 1501 bp, Oryza sativa
tcgtcagccccgagctccttggcgccaggtccggtctccatgtggttggggaccaacggatctagacgcctccatgcatgctccgcttgtcgccttcttcgccctctgtcccaaatcgtcggccaccacctcatccagatctgctcaagcgccgacaacccgccttagcacctttgacaacccgcatcagcaccttataacttataagtagtgggagaaggtgctaaggcgggtcgtcggtgctcgagcggatccgtatgaggcagcggttgacgatcttgggacagatcaacgagaatagaacacgaataaaaaactttatcgagtagtggtttctcatcattgtcaagctcgacgccagaaactgtcattctcttataaggtgcgctaaaatttaaattttaaaactatttttcataaaattttattttaaggattggtttttaaatcattaagaacacatatataaaaagtttacctataaattattatttctactaataaatggtacgacttataagagcaagtttaatagtatagtcaactattagctccaaatcatctatagtcaatttaatatccaattcatacaatagttacctataacatatactccctccatttctaaatatttgacgtcgttgacttttttaaacatgtttgatcattcattttattaaaaaaaatcaagtaattattaattattttcctatcatttgattcattgttaaatatacttttatgtacatatatagttttatatatttcacaaaagtttttgaataatacgactggttaaagatgtgctaaaaattcaacgatgtcaaatatttagaaacggaacgagtagtatacaattaatacctgatcctacttgtcatacacatatttatcttatagctcgttactcttctctctcatattttatcttctcgaaatatatttatagctaatttatagtccgctattgtacccgctctaattagcgtcaggcgaagcttctcaacagaaaagccaagcaaacgtttcgggctacgttcacctgtgatcagaccggcccaaacaatgatgggccgagccaggccggggccgggccgggttcccataaatatttaatgctacggttgaaaatggctgtgccacagacaggtaggtcccacgggcacggccacatccccctccccccttcttccatcctcgcatcataaaaatccatattcttctccttcttctccctccgcgtcgcattcgcatcacccccccgaaaccctagacccaccaccaccaccaccatccccgagctcgcggagaggcagcgagagcgagaggtagctgctagtaggcgtcgggcgaggagatgtacgcggaccagatctccaccggccggaagcgctccatccacgaccgcatcgacggcgaccagcccgccgcccgcgctggcgccggcgccggcggccggggggcccgtaacccgccgtccaagaggtcagcgcggagcagc

SEQ ID NO: 48831 - DNA, 426 bp, Oryza sativa
  unsure (1)..(426): unsure at all n locations
aaaactgaaattggctgagcatgtcctagtgaattcaatgttgttcaggaacttaatgaactaaatatatattgtaattttatagaattaatcgatcgtagttgacctcgagatctacgtaacatgttttacaagtaaaactgattcttatactctacacttaaaagctccaggatcgatcaatcacacagttaataatggagatcgagattattgattagtgcgtgaatatttctctaggaccatgcaagtaaggaagcatcgaagcagtagttgacgcgaagttttgaaaattactcctccataagtcccattagatatatatgtgtgtgcctgactgactatgtaaaggcaacatcacgtagatgaaaaggggacagagctagagagacgggagctagcccactgtnattcgatcgtagacga

SEQ ID NO: 48832 - DNA, 781 bp, Oryza sativa
atcgagaattgacgaaagtgttaaaaatggaaacggggtgaactttgggtgctattaaaatgaacggtatctttcggtgctataaaaccaaaaacgttaactttcgatgctatataaccaatttgccttctcccaattaccaaaccaactcaagtttccaactatagaagtacctatgattaaatagcagtgactagtaagccagtggctagtgggctcggccagaattctatgcacatcattttatatacaggatcagaagtcagaaatgtataatgaatggcaatggcgctcttaaaacagaaaatagaaggcattccaaattgaaggggcaatttaaatgacaatgaaatgaacagatcccaaaattcctcgataaaagattaaaattcaacacctatttacacaacaagatcatgacaggacctggagttactcttatctccaaagagcacaacatagtgaaacaaacatcagcacaagaaatccaaaagtgttagaaaattcactatttgccataaaagattaacccaatcaacagaaccatgctttcaataaaaccagggataacatttctaaaaaaaaaaaatgctaaccaaaattgtttacttgccatgtgaaaaacgatcttaccctatttgccattgcccatcagttcatttttgtcttcccttaagtcaagggactattaaacatctttggaaaaagaactccttttctaccctcacaaacatagtgctgcctgtgaactcaatctctatctcctgtccatatctgcaga

SEQ ID NO: 48833 - DNA, 212 bp, Oryza sativa
cggctcaacggatgcagcaggtggcggtgcgacgggtgctgcaccgcagcaccggtggcgctcgtagtctcggcgtcattgcttagtgggattagtgaacactgaacagtaattagtatttttagttgttgggttgttaagcatggtttactggttgatggtggtcattgtactagtaggccttttggccactagtgctttattgggctagg

SEQ ID NO: 48834 - DNA, 1501 bp, Oryza sativa
ttacaatttagggtgaagtttatgttttcttaatggtttggatcacaaaaattgaaccatgataatatactaattaatgtttatcataatttcagtttctctcctagtaatgctgcaatatatttttcaccgggactttgctagtatattcatcatcataacttaaaaaagaggaatatatttttgtgcaactttggttgggtcgatggctccgcggtgcaatggaatgagaaaaacttttaaactttgcgtagatgtaatcttgtcatgatatattgatatgtgatcgaacacgggaatgaatcctgatgcgattaggtgtccatgaggactgatgaaggctggcgaccacacacgatagaacacacgagtttcggagtttgcaacggatccacgcacgctgaaaaggccaatcacaagaacggacaattagtccaacgtcgttttgacgttgcccatcgcgcgcgacgtgttcgcgagtaagacgacaggcacgcgcaatcgtgtgacccgttcacggggcatcccagctccaaagtcagcctacagacgaaaataaggatgattacatgctcatcttcaatttttataataagtaaagataaaaataaatctaaatctaacaaataaattagaatgaatgtctaagtaataccggtgtagcataagtttttgataactcatatttgaaaaacatggcaagaataatttaccggcattaatccgctaaatataactaaaacgtttggacctggcaaagttgtactgtagcattaaataaaagattgtattctcttccaacgtgccaatatatatttcactccaaaatataccattacaaaaatagaatattatacaaaagaaaataaaacatatatagcgcgaatgattcaagataatggagtcatcataatgtcaggtgtcaggtaatcggctagatctacccctggattgtgtacgctagtagttcctctttctatgtcataaatatataatcccttatctttaggtctcacataataaatacaatttctctttaatccaacatcttctgcattgagtgatgctgatactccagaatcagtactgtcaacaaaaaatgccatgttaccaattgtgctaactttcacccaaattcttctagataaatcgagcttgtgaacttcaatctgcgaaaccttttgagcacataacactggatgtttgtatgacaacataaacaagtctccacaagattctaagaagtaactagtataaatggaccaataacttggatttggtgcatcctcaaccggcgtagttctaaatgttggctttggcaagaactcaagtgccacaattgccttatcattacataaatatgtgtagaatctcccattaattgctgtgagtagcttcatcgttttaatgacgtcctaatggctttcacgagtgctaataatacttgattgatactcatgcttgaaccatgtatgtccttgaggatagcagtaccaaaata

SEQ ID NO: 48835 - DNA, 1501 bp, Oryza sativa
ttttgccagatgatgataaacataaattcaattaagcaaatcttaattctgcatgtcatcaggcaagaaaataaatcatcccaattgaaaattaatttaatttcttgtctgatgaaatgcagagttttgatgtgtttttgtacatatctgatgtcatttcctttttttaaaaaaagtttgcaagtaaacttcttatgattagtaatctatttcattgacttcattttatacctgttcttgattcatgtttgttcactttggtggtgtattccttgtgaattctttctgctattgctggatttgagtcatatatgcagaaacattaatattacattcagattgactttatgatttcatattagaacatattcatactatttaccattctgaaaatttcagtgatttgcccagttctaaaatgacagttacaatgatttgcccaatttacttacagtggtcagatttactttcagattgactctatttagttcatattagaacagattcatttttttaagatctaatcagtttctacatttctaacctcattaacttttctttacagatctgatcaaacaaattccaaaagaagaatcaaattctgaaaagaaccaagcaggtaatatttggagaatttttctgttcactcacctttgttcttcttggacttgtcttttgtgctctttctgctcttcgattcttctttttggagttctttggattgacctttagtaccagtttctttgatatatttgatattctttcctgacatttccttcttttctgaaccttgatcttttcctaagcctatctttctcttcttgatctctgctgaattcatcttgattttggattgatgttttgggggatctttctcttcctctagctccatctccctagtataatctggattgttgcagcgtgtgttgtgtgatctcttcggaaagaggtggtcctagttgtgatcccgatctgtaatagttagctgtcatcacgtgcccatcaacttggattgcaagctttctaaatatgtttgttctgtgggctctgtttgatcatgtgcctttgtctctgttttctagcgaccatttttagactttattttgggcttgtcaattttttttaagacagatgggcttttttggcctgtattggtctaaaaaaataaatctagacttttataatatgttattgtagcagtttttgtgagctattagatgtaaatcgtgtggtacagaaatctgactgaaataggacacaaaaaacatgcgactgcagtatagacagtccctaaacaatatattggaacccattgctgcggtggctataaatcggtagcccgactggctacaaatctgtagcccgcttttcttctctcttctcttctctacgtggagcttacaagtgacagatactatttaaatacctctaaatcgaggggggtgggtttacttattgaaactgaatagaaaaaggaaaaaaagaaaaccgcaccgaccga

SEQ ID NO: 48836 - DNA, 165 bp, Oryza sativa
ggggaggcgcggaccagatcgggctgttgagccagtcggggacgtgcttccgctgccccgacctcgccgaggccggcgagggcgggtcgccggggttcgcgctggcgccgtcggccatgggcggtggcggtggtggggtttaggcgtttgggaaggaatcaggga

SEQ ID NO: 48837 - DNA, 1070 bp, Oryza sativa
cgaacgttaacgtgaaatgcaatatatatatatatatatgtatatatatatatatgtatatatatatatatgtatatatatatatatgtatatgttacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagaccttgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattacacttagcatatacgcacgaaacacttagcatacatgactattttagtcttagcatgtaatattatttgagttttaatataagattactttatttgagattagacttagtatataattatttactacggaaatggtgcgacaagtagcaattgactattggtgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagactagcacgtaagtttgtgtagggttctaatgtacgacatttacacttagcatacatgacttagattgttaaaacataaatgtctcgtgacttagcagatgtttcttgtatcaacaga

SEQ ID NO: 48838 - DNA, 1051 bp, Oryza sativa
  unsure (1)..(1051): unsure at all n locations
ttttttaaataagacgaatggtcaaacatgtgaganaaagtcnncggcgtcatctattaaaaaacggaggtagtaataattaataagtaattaatcatgtgtgattaaaagttgaatttatagccattagaaaaaagtttaggaagcatgctaacgaaaaatgggtaatttgatgtttagaatgggcctcagagctaatctccgacacgaaaacaagaactatttttagcaagtgattaattaagcattaactactataagcttaaacaataaatttatttgattttctaaagaaacttttatatacattttataaagtaccatttaatggtaccgaaagcatgctaactgaaaacgaggaaagttgtttcaaattgctgaaaagaactcattctgagctcatcatctgctacctctagtagtccatcgtaggaaacttatgatttcttctggtttttgagacagaccctggtagatttctccaagcaaagtgtttttgttctatttggaattggattattgtatcacagatcttcttgctcaaagacgtggtataattctcccagcaacttgaaaatcttgcatattgctaaaaaaaaaaactgtccaaaaaactgcggagaatgcaacaattcaccatgttaagtatcggggaggtttaataagaaactactatcataaaagtaaaattgaaattttgaacgagacaactgtggagaatgcagcaatccatcagataacaaagaccacagaacaagtcaacagacaagataccgacgcaggagatcgcaaatttgtatataataataataaaccaaaattcaggtagtttgaaatgtgtcatccccctccctccgatggagagaagacaacaatggaataataatcgtatacagcagcaaagcaaccccaagaacatcggcacagctccaatactgtgtaccgcatgaacaatttgattaatcagctggtcctgagtcctgacaagcaagccgaccagataaaaattaacaggagactaataatattacattgtcaaccttcatccagc

SEQ ID NO: 48839 - DNA, 1501 bp, Oryza sativa
catcgtcaatttcttccacatttcaagaaatgtgtctatgaagagaggtctgtcatctgtggcacactttgaaagaaaatggcatgaactactgagtgcttataatcttgagcaaaactcatggttgaaaagcatatatgatttgcgagagagtgggcttctgtcttccgccatgattcaaagtttgtaatctgaaatatttaatctctgtaaaacgttaagagtttgcaaggattgtagtgcagatgctatgagctgtgatttgacatcttcttttgttgttcaaattgcaaagaaatcgagatccctttgtaatttgtacaatgtatgtaaaatacatttggcgtgttaagtgctctgaaatctgcattctgatggatgtgttaataaatgtgattatttatctgattccatagataaataaaatatggaatattgtgtaatccgaaatcttaaatgtctgaaatcgtatagtccagcattatgcatcaatttgatgctgtctggtgaattgataagtactccccaaaacgtttcggcactggaggctactggttataatacaaaagcgttttgaaccatagcttctatagccgccaaagcagggttgagtcgagctgacaaaggcacgcgagccgagcgcggaggatgggccgccacatatcgcacacggtgtggagagccgaggatagcgcaccattggatcatgcacttgtgcacgcgtcagatatgttggagcagggttgcagtcttgcagacgagagaaggttttttgcagccggtctccacccgccccagatcagaattttttttttctctttaatctggccatagtcggatagtccggcatccacggagcccacggggtatgcatgcgtatgcatggtaacagaacgtatgcacggcaaattaacaaatcccagtatgagttttgagttctggagtccgggacataattcttctggcaccacggcaagaagacggaaaggaagcgcgcgcgctgcggccgcccgtctccacatgtaggccgcgcccgcgccgtgtaaagccatgtgcgtgtgaccttgatggaggtgcgaggcgaggcgcggctgcgctgccgcgcgcgtagtactggtactgttctgcgtgccgctgccgccgaggccgagcgcgtccagattcaccctcacaaccacgtcccccgtcttgtcgaaacatgaattcggcaataataaaagggggtagcgcacgagacctaaaagtggatggatgtggagacaaaggatttagacaggttcaggccctctcaatgagaggtaataccctactcctgtttggggaattgaatccaccgggtgtttattgatctgacgatcagattgtcccatgccccctagagggcctcctgcccaccttatataggatggggggcaggattacaagatagaaaccttaaccaatacggtatcggtttcctaaatcaggactttaggccgttccgtaatatacaaggaaacgt

SEQ ID NO: 48840 - DNA, 1501 bp, Oryza sativa
aaacatgtcatatattaagtcatagagttctgccttcagatttggcaagaaaaagatatttagagtggcttcaggtaatcttatgcaagcgggctataatattgttattaatttcacttggaaagggtcctctatctgtccattgaaattcacagtgcatgtgttcagttcagtttttatctcttttctggaaagaataccacatatctctacttcagagagtgcaggctttggcagttatctttaagatgggacctgccatagccatagccttgatctcctctcttcaaatggatggtggatgaggtctgtttaatttgcttgtcttagattgtggttttacttatgttccttttgttatacagttctggtgaaattttttatctctagctgcatcatacatttcgatctttccaaatctatagattgtgattttatcaaaaggtgcttgtgctccagtgaaaccactagccattttgctggtacagtgatattagggccatacatgaattagggttttgttttttttgataaactttggtgatgaggttcagatatcttcatgttactgtattgaagctgcaatcatttctaaattttcggatctcaattctttttctgacgatagcagtttggactgtatacatgtcattttgctggtttcttttgctttaagggaatcagggcaggacagaaggaacactgtgaccatgtcccccatgtacgcatcaagctcccaagtgataatctgaatgcctgctcagatcctaggcgccggcggaatcaaccttgacccatcaatgatggtcatcccccattgacgatcacatggtccatagagaccatggtgtctgatttttgacggtttaagctttgtctacactttttctttctcagcatttgcttctgatggtttatactttagagttgggtattggatgttcattctctagatgaattggtcatgtacttgaaattttgcacatttggtactgaatctgcactcgaagtgggtttcctaatttggttaggtacattgtataagctagattcgcattttgtacaattgattaaagaatatggtttgtctatctgcgtagcttcaaatgaatgatgtttaatgctattctatttgtaaatttacaaagcaatatatttgattgaattaattttagccttttcgtgcattgcacgtgcatggttactagtcttcttaaaatgtcagaggtgctttgcaaacagatctcgcttcattgatccaacgaccaaaacgtacagccacagctaaagttgcagaggtagtaacgactacacaggatctcaatccgttgtagccttgtaggggccttcttgctgatgtgtatagacaaaataaccggagttggttgtaagcaacacacagaagcgtccaatccggcgctcaaagagttctatggagaatcaccacagttctatggtgttgctgctgtgcatggatttaaatgatgcagacgagcgccct

SEQ ID NO: 48841 - DNA, 229 bp, Oryza sativa
ggcaacttcgtccttgtcagtaagcatgcctcccggactattaaattttgtgtaaaaattttctatacaaaagctttttttaacaaaaatcaaataaatctatttttttaggtttacagtaaaacaatactcgtcaatcatgcgttaatagtttatctcatttcgcgtgtcgtcaaaaatcccaaacgaactcagcctaggtttattttggagttgggttttttctagc

SEQ ID NO: 48842 - DNA, 1501 bp, Oryza sativa
ctgatggacattgtttggtttcactgtctaatagtgttaaatcctccctatatatctgaatagttcatctgtctcttacgggaaaaaatgcatgctttcttgcggttccatctatacagtattgaggtaatttgaaattatggataatacatttcatatgtggatgtttgtcagtacatgttgatgccattgttataaatctgtctttttctgctacagcatacactccttggatatgtttgtgtgtttccatgtgcactgttttttttaatctcatttcagtttacaattgattattttggttcctctgaatcgtctagggataaattgattgagcagcttcaaagcagacgcctccctccgcatctccgttccgctctctccccttcgaccacctccaccaccatcgcacgccgcatcgcctctccaatctctccccggtggctgcgaatcaatcccagctggataacactcatccctcatgccatctacctctccagtataatatacttctaggtaagttctgctgaatgcatattctgccatgttttatcttcatgataacaattattatatgttgatgcatcacgtaaagttgaaagtcatcctaatagaataaatatatgagaagttacctgaatgacaactcagagggtaaagctgtattttttacatgatgtcgcatgcactatatttgacacagtagatcaacaacaattaaactacactgtatcaaaatgacaaagtaagatggttagtccaactataatccatcctcacttaaaagattaaccttttttgaatagtgctttcaatattattcaatgttagtaatgaacacttttcagctaacatgatgcatactggacaagtgaaaaaaatatttttgaagggctactaaagcacacttttttggcaaaatggcatgactctgtttcaaaaagtatatttggttgcttctagaagtaataatttatatatagttttgttcctataactgtttaggatcaactaattttgttccaccactgatttgatctcaaattggttcatttcttccaattccataaggcacatgttgggtggttattgacagccataacattagatatagtgtgttttagtgctgcaatctacattaatatgttcatgtcattttgtatatcctcagttctctattgcctctctcagacagaatatgatgaatttcatcctatttcataatctatttattacaagaacaagatgagcaagcagctaatcattttgttaaaatagagatgcagagattctttattgtttgcatggatatgaattgaacgagggtaatattaatatcttattgatgttccaaaaaatgtagtgcgcaattgtcgtacaaatgaatacattttttgatatgaggcggcatggtgtggaggcgtaggtcaacatgtacaaatagtctgcccactatatgtttgttatagtgttttgccttgataagaatttttgactatgc

SEQ ID NO: 48843 - DNA, 1501 bp, Oryza sativa
tatatacttaaatcgatcggttgagtatgtacttctttcttgcttgctcagtatatactgcatatactagggactactacttgtttgttcgatcagtatctgcatatatatattttttttgtcagtatatatactgcatatactacttcttgttattcgatcagtatcttcaaggaaaccggtatgtccggtatatactgatccctgattagtttcagcatatacttttttatggaggatccggtatatactagaatactagatgtacaagtacatacaatttttaaactgcagtagcagtatacgtatgtactctttttttaaaacttagtaacagtatatacctttttttaacttagtaccagtatatactttctaataccagtatatattttttatgagtatatatatattgttctttagtgcagtatatacccttttttttaacttagcaccggtatacactttctcataccaagtatatattttttatgggtatatgctgttctttagagcattatattgctaatacctttcattgagagtatggtatatggcattttttccatgaatagaatatgtacttttttccaagtaaaatagcacataccattttttcttagagaagagtgtgtacatttgggacgtgtcgggttgctaactatgaataaattgtatcattcaatgatatagaagtgttaccgtaccaaagattcacagactggatcactggtaaagtatcgggttgttgcattatgaataaaaaaaataccctagaagggcactgaattctgaatggacagaccaaagaagaaaaacaatgcaagactttcggaaaccaaaacatgcatggagactaaaaaaacataacgggatcaccctcgatgtaagtctcatcgaagaatctctgcatccccgctaacagatcggttagcatcaatgggatcacgccgaccgcgtgccagagaaggggccaagaatgtgtcttccttgatcaacaccgtcaactaggaatcacgggttcgatgccaacgctgatgcagtcgccgcacgtccgcacatgctggactgttctgtggttagcaccatccatgtccacgatacatgcatctcgtatctgcattcaccaaacaaattcgtttctttagatgctttatcattcgatcagcgtcaggtcggggactgcatgcatgtctgcatcctcttctgctattaagagagataaatctaataggaaaatgaaagagtatacatgcatgcattatcgatctgcaagaaaaagcaaattaagaaaatcggaagaaagaagaacttgccagcatcgtcgatgttgcagttctggacggcgctcatcgtcatcttgatcgttgcacgggcctggatcgatgccgtcgccgcacggacacacaggcttgccaatgcccgaagaataacggcgccgttgtttggtcaccagcgcttcgcccagccaatcgcccggggacagccataccggaggcac

SEQ ID NO: 48844 - DNA, 1501 bp, Oryza sativa
gcgcgcgtaaatgggccgctttgggccgtccggcccgtttagctcggccggaccgagccgaatacctttgggccgcgccctagccgcccgaggaaagtctagattccctcccttcatcatttccttttcctttttccaaaaaggatttaattaaatcctttttcctttagaccaaaaatccaataatcttagaaattcaatatctttccaaccataactccgtttgactccgttcaacttccaaaatttcccaaatctcgagatctatctaatggcacgcttaggggtcattaatagggctttattctcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatattgcttgcaaaatattatgcattgataggatcacacttaatctgttgtcccgtctgcaaggcagattggcagacctacctaatttgtcgcatttgatccttccattgttaattgctatgccatgtccccttgtaaccacccagttgcgcctcgatactcgtgcactctgtgcgagtatcgacggtcgccttcaaacttaaaatctgagtaacaacttgggtaaaactggagttttacaaaagacttggaaaacccgacacttgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggcaaacctgcatcggctttcgaaatgccttgtcatgaaagcttggaggtctcccgacgtggctgatccccacgggctgggtgacccgggttagtaatgacgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaatcgggttcgatgtttgaaaagaatccgcagctgacgggatcagctaggcccgggtggccgtttaaaaagttgttggcccgggtggccgtttgaaaaggtgttggcccgggtggccgtttaaaaggcctttggccgggtgccaatcttgttcaaatctaaagactgatacattgcacatactccgaccggacgagacgcactgcctcatccgtgtcgtttgagaagcactcacttagttgctttt

SEQ ID NO: 48845 - DNA, 215 bp, Oryza sativa
ctcgtgcgctagtctcacgaagtggcaaacatggtccgcggtctcacgcttcagtagcgcgaaggagtttggagcgggaggtggagaacagtggtcccatggtctcggggatggcaacgcaacacagcctcactccacactggcatgatagggcagcgatttcgctgcgtagacacgtgagatcggtggcggtgtcgcgcagtgggccagcgaga

SEQ ID NO: 48846 - DNA, 1501 bp, Oryza sativa
caatacctgcataaaacatagttaataatacatcaaacatagtggtagggtttaattctaacatttttcgtgtatatttggatgcaggtgataaaccaccaaagttgggaggaaatttagacttaagtgaagaagaattctatccatacaagagctgggctcctaaactccatcaaaacatcagaacatgggcccaactaccgaataaatggataaggcagagcagcgaggaggcccagaccaaatctgggggcccagcccaggttcggctgaaccctggtgatcaccgttgaatccaggttttgtaatggacgttctagatggtctcctgatggtggttgtagggcaattcctacaattcacatagttataaccaccattacctgcctataaattgagctcccattctcacttcacccacacactccaagcttgagctgaattataagaggttttattgtacttttttgtatactagaattagggagagagtatagtagaagaagtcggaggaattctggagttgtcggtaatcatcttcttatttattttactttgttaattactcatctttaatataattatcattctgagtaattaagatttgctcggtgagaattaactcttggttagttcctaattagcgtgcgggatcttgttccctgtaatccagtaaaatatattgattgctttagtgtttagctagctctaggtaattaattcccggtaattgctccgtctcccgcagtaggtttgaggtgaatgtaggggtggtgacaattctcaattataagcctagtgggcctttgtagcctggtccacgtgctcgccagaaccgcttgttcatatgcgtcctgttcgccggttttcaccaaaaaccgcccggttcatccggttgtgactggttcgatggcatatccggtccttacagcaaaccgaaccggctgaggggctggttccgattttttccggttcaaccgttgggctggtccgtttttttttactagggttgcaacttaagttaaggtagataagtcatttatttaatttaaggattgcaatggttcattattgtcaccgtcggtaccagcactatgtactgggactgctaccgatatcgcggtttcgtaggaagcggtttacaccgttttttttacgacacggtcccgttaggtgccgttgtatggtagtgctggattggggtgtgacaggatgtctatgcaaacttttggttcaaaaaaaaaatgttggttatctgatctgatggcgtcgattgttatgtttctaatacggagggagtagtagagatactagagaagagatgtagtacaatatcggtagagagctgagcatcaggtcggaataaggagcgcggtcggactggtgttatggtgttttgtggcagcgcgcgtacgcgaaccccacgcggttacggcgagttcgaatctgattcgattattcagtcgagttggaatctaattcacagcgcaaaacacgagcc

SEQ ID NO: 48847 - DNA, 205 bp, Oryza sativa
atgtgagaaaaagtcaacggcgtcatctattaaaaaacggatggagtataaattttaaaaaatgggttcatttttctttaatttttaaagaaacttttttttagaaaatactaatttctttgctccggtttttatgccccttaacgattttgctaaacatctcccgcgtgatttttttcctggcatttgacgtttttttgccaca

SEQ ID NO: 48848 - DNA, 1501 bp, Oryza sativa
ccaataccgagcccgttttgatttttgtttccaaaaaaaagaaatcctcacgatcttaattattccgcactagccggaagcccggaaccctttcgaattgctcgtattaatatctcgtgggtggttctaaacagaatcgatagatcgatctgcaggttatatcgcgatcggacgattcggaggtgacggcggcacgacccatcggcgattcggaggcgccggcgtcttccattactggtgcctccggtatggctgtccccgggcgattggctgggcgaagcgctggtgaccaaacaacggcgccgttattcttcgggcattggcaagcctgtgtgtccgtgcggcgacggcatcgatccaggcccgtgcaacgatcaagatgacgatgagcgccgtccagaactgcaacatcgacgatgctggcaagttcttctttcttccgattttcttaatttgctttttcttgcagatcgataatgcatgcatgtatactctttcattttcctattagatttatctctcttaatagcagaagaggatgcagacatgcatgcagtccccgacctgacgctgatcgaatgataaagcatctaaagaaacgaatttgtttggtgaatgcagatacgagatgcatgtatcgtggacatggatggtgctaaccacagaacagtccagcatgtgcggacgtgcggcgactgcatcagcgttggcatcgaacccgtgattcctagttgacggtgttgatcaaggaagacacattcttggccccttctctggcacgcggtcggcgtgatcccattgatgctaaccgatctgttagcggggatgcagagattcttcgatgagacttacatcgagggtgatcccgttatgtttttttagtctccatgcatgttttggtttccgaaagtcttgcattgtttttcttctttggtctgtccattcagaattcagtgcccttctagggtattttttttattcataatgcaacaacccgatactttaccagtgatccagtctgtgaatctttggtacggtaacacttctatatcattgaatgatacaatttattcatagttagcaacccgacacgtcccaaatgtacacactcttctctaagaaaaaatggtatgtgctattttacttggaaaaaagtacatattctattcatggaaaaaatgccatataccatactctcaatgaaaggtattagcaatataatgctctaaagaacagcatatacccataaaaaatatatacttggtatgagaaagtgtataccggtgctaagttaaaaaaaagggtatatactgcactaaagaacaatatatatatactcataaaaaatatatactggtattagaaagtatatactggtactaagttaaaaaaaggtatatactgttactaagttttaaaaaaagagtacatacgtatactgctactgcagtttaaaaattgtatgtacttgtacatctagtattctagtatataccggatc

SEQ ID NO: 48849 - DNA, 1501 bp, Oryza sativa
gtagaaaacctcttagcacataattaattgagttttattattaaaaaaaattaagaaaaaatatctagtattttatatcaacttgtatatagaaagttttaaaaacacgctaacaaaaatcgagatagaaggaacggagccatggtgtgaagtttcacgccatgcacatattcaattttcatgtatttttaaaaaataccggttggttcacgtgtttatactgatttttttatataatataataatctttatttttcgaattaaaaactggtgcactataagatttcagaatcactaaaagtctgttaaagaaagaggtgcagaacttttgatttttcagccatcggatgtgcatgatccgtgctagtggttgagagaaaaaaaaatacgcgcaaatatgatttgggacgagggagggaaagtagacttattctagggcctaggtcaacatatatttatattgatttttgtgaatataatttaattgtttttaattttcgaattaaaaactgataagataaaatttcataatcaataaaaatctgttgaaaaaagagaaataaaatcgaaggcaaatataatttgatgtgggggaggcaaagtagacttattttaagagaggcctatacagtgcaagtaataatacacatgtaagagatattacggtatatagattgaaaccgagaggagcggtggctggcctgtgctgctgtgctgcctgtctattttataagaaggctcgtgttttgcgctgtgaattagattccaactcgactgaataatcgaatcagattcgaactcgccgtaaccgcgtggggttcgcgtacgcgcgctgccacaaaacaccataacaccagtccgaccgcgctccttattccgacctgatgctcagctctctaccgatattgtactacatctcttctctagtatctctactactccctccgtattagaaacataacaatcgacgccatcagatcagataaccaacattttttttttgaaccaaaagtttgcatagacatcctgtcacaccccaatccagcactaccatacaacggcacctaacgggaccgtgtcgtaaaaaaaacggtgtaaaccgcttcctacgaaaccgcgatatcggtagcagtcccagtacatagtgctggtaccgacggtgacaataatgaaccattgcaatccttaaattaaataaatgacttatctaccttaacttaagttgcaaccctagtaaaaaaaaacggaccagcccaacggttgaaccggaaaaaatcggaaccagcccctcagccggttcggtttgctgtaaggaccggatatgccatcgaaccagtcacaaccggatgaaccgggcggtttttggtgaaaaccggcgaacaggacgcatatgaacaagcggttctggcgagcacgtggaccaggctacaaaggcccactaggcttataattgagaattgtcaccacccctacattcacctcaaacctactgcgggagacg

SEQ ID NO: 48850 - DNA, 1501 bp, Oryza sativa
atttgggtttaggtgatgcaagctgattccatagaagttcaagatcccgcggaaaaatttcgaggtcggaagagcgaagccgccatagaagaaatgcgagaagactacgatctcatgtgtatcaggggttggaaaagcctcaccgcacgctggccgccacccgatgatctccttggcagggagaacgccgtgcgccaccatctccttcaggttttcttccgtcatgtcggacggcacccattggctttcgaagctttctctctcttccgccatcgatttttctcaaatgtgctgatctgattcgagggatggcttgggagaaatgagggattaaggcggtggatcacgggaaggattttggtgcacttttcgaaggtggatttgagtggaatggtgaaccctagttcgccggcgcagtgctgcactgtagcaaggagtggggaaaatggtgagagttccggcggggaagacgaagcgtcgcttggatctcgggatttcttgttaagggtatcggaggtgcaaatgggcctaagcctgaacagtacttcagcccaatacttttaacagcgtggcccattgtgttccttagggacttaggcatattttgctttggcaatattatgcgcgcaatagtgttgcccaatgctgataaaatcctttttatgcggtcatataattctttggaattattgcaatgcaaattaaaaggtgcccgacagaaaggtgttatactgctttttgttagctttattaggctacaaaagctgtctgggttaatttggaatgacttgtttttatcatagtcacttccttggtatgttatttacctattttcattatggtaaatagtcatagcctaggctattagacttattcattaccataatttttataatatttggtgggtaatctttagagttttatattcggatgcctgtccagtatgttcattcgtgaaccttttagagtgtaaaccactcggactcatatggctagaaagcagtcggcaagaatgtctctttaggcgccgcgtatgcttttgtcatatgatgcatgattgtgctgttattttgttctcaactatatgtttagtttgttaactaatcacatagttgggggctacacctaattaggtgcatctattcgatgcaccatattctttatcttttcgccctttacagtcttcgtcttcgctactcggcgggccttggcatgaaaagtttgaagcactcggattatttttgagatggctacgatggttgactgcaaaggtctcgggggctactgtggagattatggatatcccatatctacacggcgatagtatttggactgggtacaggatacctaatgtagatagaatatcttatttgtatctcgggtttgtttcttaacttgtgtatcaaggaaacaccctgagacttagtcggtcacgactgtgttttatctgtatcttcctattccgttagggatatagattatcttttgtaatacggactcc

SEQ ID NO: 48851 - DNA, 1501 bp, Oryza sativa
taccttgagcatattgtgacttgttgccttctgcattcatgctggtttggactatttgagacaatatttaccatattcgatgctttttggtaattattgaattttggaatattcttcccaaattttttaacgtcttctcttgaaggaaatgatatgacgacagaccttcgtaaccttatttatattttcaacagatatgtggtagcttcacaaatctacgtatatggatatataattatattgataatatttgaatgaatcattttgctctttactacttttaaaagaaatataaaattttaaatgactctaatttaacttattaggtttaaagacctgtttggtagagcttcaactcctaaatttattatagaagttgagtcaagagtgaagttgtgaaacaacttaaatctagctcaaactctatagtttgttttgtaagaacgttccacctattttcaatcttattttaggtggaggttaaattatttggctgaactccaactctagaagaggtggagttgaaggttaaccactgccagacctctaaatcaatgtgcatctgaaatagcagaacctgtaaacaggttccaaaaggaggtccgtaaacatggttaacgtccgcgcagcccaatattaattgatccggaacgggattcgcatttgcattacgtgtaagttgggccgggcttggtcaggatgaccgatacgggcctagatgggcctgctgctgctgctgcctgctccccactccgctgcctctgcggcgggcggcggtcctcctcctccgcgccggcgtccaccgcccggccgccggcaggccagtcccccgtccgtctcctccattgaaaaccggaacccaggttggaaggagagagagagagagagagagagccagcaggcaagaggaagttgcccggaaattttcggtaagctctgctctccgctccctttctgcccatgccctcttcctgttcgtgcttatgtctgcttgaatttagtagtgctataattatactgtactagtgtactggttctaataaacctttggagagagttcctcttgctcactgatgcttactagtcagtctagtccatagatttgctaggaagctcccaagaaagaagggagccggatcggtaaagaatgcagtattcgcttggatctacccgtttaattaggtagtctattccatcactataagcccactaagtggggcttgtcacgacctcacgacacatcacaccactcagttcttggtcaatgatcggcaaaacagaagaaatttcatcctggagtcgctttcgtcggttgggctagtgttgactccagagaaaaaatacaattcatgcccagattactactccaattccagtccagctccttatctttcgttttattgctgaattgccagctacaagatttcctagcagctacttcaatacttttgctaacccccgttctcaattctcaccgtctctcctaccatggccttggctt

SEQ ID NO: 48852 - DNA, 1501 bp, Oryza sativa
catgcacacgtacgcaccgtgaagctgagggaggccggtgttacatacggcgccttatacccaattattgttaattactagtactagcttttattttttttcacacagaaaggaaaaaagaaaaggcagatatatagctggagtaattagctagggcaatggaagacgggttcctctgcttcggcgccgccatgatggtgtcgtactgcgccgcctggctcgtcgacctcgcgctcatcggctcccaggcggccgccgacgaggaggccgcgaggttcatggacgacgtcgccggcgagctccgccgccgcggcggcgtcggggaggacgaggacgagggcgaggtcgagatggccatcgccaagcagatggccatcctcaaccaggtcttggactgatcatgtaaggtacgtagccactgcaccccctatcgagtttagatcgatcgaggattgattaagcgagataatataccaactttttcttcgatcaagtttgatcctctttttccgttttatcgtattatatttcgtttcgactattttaccaatcaaactttgttaggttttattgccttttctcctataatctcaaactttgttaagtatgatcaagtttataaaaaaataataacatctaaatactaaattagtcttattaatatgatattgaatatattttatatttttctacaagcttctttaaacttaaaagaaattcgattagaaaaatatcaaaactatttatactagtataaaacagaaggagcacatatatatcctttagtaatttcttcttttaatttactccctgacatgatgttttattctcttcggttaatttgattgtgtcacagctcggtgtatacgacgcctacacacatgctaaaaaggactactacgtgagattcgaagaccatcaatcctttacttttccactcgaagttgttcagttcaatacagattcatcgtttttgattattagttcagttaaattgtttagctttggattgctccaaaaaaaaagaccatctcgtgtgtaaacttagtttttcattcatttcatatgaatattacccggttgggttcatgaagttttactgtgacaatggtacagagtatagtctgaacctgcatccttacggtgttcactgcatcgaaattaaaaattaataaattaaagccacaatatttattccatcatccatggctctgtttaaaacttcatttagtttttgcaactccctcgtttattgtgcttcctaaactatgaacgtgcgtctaaagaaagtaacttttcaagttgacgaacttaaaatatctcaagatatatatagctctctcgttatgttaagattgacgaagtcaacatcgaaaaaaattagccgtgcataaatgtacccataccaacctaaatctatgacttgaaacattcaactcgcgggcttgaagatcctgcaggtgacgggagtcccagtgagagcgaaacaacggtgtgtgtg

SEQ ID NO: 48853 - DNA, 1501 bp, Oryza sativa
gcttaaatattgaaaacgcttccatcatccgtaataacgaaaccaaaacagggtaaaaaaattaaaacaaaaaagaataaaatagtatcttacgattgaatttacttccgtcgtctgtgaaaatatcatcttatcttaatctcaatcttttcgaggggaccgagcggcgccctccgtccccgcccgcgcgatgaaacgccggccaaagttaaaaaaaaagaaattgagcaaagggataaactagattgaagttcccaaaattaaattgaatttacttccgtcgtctgtgaaaatatcatcttatcttaatctcaatcttttcgacgggaccgagcggcgccctccgtccccgcccgcgtgatgaaacgccggccaaagcaaaaaaaaaaaaaataaattgagcaaagggataaactagattgaagttcccaaaattaaaagtggataaacgatattgaaactcgcataactcgaaaagagggaataaaatagattgaaatttcccgacaaaattccccaaattcgaagaaacctaatttcgggtaagaaccctaagagtcaaaaatccaaatcaattaagctaagggttcgggttacttaccgcacttgaagtcccaaagctcaccggagttttccgggaagtggcaccgccgcaccttcacctcctcgcagtcacattgggttccttgtgcatgcgttgtcctggagcacccctccaccatcccttgccgaagacgggaagcgtcggcttggcgtcgcccctcccgccgagagctccatgccgctcggcgctcatcgccgtttgcgcgcccgcctagccggaccaccgacgccgtggcacggctttgtgccgccctcggttgcgtcccccagccggcgaagcaggagctgctcgacgggcgtcaccacacgcgcacaccagctcgccggaccgccttcgccgtcgttccgctcgctcatcgccgaagagaaatgtgatcgagaaagagggatttgggagctagggttttgctcctctctcctggtcggcacttcatccggcaaggggacgatcagagccgtccatattagatcggacggttcagatttacccagcgttgggtcaccgccgccgcagcagattacgctgcgcccaatgggccgcggaagtgcatcagaccatccccgcatatgtgctgcggtcagctgctcagcttgcgggccgtcgaactgactcggctcgccgaagatgggccagcccaagtttgggccggcttgggaagacctgggccgaaagtatatttgatcaaacaatatggctcagatattttaaattaaactccgtcggataaactcctaagtaggctcgaaaaataaaatctaaaactaaatcctaaatcctatgctaattcattaaattagactcggttctacctatttgttaatatagatttgaggttttcaaggtgtcacattatcaaacagtgtttttcccgttgcaacgcacgtgcactattgctaa

SEQ ID NO: 48854 - DNA, 1501 bp, Oryza sativa
aagacataatccgtctttcttgtatgccttcctcatcacctaataagtaataaccccccccccccccacccccatcaccgaactagccctcatactgcatgtccgttgtaagtccacacctcacactatcacgtcaccacaatcgttgtaagttcgcaactcacgccaccacaatgtcaagatatgtcaatggtgatctaatcggatatgctggcacaatatctcggaggtgtgtatatggataatactggataaagtacatgtgcacgcgtgtgtatgtgtgagcgtccgcgtttaatctgaaatcatgtcaaacggtacctaaatttttagaccctttgtttcttgggcaagggaaacataagtagagggccccttagaatcgtaggaatgaaaaaacagaggaatatgaaaaacatatgattttgacaagaatataagcgtaaaacagagaattgtaaaacacaaaaaaaacataggaatgatcgtttgattggaccaaaagaaaaacacaggaatcggatgagagagatagactcaaaaggattcttagggcccctttgaatcaaaggaattatgaaggaatttcataggattgaaatcctatacgaaattttcctatgtagccctttgattcaaaggattgaacttttcctattcctataaaattcctatggaatggtttattgcatataggttttggaggaaatttagcaagaggtctaacctcttggtaaaaatcctttgagtctatctctctcatccgattcctgtgttttttctgtggtccaatcaaatgatcattcctatgttttttctgtgtttcgcaatcctctgttttacacttacattcctgccagaatcctatgtttttcctattcctccgttttttcattcctacgatttgggcccctttaattcaaaggaaattcataggaattttattcctgtaggaatttttcctacaaagccctttgaataaaggaatgaaccctatggaatcctataaaattcctatgagatgcctgatcttcctatataagttttggaggaattttaacaagaggtagaacctcatagaagagtctttatctctcctcaaattcctgtgtttttcctgtggtccaatcaaacggtcattcctatgcttttcctgtgttttgcaatcctctgttttacacttgcattcctgtcagaatcctatgtttttcctattcctccgttttttcatttctgtgattcaaggaggcccttaccaagaggttggacctccggctaagtttcctccaaaacctatatgcaataagccattccataggaattttgtaagatttggaaaacttcaatcctttaaatcaaaggactacgttggaaaatttcctacaggatttcaattctatgaaattccttcataattcttttgatttaaagggccctctagtatttactttagggtttgttacctaattccatgagtcgtacatacgtacatcctacgggt

SEQ ID NO: 48855 - DNA, 500 bp, Oryza sativa
  unsure (1)..(500): unsure at all n locations
ctctcccatttccccctcctccccgagcccgcggcgccttttcccgctctcaccgcgcgagccccagctccgccgctcctcggcgaactccagccacgccgcgccgccgctcccgttcaccccgcactgcgccgtcgccctccccggcaccgcagcagccgtgcgcaccccgtccaccgctccattttccctctccaccttcgaagcgccgcagccacgcgcaccacctnttttcgccgccaccgccggctccagccgcctcttctcgccgcttcagccaccgccgtgccgtgccgtcgccaccgtcggcatctgcgcgccgagctccaccccgtnctacacctctttttcccaatctcccaccaaaattccacctncactggtcacccgagccgccttaactataccgnctccagccgncgtctntcgtcgntctagccgtcgccgcgccgcgtcgccgcgctccaccgcaccctggctgccgctccattccgtccaga

SEQ ID NO: 48856 - DNA, 1501 bp, Oryza sativa
tgggccggcggcccaaaaggaagaaaagaggggaaaaaaagaaaaagggaaaaaggaaaataaaaggatttctagggattctttaatgcttgtgctctattttaattggttaaaattatttccaaggctctgaaaattccactaaaaatcccgttagcttattttgacatgtagaatccaagaaaaattccacatgccgattccgattatcatttgcatttattaatttgaggaattagctctaggttaaattgaacaatttcttcggacgatttattttacaaattttaaagctggaaaagggaacttcagggcgtgacacagtgcaatcctatcggtgcataaatattttgcaagcaacataattaagttcaaatattggctcaatatgttcaaaagtggcttgccttgctcaaggacttgagcttcacaaatcttcaagaaattcacgcttgaagaaaatccggtaaccgcaacttggagctgaggtggcggtgcgggcggaggggggcatccgcggcgacgcggccggaggggaggtacagctcccctccctctcctatcccgcagctctactctccctctgcgctcggcctcgacaacgacgatgccgccgccgccttgatccgaggaggggaggagggcaccatcagctggaggggaggccagcggcgccgccggtgggttggggtggtggtggcggatttatttattcgctaaaaatattttcgcaggcgggtggttctacctaatgattttcgcaggcggtccgccgggccgcctgcgaaaattatctattttcacatgcctttacgtgcagacggtctcttccccgcttggaaaaaaactatttttggccgcctcgaaaaactatttttctaagtagtgcggattgtatgtacaatctatcacacctagaaaattgcataagtaagtattttatttaatactgttgtgcccgttagagatatgggattgtttatgaccatgactgatggttaacgacccgtcacaaataactactcatctatgatggtgttgtcaatgggtatttgtttaaccgatagaagtaacgttatctgtgacgggtcacaatcatccgtcgatgatgtgtcatcacggataaacagttacgcagaagtgttttttttttttagataatgagttacgcagaagtgtatcttaaacgtcgcccgtatgtataagatcattgatcatggagtgtctctataactattgctataagaaatttgcgtaatgacaaattgtatgtacaactctcattaattctatcgtttggcagtacgccagtaccttatcagtccaacaaattaaatgttctccgtcttttaacgctttgataatccacttccctgttcctagattacgttctgatctttatcccataataacaaaaggcttgtcgaaactagatttcggcaataataaaagggggtggctatcaagctaggaaagtgtatgggtttgaagacaaaaggat

SEQ ID NO: 48857 - DNA, 1501 bp, Oryza sativa
aacgcggcgatgatgacgtcgtcggtaatgtcggagatcttgttacgttgttcagaaaatcgccggatgtaatctcgaagggattctccggacttctgaatgacgttgtagagatcatattgtgtgccgggacgctcgaaggtgccttggaagttggcgatgaagtggtcgcgtagttcggcccaagatccaattgtaccgcggggcaatccatggagccaagatcgggcggaatccgctaaagccactggtaaatagttcgccatggccttgttatctcctcctgctgcgcggattgcgagaccgtagacggtaagccacgattcggggttagtggtgccgtcatacttctctattccagtcggtttgaagccggctggccaatccactcgacgcaggtcgtcggtgaaggctgctactccgtcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaggtcgggaggtgagtgaacagaccgctcgtcgtgacccctgctcctgcggttggatcctgcgccggtgatgctgaggcttggatgacggtagtcatgagatcggaagtggggaactcggctgccagtcggcgtgtggacgctttcggagttaactgggaccgaggccgcaatcatggtcttcgtctggttcaagatgttgacgacgtggtcggatcgattgagctcgttttggttgaggagggtgtcgagaagggtgatcgcggcaaccgcattctgttgaggggtgcggaaaaccggtgtcccttcgacgtcttgttggccgatgagatcacgcgctcggcgccctgcttccaaagctcgctgacgtcgatcctcagcctccttcgcggtccgctcacggtcctgctgctcacgccgtagccgttcttgttcttgtgcttgatgctcctcctccagtcggtgacgttcttcggtctcccgggcttggcgttgctcctccgtctcattattggccatgaaaacgccaaagtagagaggagtgtagttgtcatctaggcttccgtcgaagtcgtcgaagtcgttgaagtcgttgtagcgagaactaaattcgtcgtactccacgatgtcagtaggacgtgagtcgatggtgggagagctgttgtagtcatccagttgatccgtcgaaaccgtgccgagtggttggaggatgacgccgacttccctgaagctaggcgaaatcggtgttgaagccgacttccgcctaggcctacgggatgaagacgctgtggtagtggagacggccgctaaatcgtcggggagcttcatcaggactggtgggtaagccccatcatcttgatctggtgttgttggagaagatgcgatctcggccgagtggtttgaagccgactcggttgagatggtcttgaagtagctttcagccg

SEQ ID NO: 48858 - DNA, 1501 bp, Oryza sativa
ttgaccgatataattttaccttttactatcaataaattttgttacttaatgtggagtagttttactccatccgtttcaaaatgtttgacatcgttgactttttaagtacttatttgaccattcgtcttattcaaaaaatttaagtaattattaattcttttcctatcattttattcattgttaaatataataaaacgaacggttaactatatgctaaaaagtcaacggtgtcaaacatttcgaaacggagggagtagtatttaatcttctatcgttttggcctatagctgataagttgttttacatgtaatttatggagaaccttttatatgttatatgtgtcgacgggtgatacccgtagaccggatatagagggtattggggtacgttggtacaaggatacgtagtacgacatcaagcaaacaaaagacaagaattatactggttcaggccctttgataggtaatagctctaatccagttgatgtgggattatatggtagaaaacacaggttacaaagagaacaagggaacttgtcggatccggcgagattgtagtcgagttgattcgactagctctcgatgacttggctcctcgtaagctccggcttcataggctgtggaggttgtgttggctctaagattcgatgtctaaaccccccccgggggccccttttatatcacagatgtggaggtctcctcatagaactcggaggtatcagaccctatacgatacgccaacgacccagttctacccgagtaggattcttcccatctatagattccgtgaaaggtttccttagaatatacaggaaatatccgcatgcgcgtgggtatgccatatcgatatgtaacgtatatcgaagggcaaagggtatgcctaacccgtaaccctgacagtagcccccgacttctgcttaaaatgaactcgtgcaaccatttgcgacttcgggtgtcgagactgttgtcattcccggtgcgagaaccgcggagatagaccgtagtcgagcacaccatttgaagctcaacggtcacgagcgaattttaaactgaagtccaaaaaaccgccgcgcgtaacgggaccagaaatttccggcggacatctctctctgttccctggaattcgcaccgtcggtagtgcgcctatttaaaggaattttgggagtccatcttgaagtccgccaaacctgttaaacacacaccacctccaagcactctttgccttctctgccgccgcaagaaaccctagttcatcaacctaggctcgcttttcggcgaccttctatcggcaatggacctcggcaaatcagcttccactagtgcaacgttgaagaaactccaggaggatggcgctcttcctggccatggaaccatggagagggaagcaggaggtactaatcctcagcccatattgggtcgcatggttgcgatcgaagattatgttctctgcggttttctccctccaccttccaaatttcttctcctggttttgaatttctatg

SEQ ID NO: 48859 - DNA, 1501 bp, Oryza sativa
gaaaaaaataatttccaaaaaaatgcgcgggaaaaatacggtttccttcgtctgaaaaaaacaaaaaaaatgctattaaaaactatcagaaagaaatacaccatttctaaaaaaaatggtttcaaaaaaccacaaaagaaaaaaaactgtttataaaaaaaagccgctctgaaaaaactaaccgatgaaacactgtttataaaataacagataaaaaaacaaaacgactcaacacgcgaaaaaaaccgctgttttaaaataaggttcgagaaaaccgtccgacttaatgcgagaaaaaaaccatcatttcaaaaaaaaaatagaggaaaccatccaactcaatgcgagaaaaaaaaaagccgccgtttataaaaagaaccactccgagaaaccgtccgactcaaagcgagataaaattgatggacgcttgggtcggataagatccatcgatttttttccatctcctacacatcatttcctacacatcatttgttttctcatctaatccctgcactttttgtatacaataatcattatcagactttttttaataacatattatatgaaaatagtattaaaaataaacatatttttaattgttatttagagaagagtgcactgtgactattttgtgtagacttgatcctgagtgtaggatttgattaacctattattggttgcaagaataagattgaaagaatattttagattatatgtatattgttatatgaataatccaattattttagttaaagcaagcattggtaaaaagattgccatcatcgagtttggtcattacataaagatgctctaattttctaattgtgttagctacaacgatccatagaaacattatcattgatatgggtacgcttgaaaaatgtcaattgtcattggattatttttttacccgttgcaatgcacggggcatttttactagtatataataaaagaacgaaaatatgtctcaccacatcccgttcatgctttctttcctcgtgatctcatttttttctttatctttatctttacatacatatttaaaatatttgtagtgtttctattattcgtcactgtctagcgtacatcgacggttttcgtgtttctgcattggcgccctagcagcacgtgcgagcttgattgcttccaaaccaaaattcaccgcttccacgtcgacggtcaatcatcccatgtgtcagaatccaataggctccacacgcatcacatccgatttgccttcccatgccaagcaattttgtgaatctaccatttaaacgatgtcaaaggatcgccaactcgtgaattaggaaataacaaagtcactaatataacaaatatacaatagtaacaagcctcataatccatatgacaagtggacccataataattagaaaatctaaattaataattaattaaagtaggtccattatgcacccgtggattttatatatatatatatatatatatatatatatatatatatatatatatatatatatat

SEQ ID NO: 48860 - DNA, 252 bp, Oryza sativa
caaaatttaacggtatcatatattctgaaaatggaaggtctagtatttaattttgaaccccaaaaaaaaaagattgaactaatctcactgtgctggtacgacaacagatggggtcaaagtacaaggctgccctgatcccgcgaaggatcagagagacgatgcatgggtgggggaaagacgcgaggaggaggaggaagaagcaccgcggcggcgacgactccaccatccgcacggagaccagcaccgtctgct

SEQ ID NO: 48861 - DNA, 1501 bp, Oryza sativa
tatcccttctgtaactgttcatcaacttgcttcttgacttccgccaactcgttggctcccattctgtaaggcctcttgtggattggtgcagttccaggtaccaagtcaatccggaactcgatatccctttttggtggcattgttgtcagatcatccggaaaaacctctggatactctctgactatgggaatatcctccagcttcttagtggttttctccactgctacctcttgttcttcaccagcagcctggttcaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaacccgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccggcacgtcttggcttcgggcactttccaaccgtgtgtccgggtttgttacaattgaagcagagttcgggtttttctcccaacctcttgggctgttctggcagagctggctgaactgattgggctggaatctttagtgaactcggagtagggttgaggctgtgctgctcactattgttgtgactgtcactatggtggttcttgttgaagttacccgggtggtagggacggtgctgccggataatcatggtggaaggtccaccgtgatgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtagcgcgcgaggcggttgaactcatgcaaatactctataactgttctggttccttgttgcagggaacggaactctctcttcttttgtgccacaattccctcgggaacctgtgctttattgaaactatgacgaaactctgtccaagtaacctctgccccagttggacgggtcaccatgtagttgtcccaccaaacagaagcgggaccttgcagctggtgtgtagcaaaagcaaccttctcttgctcgttgcattgcaaaagattcagcttcttctcaatggcatgaagccagt

SEQ ID NO: 48862 - DNA, 1494 bp, Oryza sativa
tcgtctgggcctccgtcgtgccaatcgttgtcgtcgccggacttggaggtttcgccgtactcaagtaatcaatggtgcagatgagttacgttgggtgcctgcttgttcttgccagtttaatctgcagtcgtttgcttagtgccagtaatgagtgtgtttttgtagcggtttgatatcaaattactgttttatttctgcactgtatatgctgtttctgaattaatttacctatcaatttgtgattcgagtgtacattgatcaaaacagagctactgatttttgtccttgacgggcgacaagctcgccggaaaacgcggttgctgcgaagtcgctgaacccggtgtctctcaccacctcgtgttctcgtcgtcgtttgcgcgcggcggagctccggcgagctccggaagcgggggagatgacatctttgttttttatgtgaaccgttggatgtgatttcatcggcccagatggagacggataagctgtacaaatggcagggcacgttaccactggcccagaaaaatacggccggtctggtttagtaggccgaggaaaagattggcccattatgattggcagcgatccatatcaccaattcattcttgtcattctggcccaacttgctctttggcgcatgtaattatcagactattcaaatttgttgttttttttatattattaatacatttaaaaaagactattcaaatatatagtattaggttatgtcccattgaatatttggttgctatatttttgaacggagagattagcctttacgctattgccaaaatttgaatttttaaaaaaataagtttgatgtttttctcatcgtaatttattttacaatttaggttttaaaacactaaaaacatattgtcagggttacgggttaggtataccctttgcccttcgatatacgttacatattgatatggcatacccacgcgcatacggatatttcctgtatattctaaggaaacctttcacggaatctatagatgggaagaatcctactcgggcagaactgggtcgttggcgtatcgtatagggtctgatacctccgagttctatgaggagacctccacatctgcgatataaaaggggccccccgagagggggtttagacatcgaatctcaaagccaacacaacctccacagcctacgaagccggagcttacgaggagccaactcatcgagagctagtcgaatcaactcgactacaatctcgccggatccgacaagttcccttgttctctttgtaacctgtgttttctaccatataatcccacatcaactggattagggctattacctatcaaggggcctgaactagtataattcttatcttttgtttgcttgatgtcgtactacgtagatccttgtaccaacgtaccctaataccttctatatccggtctacgggtatcacccgtcgacagtggcgcgccaggtagggggccttggtactcaaggttctactactatgtcatccagc

SEQ ID NO: 48863 - DNA, 1501 bp, Oryza sativa
agtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggaggttggttgggcctgttgcaacgtggtgtagcgttggacagtgtttggttaatattgattaattactacagttgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagctgaagatcttcctagttggagctgttttatcgaagttggtttcgtcgctgccgtcaaggtttgcctgtggagtggagacacccgctgctgaagtcaagcttcccggtttagctcgcttttatcttttccgctgcatttgtaatcttttctattttttttataagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaacctaagagccctctgaacccctttttcatctgcatatgcctttttgcacttggaatttgttttgggaaaatttggagttttgcctctttggtttgcgggaaaaatcttggtcgttcattcggatcggattttttttttttttttaaaaaaaaaaatgagctcagcctagggctttagaaaaattttagttggagtttattcgacagtcagtcgggaatttattgggggttatgcattaggtcgtgtctatattcggtgggggcaatgttatgcgcatcattttccatgcaactagtctatgcattaatttattgtttagttgcattagtgtctttatttgagttcatgaaaaatattctatgcataaaaatcatcatgctcggttatttatttgagtcttcttttgctttgtttaatttggatttgagcatgagttggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgcgtgcctctttttcagtgttttaatcaagattaagataattgcacttaaattcataagcaagattagtttctgagccccctgtttttcttccttttctcatatttccacctatcccctcaga

SEQ ID NO: 48864 - DNA, 1501 bp, Oryza sativa
agagatgacgccacctgatggtccgcgagcggtccgatgatatcagtcaaaggaagggcctacgctcaatcaagtcataaagtgatttcgaaaggagaatgcgggatgttcatcgaatatacttacgttgatggcttcatcacgttccgccgcccccttttcacaaagggacatagggatgtcactcgccgtggtcgggccactgatcatcacttggccgacgcggcgctccacggtttccccgctcagacctgttaatcgagaaccaaccttcgataagtcaagaggaatgcgaacacaagtatgtcaagataaatgcgagaaagataccccgaggagaaacccgggtcacgtcctctggcccggaatagttataagctggatgggcccgagcctgaagcggttggatccgcctaccaacgaagtctgcaacgacttcatatcccgacaaaccccgtactcagagattgtcgatgatgtcgataaacgactgaagagagggggtcaaggggggctttgcggtccaagacggaatcttgttcggttgatcttcgggaaccacgaagtcagggttcgagtccttgatctcaagataaaaccacctattcctccacttgctgtgagaagaagggcactggaagggaatgtaacgcgacttcaggccatcccgaagtcggaacccgacgcaaccagataccctgttggattccatccaacgcagttcatagtaaaagcgaaaaagatcaaggaaaggctctaccccgatgtaggcctcacaaagatgcacaaagatgctaaggaaggcgatggaattggggttcaaatggagaagagagaggccatagaaattcaaaaccaggagaagaaatttggaaggtggagggagaaaaccgcagagaacataatcttcgatcgcaaccatgcgacccaatatgggctgaggattagtacctcctgcttccctctccatggttccatggccaggaagagcgccatcctcctggagtttcttcaacgttgcactagtggaagctgatttgccgaggtccattgccgatagaaggtcgccgaaaagcgagcctaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatgtccgccggaaatttctggtcccgttacgcgcggcggttttttggacttcagtttaaaattcgctcgtgaccgttgagcttcaaatggtgtgctcgactacggtctatctccgcggttctcgcaccgggaatgacaacagtctcgacacccgaagtcgcaaatggttgcacgagttcattttaagcagaagtcgggggctactgtcagggttacgggttaggcataccctttgcccttcgatatacgttacatatcgata

SEQ ID NO: 48865 - DNA, 355 bp, Oryza sativa
cctgtggagtgaagacacccgctgctgaagtcaagcttcccggtttagctcgcttttatcttttccgcggcatttgtaatcttttctattttttttataagacgtggatctgtatgtcaacaattgtcgtttgtgtaccctggctggtcctggacagggatttaatgcacattcagcttagaaattctggttcgagaatttctgggcgtgacaacgtaggaaacaaatggaagtgagggcggtggcctgagctaggaaaggaggaattctatgcagaggccagaggacaatggggaagcgccggagcatttgcgtaggacatggaagcggcgacagacggcggagcgagcgtcca

SEQ ID NO: 48866 - DNA, 154 bp, Oryza sativa
ccgctatctccccggtagggctcccgccgacgctctcgcctggtcgccggatattcccatcctatcccctcctcgctcttgctccctctacgtgtgtggcacggcggcgcaccggatcggcgctgggagctaaccccccaccccccggcgaaga

SEQ ID NO: 48867 - DNA, 1501 bp, Oryza sativa
ccagatcaaggcagcgacggtgtggctgcgtcgagtcgtcggggtgtcgggcagggcgagcggaggcgggctaggtgcgggggtggcgacggtgccagactttgtgtccctcgccagatccgggccccactcggtctggccaccctctcgcggacaacggcgacaaccaaaggtggaggcaaggaaggtagatggcaggcgccgaggaagagagcagcggcgacgacgaggccagatccacggcgggctctgccagatttggagccggcgaaggtggaggaaggggaggatgaggtggcaggcggcgagggcgcaggagaggtggcggtggggcggcggctactgcaatgggcgcagccagagcctgccagagctagcgcccctcggacgtagtagggggcatgaggtggcgctgaaggcgccgtcgcgacatggcggtcatggcctcaagcgcgcggcgacatccatcacagttggcgacatgcaggggagttttctaggcgctggcgtcggcttgtgctccactggtggcaaggcatcctcttcttcatgcagctcctcctcctatggccagctcagatgtggtcgcggagagatccatggggaggatggaggcggtgccttgcagaggggagtggcttgacggcgttcaaagcgacgttgttactctgccggaactgtgggcgatggcctaggcctaatcgctgaagagactatgtagtagaccggcgacgatccttcttgtgcggattggttgtgtgggtttggacgggtaatcgctggcgaaagcctcgccgggacgttggccagctgacgatggcaatgccttttggcgtcgctcccctcttggaggcgtcgttatggcattgacccctctcatttccttacccaggggcggatctacagtatagtcattggtgtcaggcgacaccgatgactttcggcaaaacctatagcaaaactacttatccatatattatatcatcatattctaagcataattaacatactatgacactgatagacacgttatgataccaattaaacgattttctagatccgccactgtccttaccgctctctgggtgaaaaccttactccagcttccgacgagccgtggcggcaatctatgtcatgtccagcttgggggcatcgctttgtagagacttcttcgtgcaaggatatcgttgatggtctatgcattggcttcgaagcttttaaatcctaggttttgacgaggccttcgctttctggtcccaccttttgttttgcggtgggcgaccttcgctctttgtttgattttgctaggtggagtcagagctggttcgtcggggtgacaaagctgggcaacgatgacatgctacattctctttctaggggtgttgttgttggctgtgaatagaatgtggcgcttacgcggctttggctgaagttcatcgtggaaagtcgaagccacttgatcattttggcagcgagcttggtttggatgatgcatctggtt

SEQ ID NO: 48868 - DNA, 1501 bp, Oryza sativa
catataggagtagttcgatctttgggttttacaaatacatctttctcaaatcctagactgtcatcagaagcttgttgttgacgaatatcgtctaccaccgaaaaaataattagccacaaatacaagtaataatgtcaagtttagaatttaaactcaggtgagctagttctatcacaggataatcattttagttacgcctattttgctttgtaattttttttagacatgctaccacaaggagtaatatagaatttgttttttttttcttttttctactttggaaaggatggtttttacacgaaattttacatgaactgactatttcctaataaaatcaaataaaaaaacctacgatccaatagtcacaaaactccaaacctaattcattttccatgtgactggggagatcagtcggttgatgaacgataatgtttttctttttctcaacacaatttcataaatcatcgtagcgttacacacaagctagcgcgtaatgaacattattaacccaggtgcaaaatcacaaatcacattcacccaggtgcatatgctaactacaggtgccaggattaaaacctactccgtactcattgtccgcatggccgtgactccacaccacacaagtactacttccctaatttacgcgctaacttttcttaatcaaacactctacacacgacttatttgattaccacgtaacagtagctagtaatttctcccccaacttgttctccggtctccacatctcataggatttatagcacatcattacgtatatcatcataacaaaacatatcactccccatcaaacattatgacgtagtactatgtaataattagctcccttcatttttaataattaagatatgccttttaaattgttaaatagtacatttctatgtgaaaactttctatataagaatttcctctaaaatatatcaaataaatataatttgaagtatgtaattattgaaacgcaattgatcatacgctaatgctttctcattatgggtgtacttacttagtcctcttgttcgtcttgcgaagagccgagagatttgtcattttgctatgtctaggtgtttcatattataagttgtttattttttttctctagccaaacttctttaaatttaattaagtttataaatgaatatagtagcattttttaacataaaacagacatccaatgctggattttattaaactaatttgttatttttgatattactaaatttttctataaatttagttaatcatcttaaccaagtttgactaagaaaaaaaactacaagtacacttcttttcaaggtacagcagcgtcacggcaaacccgtatttccacaagtatatacggtagtacaaaatacaatagagtagaagcaacaatcatttaatctttcacggaaaaacaataataagtaatatataaaataaaaacaaaataaatgaagcaggcagcaattaactcatgtcacatccgtgccgaaacaatccaacc

SEQ ID NO: 48869 - DNA, 641 bp, Oryza sativa
ggtgtgggtggaaccctaagtgttggttttagttgagctgattgggcctattgggtaaaatttgctttgttttgtttttttgttacgaatatgtccactttacatcccttatctttctgtcgggtttaaattgtatccctgaactacaacaccaaaaatcttgaaaccccccccagaaaaaaaaaacttagaaaactagtttaaattagatctcctggtagtatgaagttggtttcactaatgtggcatcccggtccggtaaagtatgaagaaaataaaaaaaaacataggaggagtagctaatcaatcatattacctttttttttctaaaagaattatcgaaataaacctattcaactatctaattgttcatgttataagattaagaacctatccctttttcatttgatttttgacctatgtaccttatatttgagctcattgagttgcatatttttaattcattttaagcattttatcatgggatttgagctaatctagttgttgagttagcttcatgattttttttcatgacttttgatgatgcagtcccatccaccacgaaatattttttgcagagcatcctactttgaattgaagcggttatagtaattttctttccttgctttactgttatgtca

SEQ ID NO: 48870 - DNA, 1501 bp, Oryza sativa
ttctctatacagtttatctgaggattccgtgcaagaacagggaggtttggaaattgcgtgttagccgaacccacccccaccacccaaaggaaaaagcaagcacctctctttttctcctgtggaagttaaagtttaccctttttctgatgggtgatggacaatactcggctcagcataccactattgctccaaatttgggtacagtgatgcggaagaaaagtagtggatgttagaatttagagaatttcggtggttgaggtgatcaccatgaagtagtattgtttttggaatcataccccaaaaatttaggtggcggctgcaatgtagctagggccatattggagcatgacgcaatggcttaatgcaatggatggcccaaccaaaagggacatgcgacagttgattggatctggttgggcgatagcacttgcgaaggagataaacgaataatttttgggttggacaatcgctttcctagacttggtgcctgcttggctgagcttcagattagattttaaactttaggactaattttagtggttttcttcgccactttcttgtctggctctagtttcatagtaattgctaaaatggaaagctgaaaaacctatctaaaactagtctttagaaatcaagctttaaaattcgaaattgttttaagttataatctgatgcagaaacaagcaggaccgatgacgattatacctctccgcacctttttttttacaataatgcccctccacatttctattactgctaactaagatggtagtataaatagatctaaacccttcgatcaaatgagattaacggttcagattgctttctaatgccaatggagagcaccatagtggggctccaattaatttgggctgttattcatacctttcttgccgttaggatgtcaaaggtgctattctgtatactagatgcatactttaccatataaacatctagacatttacattccttgtaagtttgtgatatgaactagtaattcttttactaaaactttcactcaccgtgcaggtttatctacacttttattggcctgggagtctttatgtgcttgttgacttgctctggtcatattgcagctgaaactgcaaacagccactgtctctcttgtgtatccttcaagcagcttggtttatggagttgttttggtgcctaactttacacttttatgtttttagttaataaagtgaagttacctgcgtgttcgttgaccggatatgttctatagtacagaactatgtttttttactggtttatataattgaaatgccacaaaaaaaaatttcggttgagcagatctttctttttaacatgagcagatcatttctgaaatgacagtgcaaacttctattcccttttatttgcgggccaactcttgatccatttaagcctccaaccttacatgtaactcaacctggtgatgcaaggactattttgccttaacctgacattcagtacatgatttttgtgtttattattatta

SEQ ID NO: 48871 - DNA, 377 bp, Oryza sativa
  unsure (1)..(377): unsure at all n locations
attgtatttaaaacttttatatttatgtgttttaagcgacgtaaaagctattgtacaaatctctactacttaaaaaaatnttaaatgattttgtcgtccattctatcatggcaaaaaaaatcggacctgaagaaaaaagagcgaaattaaaataatcggtcctattcctaatcacaaaaggacaaaagatctaataaaaaagataaaaatatgtcccaccacaccttgcgcttgcttcgcttctcccccttccgatctcttttttgcccttattgttttaaaaaataaacaaacaatttaaattactaatcacaaaaagacagtgatctatctatctatgtggtcgtacttgtcttatgtttggataaattccaagg

SEQ ID NO: 48872 - DNA, 1501 bp, Oryza sativa
gttggtacagagagctcttgttttaatgcttttgcaattcaatctactctaattctgtcttcttccattactaaccctttcttaaaatctaaaacttacagggtgtgcactctatgttggagggatgcccagctaaaccatgggagccggatgagaaaagattcaacaaattagtatttattggaaggaatttggatgaagctgcactgcgaaaagccttcaaaggctgcttactgtgaacactctgatcacgtattgagtcctgggaagccatgcatatatcaaactgtacaagatgtttgccttgtgctcgctgataaaatgcttactgtttgtcaccaacgtattaggccaatctaaatgtgttgcatgtcatacgtgggtggtgggtcatggtttacgtttatttgtggtatcctcatctgtgccaggatcatacctgtgtatcatggacaatcagacaacagagtaaacttttttaagggaaaaccaagagttcatgtcccaatggtctgaatttctgaatgcgtggttctgcctcttgattgaatctcgagcataagtttatcttatcgagattgctctggccggaagatcgatttgcttcgatgaacatcggatccgatgcaaacagtgagctgacggttgattagtgaaagaacatcaccttacccaataagataagggttaaaattgataatcggtttcatgatctgctattagcccaatcacaattttgatctagtagcactagatgatgatgatcccagctaattttgctactgctaatactagtgcgattgtgtgtgaactagtgctaaagttgctaaccctaagttgcagctgccacatcccaacggctattttttttctcggacacactgctagccgttgcggccgccgttccgtataaatattttgacggatctaccagtaaccccacaaggatactactccgcgaggcacctctctctctctctctgtgagtttcgtgcgatctcgcgagcgaatccggcgcgcgacccaggctctccaagatccccgcgctctcctcttcggtttactgatctgaaatctctgcgtcgaatcacctgtttgttggcttgaattgcttgtccgcgtcgttgatttcgttgtggtttcttgatcttcggtggaatttctttgcgttggattgtctccacccctgttggtttcttgtcgattcccgatttgagttgttcgttggcgtgaaaaggattctttttttcccctgagatttcttgatttttggtgaaatttctttggtgttgaaatatcatcgccttttggtttcttatcgattccgtcgttccgattggagttgttcgtcggcgtgaatttttttttcctgattcatcgttgcttgttgattggggatcgaatttttcgtctacgatccatcttattcgtggtagcagtatctcttcttgttgctgcgctgtgccctgtttatttgtttctgcttgttgcttctgaccca

SEQ ID NO: 48873 - DNA, 197 bp, Oryza sativa
  unsure (1)..(197): unsure at all n locations
ccttgatttggaaagattttcattggctttgtgactgnnnnnnnnnnnnnnnnnnnnnnnngatcacaacaggccttggaatgagatggaactacctcgcaacgcaaaagatgtacaactattctaggcttgcactgaaattgttattggaaacgaaaagaaaatcctattctggaaagacaactggctacaaggaa

SEQ ID NO: 48874 - DNA, 167 bp, Oryza sativa
  unsure (1)..(167): unsure at all n locations
gtgactgnnnnnnnnnnnnnnnnnnnnnnnngatcacaacaggccttggaatgagatggaactacctcgcaacgcaaaagatgtacaactattctaggcttgcactgaaattgttattggaaacgaaaagaaaatcctattctggaaagacaactggctacaaggaa

SEQ ID NO: 48875 - DNA, 252 bp, Oryza sativa
aaacgacaagtattatcagctcggagggagtagtaaatttcaccttaattaaactatataacaataataaaattaaaatagccttcacccgttgtaacacacggacatcttttccagtaaaaagaaaaaaagggaaaaataattctccgtattgggcctaacgtatatgaggcccatgctctctagtagcacctaaaattaagcccaaaagggaccgatcagttctattacgaacggattagcgaccattaa

SEQ ID NO: 48876 - DNA, 1498 bp, Oryza sativa
tccgtcctcttcgatctcctctgccgtcgatctcatcggaagagagcgccaagcaagaaaggtaaccatagtgttcaacgttttgtttttctttggtacttttctgctgctttctcgagcatttcttgcctcttgttgtttttatcccctcgtgttcttgatttcctagttcttgggctttctcgcacactagttttagcctagagtttctccacctgatttctgatgatgcgtctggagtcctgacctgtgatgtggtgatgctctgggagtttgtgttcatcagatgacgatctgtcaagagtttttcttgagtggcaaagcatcattcggacagagattctgaaaataagtgatgccgtcgaatcatccgctgggatgcgaacaaaagaattcttggaattgtggtctgaataaacaagttggatgatccgttacttatgaggtgtttgaattgattggggaaaagaagtggatgataatggtttaagacatgctgatactcccatgaaaatatgcatatgtacaagcatacagattgaggcgagtggaccatggtgttagaagaaatcaccaaacttcagcttgctttggtgattgttcttggcagctatgccatctggccgtttgctttgcaaatcatgtgaactgttcagtggatgaggtgctaacctagtatttacatgtgccatacatggccattggatccagtggaacatctggtatattcacctgagattggagctatgtggtccaaatgcacctggcatccccaaaattttgggtcatgtttcttttcatcatgagaatcgcaagttcacaatcatggcaccgattaatcagttatcattgaaagcttgccagtatgaggttcttttgtgctttaatcatgaggaatgatggatttaagatctaattgtactcggtttcaaaaaggagatttaattgtactccagttcctgacctactctagtacaggctaatgtgggtggatctgcatctacctatcagttctaacaagaagttttgcgcagacttctgtctaaagagagtcatgtcctactttttattttcccttttctgtactatatatccaaaatatataaaatgtacaaatgaactcaatttgcaactctctaagtggttgtttcgcaatgaattcctgcagaataattattcctgaagattcctcttctgcatgttgaagtgtacaagacagccacaacaactgaggatatgagctggtggtgttgcattccaaaatccaagaaaggagagaatccttactctcatggcgttagcggtacgaactgtatttgcttgcaaaatttatgctgaatttgcatagcagccaacagagtttatgaaatagaaacatgtatattgtccctatcacagattcgatcatattaggctagagaatgccagtactgaagctccattttaagattccatgctttacttaactaaatgtaactaactttcaggtattccgcct

SEQ ID NO: 48877 - DNA, 1501 bp, Oryza sativa
catttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgatggtgcaggcatccaggtcgaagagtaaaagcacccagtggaatctgcaatgtgcgtgggatgcattacatatgaaacacttagcaagttcgtatgggaatgaaattttgtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatagtctacttatatacaaggacctaattaattaaaggagacgtatagtaagaaatctaacttaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcatgaggaggagtcggtgcaggatcctgaggaggagtcgatgctggagcctgaggtggagacggtgctggcggagcaagaggaggagacggtgcaggatcctgaggaggagatggcggagccggaggagatggtgcacgagacgccgcttgtcgc

SEQ ID NO: 48878 - DNA, 1037 bp, Oryza sativa
ataaaaaaaacgttaatttcagactttaagatacgattgatttatgagaaggatcaatgacatgcattatcatttcgtgctcgtggctggtgacaacctgtgacgaaaggattaggtcacgctgaaaagtagtagtttggcacaacacaacaaaaacacaacaggagagaacacataatactatttttatacgatgccgtcagagatatggagctcttcgcttctgacgagtcacattagtcttatacagtaacaacaacaatagggcaattggatgatcgtggcgtagactccttcaaaacaaatcagatcacaccagatggacgtgtgaacatcaacagtaacagagcataattggttgacaagaaggcagcaatcatccaaaaccaaaacaggaaatagcagcggatgtcagtcgttgactcgtcaccagtccacctaagccaacagcaagaaaacacaggagctcacttaaaacgaggagttaaatcatgtagtagtattaattaacttgcgttaattaactctaattagggcttgatttttgttcgggttagatgaatgattttgtgaccacatagagttaaaatataaatttaaagcagtttactttcttttcatgtgtacaactgtttggatttagaggtcaggtattaatccatttttttcagaaaatttctttgtgaaaactacaccgtctaataactcatgcattccattcttcaattccttaaaaacaacatgccctagctttgatacgtacaaccttatcatttcacttatagtgaaacctataagacaaaatttaaattttaaaagctgatttcatgatttgttcatcgtagtttattttacaatatttaattctgaatcatcaagtacacacataaaataattacttaaattattttttgattgctaacaagtaatacgaataagaataactataagcgtgagcgaaacgacaggaccgtagaaaattatttctcaagcacgtaaatatctctcctctttcgtgtactgttaacatacgtagg

SEQ ID NO: 48879 - DNA, 1488 bp, Oryza sativa
ttgtgttattagtctacgatttaataaccaattacagattcgtcgtgtaaactgcgagcacgaatctattaagcctaattaatccatctttagcaaatgtttactgtagtaccacattattaaatcatagagcaattaggcttaaaagattcgtctcgcaatttacacgcagtttatgtaattagtttttccatttatatttaatactccatatatatatccaaatattctatgtgacatgctgaaacattttgacaggaatctaaacaggccccaaatgatgctaaagcaccttgttctttggggacggaaaaccacatgtctgcattagctgcggaggcgtagcacttccctgggaaaaaaaatgataatattatgtttttatcatgtgaagtactccctccgtcaaaaaaaaaaaagacaaaccctagattttcatgtccaactttgattgtccgtcttatatgaaatttttttataatttgtattttcattgttgttagatgataatacatgattaatattttatgcgtgacttgtctttttaattttttttatatttttttcaaataagacgaacggtcaagcattgggcacggaaacagggtttgtcttttttggaatggagggagcagtagatagtagatactttactagatatatgctgatatattaatataaagtgtaaatatatgttatattgcatatataatttgacatgcatatattgttttaatcaggaacaaagaccccacggggatttattccccgtgcaggggcaaggatgggaataaagttaccacagggtaaggatggtgatgcatttcccgacggtgaatgttgtcatctcttttgtgtgagggaggagattatggcaagtactacaatggtaaatatggtgcctctaagagtgccacattggattgagtgatgagatggaaaggagatagatgatgagccacccctaaatcaagaagtaacctccacacaaattttaagaaagatgtgagagtattaaagatattggtaccagaggtgatacattgtataagttgtctctcagttcaggagtgaaaaaaataaataaatttaaagatggtggtcacatttatcgtagcacttgccgttagtagatgcgttgctaaccaatattgtattcgtaggtgtagtgaaaaccgaggcaggatgatcaaatgagtcagacagcaactgaagagattcctttaggtaacattgtgtcgagcatgccaagttctaaagtatctcaatggcatcactatcacatgaaatacaaaattgttcagaaccaactacttgccacaaaaggaagttcataatgcttacggttcttaattaacttaaataaaagaaacttgttcaggaaatacgggtagcttcgcgcgaggatagaatgtgtggacaggaaacataactccattaatcactggtggagaaaccctttgtagtcccggttcgtaaccccccttt

SEQ ID NO: 48880 - DNA, 1501 bp, Oryza sativa
gttgaactaactgcacctataataccttgttcttctagacttgctcgaaatttaggactatcttcaattaaaagtatggtgtaacaccttttatgcaatagtactccgtcgaccgaaaaaatatggaagaatacaatttttagctaaaatttatcatagtttaatacgccgaattgacggcctagtaaatctatatccctttaaaagaaaagaaattagaaataaagtagtgatggtaatagtgaatttgctacttcacctactgcattgaaatttttgcaagttaactcctgaactttttaatattaaaaagatcgaatctaaatgggtagctcctaaaaaaaataaaagtaggatgaatattctctatagcaaaaagtgaaagtacattaatacattattttatctgtagcgagcatggacatttagatggtttctaaaaattatatagtattttgtgtttatcatgattttttcttaggaaaacaacgcttactacacgtactattttcagaatgggctttctttatagaagaaaaataatccatcctttcggaggatcggttgtggtcgttagcaggcattgcttcctttagggatttgttgaaagtgtagcgtggctttgccctctcccgctgattggagtagcgttacctgtcgtacgagttatatttttcttccttggttgttttttttctctccttggtataagttggtctagctaattacattgagtaatatattgacgtataatctttttcgcgttcatgaaaaaattatagaaaaataattttggagcggaaactagtctccgcaggaactctttgatttctgacggactcaacgcctgcgggctgcagcttctccctgctatcctccttcccttttgatatcgggtcgaactttccaggaccggtgctgcgcatgcaagtgatcttctggtttactagatgttcacattttctcctttccagccacggcgaaatgtcagtccatcttcgccggttgactagcaccggtcgccaaacttcaaggaaaccgacgtgcaggattctttcgttgccatgttgtcactcacccgtgccaccatcgcgcagcagaatccttcagcggcaaaccaagaaacgacatcccgttgaaaggtcaggtcaaccgtaatcctcatcacggcatcagtgcatcacctgaggccgacctgctctcccgatccctcgcgaactccccgggaagacgacgaagaccagttacttctacaacgcaaatcgaactatagccgccctgctctgtccaggaagcaacgcgccggcgcgggatgctccactataaaacgcacccgctaatcacatcgacccgccacaccacctatcacagcaacacaagccaaccacaaagaattctcatttccggtaacttttctcaagcctttttggcgctctgagaatcatcacacggaagtcaagcctttgttgttgtcgtgattagtttagtttagtcaccgaga

SEQ ID NO: 48881 - DNA, 673 bp, Oryza sativa
attcctgcagcccttctataaaaatcctgtaaaattcctatgttcaaaaataactcctaaacatatgaattgttggaaatttagaatgaaaatgctagaagtattgtcaccaattgtttattaaaaaaacatttgatttctgaactgctagattacatcaaaatttggaatgaaattgctagaactctatcgccaattgttcgtcgaaaagattttctatttctagagtatcatattgcatcaaaatttgttcagggagaaggggaaaaaaatgtacgatgcgcatggaaggtgggtatagaatgcacgatctgcaagacacaaacacgtgtctacaggtcaactgtgtcacacgctgtttttataagttaaataaaagttactgtaaccatactatagttatgctctaaagattttcttttttcttaaaaaagaaaactgttgtcagatttggatagccccaatcaataatcatcagtggaatgagacgtataaccaacgaatcatcttgcggtaacgtagccggccggccgccttcccacggaggccggcaatggtgattcgttgaacattttgatcgattcgccgctgctgacctcccagcgttgatggcgatccaaccatatcttaccatatatccccgagcatccctgctaagagcaaggataatagt

SEQ ID NO: 48882 - DNA, 1501 bp, Oryza sativa
tcaggccgtaattgtcctagatttatctccgccctagtttcttaggtggtctttggttcgttcgttgtgtcagattatatttccaaccgcatagtccaacatcaaaatatttgattccttatctaccttggtcattggtgtcgtcagtattctgttgaccatatgccttacctaaggttaggaatatgccaaagttagccacgaacaaaacacaaagtctaaaactaggatctgccttgcttgctgcaatggagatggaataaagccggatacgaatcgggccacggtgcattggcacgcgacgcgagctatacactcacggattaattaggcccagcctgggcccctgcacctgccggccgccggccgcgggccacgcaaacgcgcgcgcggctcgtctcgcgtatggctcgcgtcttgcatctgcgggctcgcgtctcgtgtctttttaagcgagcgcgcacggcgcacgcaacgcatcatgcgtgcatgcatgccatccatgcggtggaggggtcatgctgcatgtgctgcgatcgagcgagccagcgagcggccgggccgcgcgcgcctttgcgcgcgacgagctgtcattatcgcccgcaccggttactatgttgctttgagcttaggctgcgatagatatgcagccatgaggcatgcatgccacggttccttgattcagacaaaagggtaaagatttccctcctgtgtcgtgtgcagtgtcactagccagttagtgtggtccttaatttgtaccaagtatatttgtgtgttactactagtttttttttttttgtgacctagctagcagccagtggccacttttgatttaaacctgtttgtcatatgaggtcatcggtcagcaggcatcattctcggtactcttccctaatttaaaggtcacacatatggatacacatgtttatggatgttcatgattaaaaaactatttacttttgatccaagcaagctaagtattgacacatgtaaatgtatcacagatattatacgatgtgatagctacttatgccagtaattccagtgagagctgatgcacataacactcgcgaagtgactctcgcgtgactgagtggtagctaactaggctcctacgatgcaatgtgttgtctccagctcaaggacatggtgctcaagttctccggctccaacaagcatcagcactacaaggcggcgacggccggtagcccttcgttcaggagcaggagctaccgccgtccgtacccgggcttcatcgatgactccgcgttcatgacgacgaccaggcctggaggtgaggcctacatgtacacgagagcggcgccgccgccgcccgtccgggccgcgtcgacgtcgatggcgacatgggacatgaccaggagcaagagcaaccgagggtggcagcaggatgccggcaggagccccggcggcacgacgtggatacagagcatcgaggaggaggccggcgccgacgacgtcaccgtcgtggaggatgccgtgc

SEQ ID NO: 48883 - DNA, 1016 bp, Oryza sativa
aaaaatatatttatatcagttctatataaatatatttttaatctgcaggttttcctcacatgttttttcagcttcattgcaccttccactagtaattggtagagtaaaatatgctgacttgacataaaaccgatgaagatgaaaattaagttggcgtacggaaaacgagaatgccattagcacatgattaattaagttttaattattacaaacttgacaaatccacatatttggtattttaaagcaacttctatatagaaagttctcgtacgaaacacaccgtttagtagtttgaaaagtgtgctaacgaaaactgagataaaatatgaatcttaattagaaaagaacggggcaaaattttcttgtatctagaagaaaatgaccgagccctatgtatcaattctctgtcttttgttatgaccaagcggaggaaaaaaaaggcaatcatatagtgttatattaattgaccaatcccatgaccagctttaattcatcgtactcatcagctttctatggataattccaatgggcgatctactgttcttgtcacctttaaaaagtcagagacgttactctctctatatatattatatatatatatatatatatatatatatatatatatatatatatgctaacacgtaaaaaaactttgcatattaatatattagaaaaaaaagtgacacgccgagacgatcaaccagcaaagctcctaagctatgacctcttgcatgttaatatattagaaaaaaagtgacacgcctagacgatcacccaacaaagctcctaagctgagaccgagagaggaagaaactacactaaacataactaagctatgtgcctaacaactctccaactggattggcagttgtcgccacccattgcctcccttcttccacaatctgctccaccaccatcagcacttgagatagaacatcatcaaggacatgggcattcctctccttccatagttgacaagggagtcgagacatttcctactcttattatggtggcga

SEQ ID NO: 48884 - DNA, 1002 bp, Oryza sativa
ctgtttagattggtgtcattttaaactataccattatttggtaaaattgacaaatatattactatatttagattgttaccaaattatggtaacgcataggaaactttggcacaacatatttattccatcctaccaaaatttggcaattttatcaacttaccaaaaatttggcaatgttgattttgacaataatttgaacaagccctagacccacggtttagattaatttctactaccagtaaagagtaccgtaacgagactcttctttcattgctacagcgacgttaacataattttggtgctagtttaaatgtatgtcagtcatgcacataatacgatctttgccattgatatattcatatgagtacttttcatgtttatgttcaaaatggggcctttctttttagttccaccctgtgcgacaaaaatctcagggcaggccctgatttctgtatgtgactacagaacaaactgatgaaattgaaaagcccaatttcttgctcttttagatatgatgacatctggtgccaaccaacaaacctaatgtgctgttatgttattggcttaaatctggtcatcaatatttattctttttaagagggtacaatctagtcatcgattaatatggaaatttgcaaggaagatcaagattataagcttgaaataacctactactaccaaactgggtctgcaatccttttccaaaaaaaagggtctgcaagtaggaaagtaacacaaaagttacataaggcaagggacaagaaaagaaggcattgcattttcataaataatagagtatttggcttacaatctcatgttgaaaatcacccatcataagcagcaaaaagtgtttctggcaatcatccaaattcctgtagtcctgctcatcgcgccgtctacatctttcgcaccacgtgcccatctttcaacaaacccctacagtgtcggaaaaaatcactacttctcagtggggatatttttttttctcatcctttcactagt

SEQ ID NO: 48885 - DNA, 1501 bp, Oryza sativa
cgccatttttggagtattttatgatttcatttcgatatcctttgatctctcttttggttcggtcaagcacactagccggtgcgcttggctgctgtgcacagccatgtatgattgcagggtggtctgtgccgccgtacgtacagaagctgagaaaagaagcatccaaatactatagtatttgcctcgtgaagcagtgaacagcggaggctggtttaaaaattgttcagaagaagcgcatgtgtaggtacaggacggtagatagatggaataggctcatgcatttaaccgggaatctgagtaactgttttcatcagatgcacaatggtttcgaacggagataggactagtcggctgcgcgcctgcgcatagctcggatgcgtgccagtgctagtactcctactaaaagattacagaacctgatcgtatagtactcgtatgatatactactatactgttttttaatatagaaattctcatatccttttcacgtcgccatgtttttgtacaactatagtctatgaatctgcataataaatatttgcaaatgatatttacaggagctaataaaattcaaactgaacttatctaaaaatgtacaagtctgaatctcaaaatttatccacacatgacacatgtccgtgactgtctccagcaaaaattgactgctccaacctcccacctacctatacatttcgtgatgttgatttgtatatttcctctcggacggcgatgtttttgctctcctattaatcgtcgttggctttccaccaccgcaattaatcgaagaatccgtcatttgagaggttcattttagacgctcgtgatcttaatccctatagtaatttgtacggtttattaattgatgtgaacctaatactaatagcctatggcattgtctacttgtcgctctgattgtctctctcatcgtcgctgtcggtgacatgggaccgggagtatcatgactagaggcttgaggcagacacaatcgcccacgtgacctggcaccgtcagggggcgtcgggcccgagggtgatgtgttcgccctcctctttaccgggagtatcatgacttagagacttgaggcagacacgatcacccacgtggcctaactccctcgggggggggggggggtcgggcccgagggtgatacggctgcccttctctttgtctccccaaggggtcggaccgctcccgtctcggccccgagggccgaagcgccccgaccccttgtgggttttgcgccacgtatatggggtaggtgagcatggcggggctcacctaaccacatttattgcagttttgacgagcgcgtcacgccgcctgtatcgcagtacagcacgctcgtttatccggtctgtgaccagtcacagaccggtcagatcatgggttaggtggcgacaggcggtctgacgcacgcctcgccccatcccgtcaggacgagagcctccaagcactcgtccctagctggagccggcgtgttagctcctggagatggcacgtt

SEQ ID NO: 48886 - DNA, 1501 bp, Oryza sativa
taagtctccaccccaatacagacatgcactatcacctactaataaacatgaagccaagggagtagagattttcatgattttatttcaagattggtgactaataaaagaacaacttgttaaaagcatttcacacgctcatcaaagaatattgtgttaaacatgacctccaccctagtttcatgtacatgtatggtcaaatctttaactccatatctgatccaaatatgtcccataaatatcataaaccgtggcatagcgatcggcacggtaggttctatcttaagataacatagagtttgaaatcatcaatctacataatgcttatgtccccgttgaaaatcggccttatctgaatcgttggatgattcattgactcaccttatatcaatccttgcagggaatcctatgctaacgaaatatgacaccgatgggttgtatgttgatggtgacaagaaacacaacttagggtgtgtttgaggaggagattggagaggttgggaagatacgtaaaacgaggtgagccattagcgcatgattaattgagtattaaatattttaaatttcaaaaatggattaatatgactttttaaagtaattttcttatagaatattttttaaaaaaacacaccgtttactagtttgggaagcgtgcgcgcggaaaacgaggtgctttctcaccctatatcacacaaacgaacgcaaccttaggctctatatcgtcgacttaggggatgatgctaagtgcaccatcgaaaacttatacataggtgtacattatgtgatgtgtctttgattcagtaatttttttgtttgattttcttctcattttttttaataaaatcttaaaccgccggctgttaaaaagctaacaagacatgtaatgtattactccgcaatgatcaatacaactctctatgttgtaagaaaaaaaaacaaatatgtggtgtatattaatatatgcatagtaatcaaagtttaatttatctttttgcgacaacatgtagaagtcatatttagacttctatcatatttagacttctatctttctagagtactttatcttattaaaaatattaaaatttttaacaactattcagatgagatataagatactagaggacattcttaagtgtttataatccactcccacaaaaccgaatactgaaagcgagcagcacgcgaacccaaaggtaagaaaccgatcaagacgcaggtgcttgtcccttagctggaaccctcccgtgtcggcctcctcgcccacccccgcgcaccgctcctagctacccggccggctatatagccccatcgttattcgtccccgtctccccccctcctccctcccttcatcaggcagagccggcctgcagcctcgctcgcatcagcttgcacacagcccacggcgccaccaccagcgaggcgggacagagggaaggagacacagaccagccaagtaaaaggcaaaagcacagcacattaaaagagagagggcgcaagcaagcgg

SEQ ID NO: 48887 - DNA, 248 bp, Oryza sativa
atttcatttattaaaaaatactttcttagctcaaataaatcccagaaaaatctaggaattatagcattaagcaaagtatttaaggaaattttatctgggcccattttatattggaatttattaattaaaaattagatcttcttttcaagactttttaaaattatttctaaaaaattccaattaaacaacaatttatatattttgaattttcagggtgtgacagaaagccgccaaggcttccactcagg

SEQ ID NO: 48888 - DNA, 1501 bp, Oryza sativa
aattacttaaataaatttttctacagatattctaaaaacatacatttagcattttgagaaacatgtgcgtgaaaaataaggaggtgtacaaactggaaatgcgtagtatagaacgcaccctctttttttttttgctgattcacttttttttccctgagaaactctcccatttcttaatgaaatgaaaaggttaatgttctccaaaatagaagtcttctatcgaattgtttagggcacttgtttcgaactatttattaatcttagttttaaaaaatatttaatttataatttatccatataattaagtagtaattcatgacaacaattcaatcatcaataatctaaatcgaataaggccttaagacccctttgatttataggattggcaaaggatttttataggattcaaaatcctatagattgtattcctatgcttcacatttcataggaaaaatagcaagggatatgatctctttgtgaatttcctttgtttttctcatagcattattaaatgactcctattatgtatttacttattcttgtaggatttaacaaacatactactttaattcatgtgtttttcctaccctacgaatcaaaggggcagcgaatcgtccttccctctctatgccttttccgtatacttttctcgggtgctaccttcactcggacgttagaattaagaggggcccggggatccaagtgaaaacactcctaacacgacacgcataacatcagctggaaaatcagctgacccgccgagaccgtggagtcgtggagacaactcttcgtcggcgcatgggcaactcatcacggtacgacgcgggccggccggcggggacaaacgcacccgcctccatccgatcgccagcctcgtcccctcccataccaaacgaggtaaacctcgcaccaacaggcacaacgccgagtcccccggggtgccccatccaaccaacgcaaccaaccccaaacacacactcgaatcgctatccgcgtcacgtgacgcggtggccccgcgcccgctagcacccaccggcatgcagcgtcgcgcgcgcgcggccgggttgggtaaggtttggtttaccccctctgcattattgacgattttggatggggggccgggcaccacgacgcactgatgcagcactacagcgtcctcccccttgcctcgccgcaaacaaccgccactgctatgcaacagcagcaacgccgccgccgccgctggcgtgcgtgccgtattatgtgtagacgtacagtgcaccatcgctggcccggcacagttttgcggacgctgactgggcgagcgaacgatgtgcggcacgtgacgcacggcattgacggcggccgcgcggcgttcaccggctgctcgcccactgccagccgagagctacccctagctactagatgccgaggaaaaggtcgaagaagacgtgcatatgccactaaccattccatgcgccggtgctcgtggactcgacgtgtgcactggccaccgaggcac

SEQ ID NO: 48889 - DNA, 1501 bp, Oryza sativa
ctaatctaaattactactccctctatcctaaaatacaagagaatttagttgaatgatacaaagaatttacacaataggtcaacgttatctttttttatgctagtcactattttttttaaatcttcattttttttagtttataagaaagtccaaaaccttacgccgaaaaacccaaatccataaactaatataaaatcccccatactccgcttcttccttcccaatcactatcctccgcctccgcctccacctcttctctctaccaaggaatgcccaggccgtgtggcaaagagctctccgatcgccgcatgtgatgtgagcgagggtgtcccgatctttcgatgagaggataagtcgattggtttgagcgacgttggcgatccgattacaactatccagggatgttgtgccttagcaatcgttacaccaactccagaggcggtcatgaatctcgacggatgcacgataagcccaaccacgaggtgtttgttcttgcaagcaattgagaactagcaagaacaagatgaacaagcaactcaatttgtgaatcaaaagaagatggattgtgtcgatgggggatacccgtagacaggatatagagggtattggggtacgccggtacgagcatctacgtagtacgacatcaaggaaacaagagacagagattatactggttcaggccccttgataggtaatagccctaatccagttggtatgggattatatagtggaaaccacggattacaaagggaataacagaactcgatgataccgacgagatcgtagtcgaattggttcgaccagatcacctggcgacttggctcctgtaggctccggcttcgtaggctgtggtggatgtcttagctatgagattcgatgccttaggtcctcccgagggggtcccttttatatcgcaggtcaggtggtctccaagtaagactcggagacatcggaccctgtatgatacagtgacgacccagtcctatacgggtagaaacctttccattggtggacttcgtgatgaatttccttagcgtatacagagaacgtccgtacacgcgcagatgtaccatattgccgtatagcgtacatccaagggtagagggtataccttatctgtaaccctgatagtagcccctaacttctgcttaaatgaactcatgtaaccgatcgcgacttctgatgttggagttgttgtcattctcgactggtcgatctcgatgtgagaaccgtagagacaaggagtggtcgacaacaccatgcgaagttcaactgttatgagtaaatttaaattgaagtccaaaaaccgcctcgcgtaacggacccagaaatttccggcggccatctctctcctttccttggaattcgcaccgttggtagtgcgcctatttaaggctgttgtgaaaactttctagcctccaaacactcttcgtcttctccgcttccacgcaaaccctaactcacttgcctcggtttcttctctggcgatctccggcggcaa

SEQ ID NO: 48890 - DNA, 177 bp, Oryza sativa
aagtttccccgaagctgacccaaacccaatccttccgagaagagtagttccgttagctttctagatcgtgtgttgtttgcttgtgtgcaggggtatggtttgcatcattggtggggatgcgaccatactaggttgtttgcttaagcaacttgaacaataaaagtgtactcacaacat

SEQ ID NO: 48891 - DNA, 625 bp, Oryza sativa
ttattttattatatctagagaaaatggagagagaaacatttattaaagataagtttgcccatgggcccactggtcaatctcacatctctagctttctttgttcatgttcttcttcctactgctaccttctctctcatgcgtgtgcacagcagcggcaatggagagcatgtgcagctgctggctagggcagagcatgcggcagctggttggaggaggtaggcctggagcttggccacccgtcagcggcgccatgagagagccgcacagctagggtgtcggtgcgggacatcgggttgcaaaggggaaatatgcgcagcttcaattcgaccaagcagtagtacgacggggtgtctaggaactttgggaagtcgatttccaatgattgcaggatagagcaacgtcggggtcgtgtgcccgtgatgagcttgatggcagcccaatggagtttggactggcaaggcatcttcgtctaattgttaaaattgattgggtgcagtgcctctatgggtagggaaaaatttaggatgtaatagattgccggaaattggcgtgatggtgaatgatggcaacgacatcgtgctcgccatcaacatgtctccaggcctacctactcggcagcttcagg

SEQ ID NO: 48892 - DNA, 206 bp, Oryza sativa
caaatgcagtcaccaccaacatatagatggacacaggtgcaaagagataacttaagtgagtgcaacaagaccatgatgagttcctcctccgagtcatcggttacaactcagttcttatatgcattgccttataaatctcatctggtgttgtcatgtcatatttcacagctataactggttgatgttttcttttctttgcacacagg

SEQ ID NO: 48893 - DNA, 1501 bp, Oryza sativa
agaagtctaaatatgatagaagtctaaatatgacttctacatgttgtcgcaaaaagataaattaaactttgattactatgcatatattaatatacaccacatatttgtttttttttcttacaacatagagagttgtattgatcattgcggagtaatacattacatgtcttgttagctttttaacagccggcggtttaagattttattaaaaaaaatgagaagaaaatcaaacaaaaaaattactgaatcaaagacacatcacataatgtacacctatgtataagttttcgatggtgcacttagcatcatcccctaagtcgacgatatagagcctaaggttgcgttcgtttgtgtgatatagggtgagaaagcacctcgttttccgcgcgcacgcttcccaaactagtaaacggtgtgtttttttaaaaaatattctataagaaaattactttaaaaagtcatattaatccatttttgaaatttaaaatatttaatactcaattaatcatgcgctaatggctcacctcgttttacgtatcttcccaacctctccaatctcctcctcaaacacaccctaagttgtgtttcttgtcaccatcaacatacaacccatcggtgtcatatttcgttagcataggattccctgcaaggattgatataaggtgagtcaatgaatcatccaacgattcagataaggccgattttcaacggggacataagcattatgtagattgatgatttcaaactctatgttatcttaagatagaacctaccgtgccgatcgctatgccacggtttatgatatttatgggacatatttggatcagatatggagttaaagatttgaccatacatgtacatgaaactagggtggaggtcatgtttaacacaatattctttgatgagcgtgtgaaatgcttttaacaagttgttcttttattagtcaccaatcttgaaataaaatcatgaaaatctctactcccttggcttcatgtttattagtaggtgatagtgcatgtctgtattggggtggagacttaaatggcctaagttccacacacttagctcgccaatgtccacgcaaaaccctaaccaccaacaaacttattgaaattagaaaaggatctgtgaggatgacaagtaggaccaagggacattaccacatgagtcggtgttgtgttttcgttttcagggcccccacttaatcgttggagtggaaaaacgaaaaaacatgaacaaactaataactctgacggaatgcaagtgcaaaatagatgattacaaaatacataaataacatagaaataaccgtttctttggaacataggaaaaaaacaaatgaattagatgagagtgataaactaaaaaatttcaagaggttgaaactcttactaaatttattcaaaatccatatatgattgttcgttatgtaagaactttaaatgataggatataattctatcattttaaatctttattgaaattctctaaatatttctat

SEQ ID NO: 48894 - DNA, 464 bp, Oryza sativa
aagggaaatagcttaaaaaaacttatccagatatataaaatttattatgcttgtgacaagtacttcattcgtcccaaaaaaaaatggtggaggggatatgatttcttctaaaacaatgaatctgtactacccttttatccagattcatgtagctggggatgtgattttttctaagacaataaatctgtactaccttttatccagattcatgtagctggatgtgacttcttcctatgtagtagcagtacgtcagatttagcagcagtgcatagagatagggcaagatactgtacggagtatttatttgtgagaatcgtaaaaatggaagccacccgaatcggcacttatcccatagcttgaccctgacgatgcgactttacctacggtttgcagatctgatcgtgcagaagcgcagtgccgggcccattgcacacctgtgagctgtggcggctttcggccttaga

SEQ ID NO: 48895 - DNA, 1501 bp, Oryza sativa
atgaggagggaatttagcccaccaataatttctattattgatcaagagtataagagtagattttgctcaaaaatagctagtgtcccaaagtaaagaagagctagcggcaatccaatagctaggcggtgggtgatatatggggttgcaccattgtgtcggctctctgctacgtcattgagttcaagctccgcacccattgccaatgctactccagctcaagctccacgacgtactacatgggataggagaaatggagctcaccaattgcacgcaatgaggctggtggctaccacccactgagcactagttaacagaatggtggagaaagatatgggaaagtcaggaggaagaagaaaaggagatagaatggcatgtcagctcacctgggctccataattattttttttaagttgtttcgccgattagatgccaataagtgttacgttagattaaacccagtgaacttttctaagggtgtgtttgagaggtggaaagtaaaaatttagaagatgtgcataaaatgaggtgagccattagtatatgattaattaagtattgattattttaaacttgaaaaataaattaatatgatttttgaaacaacttttctataattcttttttaaaaaagtaccatttaatagtttaagaaatatgtgcgcgaaaaatatgtgagtttttgtcacgccccgaactagtcccgaccggaactagcccgtgacgctccaaattaacctgttaatcgataccagtcccaggaaacagtactagtatcacagggagacagaatatcacagcaacagaggtctctttattatagagtagatgtacagtcatgttgggctgcggacagatcccgagctcacaactgcattacaaaaggaaagcggaagccaggacttggaccattcatcacaggcgcgacttgggaactaggccgaaaccctaaaactcatcgtagccgacttgctcctggaagaactcctcgtcagcaggatccacttcatcttcttcagcaactggggggggattatttatatagagcaagggtgagtacgggagtactcagcaagccaggggaaataagtgtttaatgcaggcttcaaggaaaggctgttgttttttcaattggttttatttgaactctttttctaaaacgactaggtgagtgcttctcaaacgacacagatgggacagtgcgtctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 48896 - DNA, 1501 bp, Oryza sativa
tgaccggtctgacactggtcgcgtcagcaacggacagccataatcccacgtcgcacctgcttccggcggaagagggggtaggtatgggccgtcccgtcatctggcgcactaggacagcaaccataccgatttccgtccatttatgaagagaggaaaagtccagtttggaaggagagaggggcatgtggtatccccttgagatataaaaggaggaccttgcccacttagagaggaggattttttggagggggggatccgatcccagaacgattgggggttggttcatactttgtaacttgttcatacacagatccaccaaaacacaggagtagggtattacgcttcccagcggcccgaacctgtatacatcgcctgtgtctcttgctctttcgataggtcgcgatctttttacatacagagagagctggggatttcaccctgagcccccggccgaaccggcaaaggggggcctgtgcggtctcccggtgaggagccaccagctccgtcaattatacttatgtataaaatcttaacatcaaattcattatattttagtcttaaaaagtataattttttttgacaatttaagaatataaattccctgaattttatctattttgttgctccctatatacaatgaatttgaaaatgaaactttgctcatagatataatactactaaaagtacctgtacaattctgtatagaatattttatgatatgtttttaagttggtatgtacggtatgtacacgggaagacttgtgtatatagattaagttcccgatgcatatgcttatgcaaacgcgcatgtacttactgatataaaagcatgcacgtacattcttccaacacattcttaagattaacaaagtcactatttttaaaatacattaactactaccgaaacaataattcgatgtaaatacgagtatatgtgtaagtgtataacttaaatatggatggcaagttccatcagaagaagaaagctaactagaggatggaaaagaaattagtgtgcatcactagcttttcatacaaatgaatatcactatagatttattttttaaaaaaaatcattatagatcgactttttgcatttctacccgtgttgtgaggagaggaatatctctgggtacacttcacgagtacccctagcataggcctccaacaaacccccaaaatcaacggtggagagagagagagagagagagagagagagagagagagagagagagagagagagattgttcacatgattagattaggctaaagtaaatcagaatcacaaaccacagagggagatacttccatctcctatcttcttcccttccaaaacccccatctcatcccactccggcgtctcctccgccgacgtcgccatggggcaagcctgggcgtctctccaggataaactccaaggtaaaaccttgcctcccatcaccaatcgactcgcgtcctcctgtcctgcatcgctcgatccgaaagtagcgggtttgtgcgg

SEQ ID NO: 48897 - DNA, 1501 bp, Oryza sativa
gccctccgctcccacgcgcactgcggccggcggcgaggcgccgcgatgcagcccccgtccacgctcctgcacagctgacgacggttcgcgggagagtgatcggccactgctgcttccgcgcttcatcgatgagagttcgccacggcttggccgccctttgctgacgctggcagcatcggcaccttccttcctatcgttttcagcttcaccagctcgacgcggggagcgctccatgaattctcgggagctcggcctgatgctgctgcgtatcgtggcagccacgtccgtcgacgaggacagcttcgtcgttgttgccgcgccgcgtccgcctcgctgagagccatgtcgccgcgccagtggcggcggcaccaagtttacggacaatccggagtccagcctcccgagacggcgcgtcgaggagccgccctccgctcccacgcgcggtgccgccgccggcgaggcgccgcgatgcagcccccgtccccgctcctgcacagctgacgacggttcgcgggagagggagcggctgctgctgctgctgccgccgccgcgctccatcgacgagtcgtcgccacggcgcggacacctcatgtcggagagcggattcccaccgtccaccgtgccgcgccgcggcgtcacggctctggacgaacggcgcgaggcgaggcggtcaaggcgtcgctccggactctgacggtggcgcggcgccggcggcggcactgtggttcttgccgagcggttcgaggcgacgcgagcaaggagacggtagttgtcctggccatggcgaccgtctcgccttctcgtcgcgccttgcgtcctcagccggcttgatttctcactggcatggaggctggggctgaacgaggctatcggcttcacgaccggcaccggcaccggcaccggcacggcgtcgtcgcgcgtccggcgatgatcggactggatagatagcttcctctccagcacaggagacagcatctgcaaacgtgcggtgtttcttttggatcagcatttgccgggaaaatttaaaacggagatgaaggtggagtgatgcaatcttgcaaacaatgtctaaatgaaatatgaccagatggtccgaaaatgtatcacctttgcctgcctgaggagtgtctgacgagtaatgtcatctaacatcttcgtcatgaaggctcttgatgtttcatccaactgtaaaacgtcgagataatatgagcatgaattgatactagcaactctaaacgtgcattttctttcttcagattttccccaaggagaataagaatatgcactaaacacgagcatctagcaggtactgaaaaataaatccctgctctgctattcagaaacgcctgaccaaaacggtttagaaaaatggaaacatatttatgctttctcctattcttgttcacttcagaaaaactagcatggtggcccgcgcatattgcgcggttagcatcattatattttctctcatataatagcatatatgttttctcattatctc

SEQ ID NO: 48898 - DNA, 1501 bp, Oryza sativa
aggagaggaggcggaggtggtggtggtggtggtggtgaaatggagaggaatcggatggggttttgattgggtttggagaagagatgagatgagagagatatttgctgtcgtgttgggcttgggctttgatactagcgggcttcctaatccgattacacttgggcttcccattacggcccgccaacgatatgacgaaacgggattaattaatcatcgtcatgaataaataagcttggaacccatgggcgagcagcacgaaggaagatagattttccccatcgaaatctcgtcgcttcccccgggttcgattcgagtcttctctctcgcaggtatggtgaactcgatccctctccccgcgatctctctctctcgatttgtgttcgtgttgctatcaatttgaccggatctggtaggaatcgactgcgttcggtgctgaccctaatacgttttctcgattttgatcctgctcgtttgatccgattgggtgatagtagcagattgagtaaatttgttgattcgctagcctctgttgctggatcttgctcgatccttgctccctggtcgatttcaccgttcccggccatagcttaattggcctccgattccttgttccctagtcgatctggctgttccatcggcctcgatttcctcatcgtagagagttcgcccgccgcctccggctagcagcggcgccggcgtctttctgcttccaccgcatcctcgccggtgagcacccgtactgacattctcattctcttctccaccgacgccttatctcttcgccttagccttcagcttgtcttctagatctggaagcttttctctttcccttaaccttaaccttagtacttatagcaatttgattccaagaaaagatcggtagcaattccccacgttagttccgcccctggttgatataatccaaatctttatctctatgcgtgtaatagtatgatctatccagcttgttgtacatttttttaatgtgcagtagggtgctaatagcagtttgtattttggggtttaacttgacctctatgccccagcttgtgatcgcccctgctaacttctgttggtggatctttacatgatattattgttttttataagatagctgggtaggtctattcatactatacacgagagtccatagttaattcattaatccaaagtaattagaactgaggaacaggcaatacgcgctattactgttgtagttcagcaggttgaaacagaatatatatgaacaaaggttaggtccatggtagatttccagctttatgtgtggaccattatatttttgtgttgtaaacaacagtagcatcagatctttcttgttgaatgtagtatgatcatatttgcttcctgtttgtttactgttagtattgagatgtgccatatatttttggacttttgatggttttacctggccttctgatcaagttctttttttctgagttctttttaattgattctgattcttccttcagcagcacaaaga

SEQ ID NO: 48899 - DNA, 292 bp, Oryza sativa
ctttgtgctattaaattttcttcttgagctccgaaaattcacgaaaaattccggagagtattttagggcacaaagaatattgcaaaatattcccggccaatgatttttttaagggaaaattttaattctcccattacttcacttgattaaattgatttaacttttatttaatttctagaaaatgcattatttaatgatttttaatcccgaacgaaaatcggggcgttacagcgagcaacggaggctgaagcggcgtcccggcggcgcgaagaggcccttgaagcccgtgcca

SEQ ID NO: 48900 - DNA, 232 bp, Oryza sativa
aaagaaacatgctcatagacaactacagaacattatttactacaggcagattagttgcttacttgttatcttttatatgggatgtaatgcgctccaaaatgatctgcatatggcctaccatcttttgctaccactgaccattgcacgcagcctaccagttatatcttttgctatgcataggcatatcatgtaatattactgatcatgatggctatctgctatatttctcagt

SEQ ID NO: 48901 - DNA, 1501 bp, Oryza sativa
cgtgagcacacgctcccccgtcgacagtggcaatggtggccccaggttcttggaaacctaggtcatcatcaccgtcatcgatgtcaacggcgggggccttctgtctggcctcacttcgccgtttaccggagggaactgccgcggacttgccctcacggcgttcctgcctcctgtcctcctcccacttcctcgttcgctcagccaagtttttgactgcgcgacagtccgcgagatcgtggagggaggtgttgtggacggagcaccacttgctggctgggcgctccctgctgggagtaccagcctctttctttttgtcgctcgcaggcctcccctttcgggtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcaatcttttcgagcatgcggttgtgccgcacaccccccctgaacgcgtagatcaccgcgtgtgcagggatgcaaggtatagtattgcggacttggcagaaacgctgaatgtacgagcgaagggactcatcatcccctcgttgtactgcgtgcaagtccgcttcttcacctgggcgtggataggtgccttgaaagttcatggtgaactgctggcacagatcctcccaggagtggaccgacgcgggtggcaggttcattagccaaccccgcgcctgccccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccaacaccaccaaccgggggcacggagggctgatcctcacgtccatgtcgaggtgacgccctggacgaagaggcaccctccgttgcgcggggagcacgccgatcactacgtcggcgctcgatgtcgaggcgggcatccggctcttcatgctgatcctcccgagtcggaggcgccgacgagggagtggtagccgaatggcgtgcagcagccgccgctcgccgcgccctccgccttgatgacacagagccggtggtggcggcgccggaggtcctggtagcggcggaccgtccaccagcacccaggcgctgctgtgccgtcatgaccaagttggccacgtcgtccagccatcgctgggctggagactccgggtcagggacgacgggcgggtgacgtaggagcgcgccagcagcctgaagcactccctggggcgtgctgccgtcgccgtagacgaggaggcgtcgctccccatctcgccg

SEQ ID NO: 48902 - DNA, 1501 bp, Oryza sativa
aataaggtgaaatagaatcattcacacctaccgagaaacagagagcagaaaccgagattactttgcttttcgtacaaggaaaagctgcaatatggaagaacgccaaagggaactactcctatctaattgaccaaactgattaaaaaaattaaacgaatgggatgtgaggtactagtggtttacattcatcatggccttgagcttctccttggagggcggatcatagtgcggccctggtaagtacttgttgatgtcgctgccacaacagccaccaagaatcaatcagggaaaacagatacggataacaagaactcatcaggaatttggaatggatttggttgctcctacttgtagacgcagaggacggcgatgtagacctcctcgaaggtgagggcctcctgctcgcgcttcttggtgtcctcggtgaggcggtcgaacaccttgtccgtgatcttcctcacctgcttctccttccattgcctccctgcaccaaccaattcgatccatatttcattcaccgcacaaacccgctactttcggatcgagcgatgcaggacaggaggacgcgagtcgattggtgatgggaggcaaggttttaccttggagtttatcctggagagacgcccaggcttgccccatggcgacgtcggcggaggagacgccggagtgggatgagatgggggttttggaagggaagaagataggagatggaagtatctccctctgtggtttgtgattctgatttactttagcctaatctaatcatgtgaacaatctctctctctctctctctctctctctctctctctctctctctctctctctctccaccgttgattttgggggtttgttggaggcctatgctaggggtactcgtgaagtgtacccagagatattcctctcctcacaacacgggtagaaatgcaaaaagtcgatctataatgattttttttaaaaaataaatctatagtgatattcatttgtatgaaaagctagtgatgcacactaatttcttttccatcctctagttagctttcttcttctgatggaacttgccatccatatttaagttatacacttacacatatactcgtatttacatcgaattattgtttcggtagtagttaatgtattttaaaaatagtgactttgttaatcttaagaatgtgttggaagaatgtacgtgcatgcttttatatcagtaagtacatgcgcgtttgcataagcatatgcatcgggaacttaatctatatacacaagtcttcccgtgtacataccgtacataccaacttaaaaacatatcataaaatattctatacagaattgtacaggtacttttagtagtattatatctatgagcaaagtttcattttcaaattcattgtatatagggagcaacaaaatagataaaattcagggaatttatattcttaaattgtcaaaaaaaattatactttttaagactaaaatataatgaatttgatgttaagattttatacat

SEQ ID NO: 48903 - DNA, 1501 bp, Oryza sativa
acttttccttgttatattattaaaggaatagaaaaaggagcctccgcgttcactctcatggcctagaaattctcacattaatcggagaaaaggaaaaaagcagagcccatatagaaatacaatttagaaatagttaaaattcggaattaaaaaaataaggaatattagaagaggagactagagtccatatagaaatacaatttagaaatagttgaaattcagaattaaaaaataaggaatattagaagaggagactagagtccatatagaaatacaattaggaaaaaactgaaatttggaattaaaaaataaggaatattagaagtagagtatagagtccgtatagaaatacaattaggaaataatagaaattcagaattaaaaataaggaatattagaagtagagtatagagtccatatagaaacataattaagaaaaaaaatagaaatccagaattagaaaataaggaatattagaagtagagtatagagtccatataggaatttaaaactaactaaaattcggaataaacataataaaattaaaagtagagtttagagtccgtataaagacacaatttacaaataactaaaattcaaaattaataaaaacatgggaagaagagtttaaagtcaatataggaatacaatttagaagtaactgaaatttgaaattaaaaattaaagaatattgaaagatgaatttagagtccatatagaaatacaattagaaataataaaaattcagaattaaaaaaaaagaaatattaaaagacgatactagagtccatataggaatatatataatttacaaataactaaaatttgatattaaaaataattaataactaacacgtatataaaatacaatatgaatattacacattagtagtttcgtaaagttattgcaaaatttaaaattatgttgtcattgtaatatattttaataatactagaaaaaatgccagtgcgttgcgacgggtaaagtctattttaatcttattattgttatatgctttagttaagatgaaattcactgtgggagtttgcttgcatatataatttttttagaaaatcatgagatgcagttaggagttcgatcgtttcaagttagcatgtaagtttttttaaatagatttcttatatgattccttctatattaccaaaagtgaacgatcttaaaaaccgactcaaatacagatatgtatttccaaaagcaaaggaacttaaaaaccgactcatgcatagatgacgtaccaaaatactagcaaaaacacggatgaccgaccgcggaaacatcttcaatttttataaccgactcaaacacggatgatcgaccacggaaacatctataatttttataatattagagaagagatatagattaaaatcaaatcataaaattaaaaccgacttaaacacggatgacggaccgtggaaacgttttcattttttataatagtagagataatgagaaaacatatatgctattatatgagag

SEQ ID NO: 48904 - DNA, 660 bp, Oryza sativa
tatagtttgcataatttattcaatctatgtactcctatattcctgcacagtaagaactttatcaatgactgttgtgcaccaatttggcccattgtcacacatgaatatatccactggctgcatcatgttaaggagttggaactcgctgaacttttgagttaactgctgttaccctgtttattattacggagtgctccatccgtccagtccaaattagttgttttaggatagatcacattttattctagatatttttctttacttattctagatgattactccgtgcaagagaggagcgattagagggagagacgagcgatcagagaggagggggagggtgtgtgtcaggtgtcaggttttcacctgtgtcaatccgtgtgagagaggagacgggttatcattaactaggaggaatcatttcttgttacaaggtgtcagagagagagagagagagagagagagagctagagagagataactaggaggaatcatttcttgttacaagaggtgtcagagagagagaggagacggctaaaccacgcaagtaaccagctcgagtatataaacgcgggttacataaggagtctcacgcctctcaccccaccccacccactcctccgacgagagtagacgagcagagcaaaagccggccgccgggca

SEQ ID NO: 48905 - DNA, 409 bp, Oryza sativa
aaattttgagatttttcagacaaaagttttcatatttgagttgaaattttctaaatttgtgaaggaatttctagattttgaattaaaagtcttcttttgaattcgagacaaaagttttaggattcttgtggtcatgtgatactggggaatgggaagctctcgcttaggtggagacatgcgcactgcaatgggctctcgttcacctgcaacgctcttgcaccaaagctctaaactctaatcggggtgcgcaacttaccgttgtcgcacgtattcgctagctagcatctgttgttagtacgttaaccatatttttaataccttttcatttgtatcttatcttacatcgttagattacaagtgatcacaatggctctcctacattcaatcaccctacaaagtctcagtcagt

SEQ ID NO: 48906 - DNA, 420 bp, Oryza sativa
ggagaccttgcgaccgtgtactgcttgtatttcgatatatcagtcacacggtccatcttgggaaaaacgtcctcgatcttcatctcctttttttccctatcttcctatccaaactagtgtgtaccccttgacaatttttctcaatctcattcatgccctatgtggagattatgggtaccccatacccacacggcatggttatccgactagttataggggataacttatatatataaaatatgtaacagatcatgacttgggtattacgtttccctgtatattatggaacagcctaaagtcctggtttgataagattgtaaagtagatttaggaaaccgataccgtattggttaaggtttctatcttgtaaccctgccccccaacctatataaggagggcagggagccccctctaggggca

SEQ ID NO: 48907 - DNA, 233 bp, Oryza sativa
taataatagggaggcagcaacatgaaagcgtaagaagaatacgtcaagtccacacgaaagcggtattcgatggggacaaaccaggataaggcgaactttccggcgggaagccaagccgagctctcccgcctctcccacggccacagccatggcggccgccgccgccgccgccgccgcgaaacccaaccttcttcttccagtctccgtggctatcccctcttctagggtttctc

SEQ ID NO: 48908 - DNA, 1501 bp, Oryza sativa
gcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaactgaatacttgtgccagtcggaattcaattgttatatctattttggagtatcccataaaggataatcactcagatcagaagctattcatatgagctacacttggtctatatcacccgaaaagatttattactcgggagcatgttacatgcgtcatcctttaaagggtgtcgaaggcatattttttggcctaggcctaatatatctgcagcccatattttcaggtgtggcctgtcacgttcttttagggacttaggcactttttgcttaggccaaagtgcgcgtgatcaattgcccaataccttaaaatccttttatatcgcagttactcaactttttaggagttggtataatgcatcttaaaaggtgtcaaacagtaaagctttatatagctgccccgctgacttttttatatagtcatggtgttgtttgggtttttaagcaattgattggatacaatatcattgctttttgccacgtaagtgtgcatttttattgaccaatattatggcttaggctgattatatattgtggtcattttccaggcggttggtaaatcctttatgagtttatttactcagattttatacctcatatgccatatatttccaggtgtggtggaaccatgtgtcttctagggacttaagcacatctgttaaagcagtgtgcgcatggcgtatgcccaatactatggaaatttctttattcacaacatacaagcttctttatagctattttgctatgtgaattttcaatgatgtagccaactttaggttacactcatcatattttacaaagcagtcggtatatcacttggatcatattattcagggattcataccacatatgctacatattaagtcgcttggttgactacaattatcgaaaccactcggtgcatctagtcgatgcacctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatataaaatatgtaacagatcatgacttgggtattacgtttccctgtatattatggaacagcctaaagtcctagtttgataagattgtaaagtagatttagaaaaccgataccgtattggttaaggtttctatcttgtaaccctgccccccaacctatataaggagggcagggagccccctctaggggca

SEQ ID NO: 48909 - DNA, 431 bp, Oryza sativa
ccgtttataaaaaaaaatcacatcaagtatacttttaattttatttttttagtatatattttgtagttctagaaatttattgcacactatactcactttactaaactatgtccatgttagtttttcttatcaaggcatttatcattaatttatatcaagtctatatatagtaccgtctttttttaagaaaaaatacaaagatttttttcttaacttcatacccacattttaaaaatctttcatccaccaccgtattacactagtgatctaaactagttgacatctctttatcacgttacacataagagtatcatctaggtattatgtaagaaatatatatagcttagaatcaataaacaaccaagacatcaacatgcacacaggatcaaaggccaaacataaataaaacatttgatttcatacaacaacaa

SEQ ID NO: 48910 - DNA, 622 bp, Oryza sativa
gagcggcgacatcggtattggcattgtcagcaactgcagggagaagaggcgtgcggcggcgtcggcgtcgtcaacgtgcagcgggaggagcggcggccgcccggaagtatctaaaagtaccctatttctatcgagaaagtatctcacagttcatttacataaagactaacccattaccccaaacataaatcacttatccatctactccgtagctagacatcagaagttcgtactatccatagaactagccatatgctcgtaaaaaaccaaaggacaaggttctatgcatcaccgaaggcttctactagctctactgctctccatctcccatgccccttgtcacagcaagagtagaaagagttatactgatggtgtaagtatagtatagggtaagtataggctttatatagggcagtttccttcagcctaaaggagaacatatgtcccagattcatgatgagctggataggtagataggtttccccctctctcgtcctcacctcaagagtggttgatcctatccatttcatcaatacacagatatatttgtctgtcttcctctccaaaataattcaagagttaaaacagattgtacatagttaaatgtcatgtatagtactat

SEQ ID NO: 48911 - DNA, 264 bp, Oryza sativa
gagatcaatacttttatggtttttgcgcgaacatcgtcttgggggtaaatcgggtgtaaagtgaaagtcaccaaaaagtggcggaatgctttcgaaaccaattcacttgagtgagacagaggagagtggaatttggtgtgtaggggtgaaatccgtagatctacgaaggaacgccaaaagggccctattttaggacatacaatgcattatagacgtatgatcacacaccgcccgtcacacctggggaattggtttcgcccgagc

SEQ ID NO: 48912 - DNA, 193 bp, Oryza sativa
ttccctccgccccctcgcgcgtgcggtccacgcgcgagccgtgaggctgcgcgtgggcccgccgcaccgcgtcctccgcgaaccgcgcgcatgcgccgcgcctccctccccaaaccctagcacgccccgcgtgcacctcgctcacggtgagccgagtcgccgacaagcgggtcccacccgggaccacgcggga

SEQ ID NO: 48913 - DNA, 776 bp, Oryza sativa
tcaattgaaatcatttagtatttgaaaatgttttttgaagttgtcatatttttaaattcaaattcaaattgttcaaaaaaatgttatattaaaaaatgaccaaactaaaagttgtaaatattgataagttatacaactttgttgttgacattttttccatttgaaatcatttactacccgtaaaattattttgctataatcaacttacaaatataaacatttcatatgaaaaatgaaaaaatagtcatcggtgacgggttttagttaatgcccgatagagattaagtatatagcccgtcactgatgagtcatctatgacgggcctagttgttatctcaaacgggcctcaagttggtgcacgtcacagatgatggtcatttgtgacgggccacaacttgaggcccgtttgagatatggaatggactcgcaaacggtcctacagttgtggcccgccacaaaagaacttccttaggaccgggcgctatttctaggcctgttagagctccctacagatagaaggatctgtactagtgatcattggtgggccccacaaaaaccgagccgagccgagtccgcacaagaccgcaagtcgtcgttcttatccatccactcggctacatctctctctccttgtctctttcttctcctcttctcctccactcggctccatcttctcctcttctctttcttctctctctccttatcccgggcggcgccatggtgggaggggacgtgcggcgacactcggtggcgtgaggtggcgctacggtgggagg

SEQ ID NO: 48914 - DNA, 719 bp, Oryza sativa
tggctttgttttgttagtgttcagtgtatgcctgttgaataaagatccaagattaccttacattcctaatctggctatgcagatgctcaggattattgttccacttcagattaatcaagaatggttatccaatacatgtagaattagtttcacatctgtaggaaatgcagttccagggttttgttcttcagcagtcagttcggaacctctgaagtgaaatcctgttacttcagtggtccaagtctacagatagctcaattgaatgattcaaaaaatggctagacatttcaattttgaaacttggattcagagtttcaggttacctgaaacatacatactgtacatcccaagtccaaagcatgatcctgcgcggagtgcgggcggacaataattgaaagaattaacagctgaaattttcaacacataactaaattttgacagcaaattcgaaaagtcataactgattatgagggcctttcatgacaactcttttgccccagactcaagcctccatccctattgaccactggttggtgtaacatgtaccagtaaatattaagacctactccaggattcaacagagcaattatttttgagactctgacaattatgaaaactcagttgaaccatactgtataccctagtgaaaaaagttaccatgactggcctgctgctgttcattttcgtcagttaccctcatattgggcaatggtcatagg

SEQ ID NO: 48915 - DNA, 662 bp, Oryza sativa
gatcagatttagtgaaactgtaaaactttaaccatcaatagcttcttactcacattactacaaaacatcaaattggtctcgacactataggtgccagaagtgctaaatctgacacatataggccttttcgcacatgtgggttgaaattgcaaaaaaaacgacatctttaaacaattataggtgccggttctaaataaaaaccaacacttattctataggtgctggtttttattaaaaaaccgaaacctttaatatgtcaaaaaacggcacctttaatccactagaatggataccctcatctcaatcgggcggtaagccccatctcaatcgggcatggcgtccatcacaggctagaagtcactgatgtgatgagctatctcaatcgggcaaacggtcgtcacagatgattctatctcaatcgggccctaagtaaagcccgtcaccgatagctttgacccagacgaccaatcaaactatagcccctcacagatgacctatctcaatcgggccacaactataacccgtcacagatgagtcatctgtgacgggcattagctgaggcccgagtgagagcggtcatcagagaggggcattcgaaagataggtcgtctgggtctttgcgctcggcgtcggtcttgtgcacccacgcggaagttcaaact

SEQ ID NO: 48916 - DNA, 642 bp, Oryza sativa
ggttaaaatatggtttattatttccatcggttaaatagtttttccctctatttgattgtgtatatgtgttctacatttccaaataatgttatctgagccgtttgtattcaataaacaatatacatattttattgtagtttgcctaacagttttttctttttatgttttttccctgttcactcaatttaatataattattagttatgttttctaagaggttaaacgtccttaatatcatactgctacataaattacatggatattgaaaatccaactgaattacttatgtgtttgtttcatatttttattcatcacaacaatcagttttcctttttagtccgtgtgagcgtatttgaatatcttttgttatgtgcttaaaacatgagcatgaatgtgtaaagaccttactcgattcttattagatctgttgacatccctaccccataccgtatttcatgttgccacaattgatgtagcaaatcttcaaagatatctagttgggagatagtgattttcataattttctatgtagcttgaatttagctaggccccattcttgcacttttattttcttttcttttttaaaagtataatatttgcatgtggtggattccttgacgcaccaaagaccacaagcagtga

SEQ ID NO: 48917 - DNA, 1387 bp, Oryza sativa
tagtgcatgtctcataatctattatacgtatatttgtcatttctatagatagatcactctacataaatatatcaagtctgattgatctcggttaattcattatatttggtgatcaattattatttgatatatttatctagattaacctgtttatataagtttttattggagtaatagccagtacattatctattctacctctaaatattggattatcagctatttcctaatactgtcaaaaggtgattgttaaaaacaaaagaggtattgtagtcgatagtacatatttagggttttgtttcacttgctcatcataaagccacatcccatttggtttaactgcatcggctaggtcctgacgatacgttatcagttctatcggccgatcggctatcgttcatctaattacgttttgttgcaggatcaaaccagctcgtatgctcttgacactcgaggcaagcctttgaccagcactggagtgaagcaaaatctcccagggcaccatgtttcgcatcaacacttacgtcagagtttttttttttatattaattgatctctaagcctaataaaatgtaaaaaaaaagacctatgggggtaaggccacctatttataagggctatggccaattttaatatatcatagccccgaccttgacacctacacaatcgaatcattttatacctttaccttttcaccatattttctaatttaccttagttccatccaacttggaacatttccatcgtaaaccacccgtctttgttgtgagagtgtgatatccttcgtagctttgtcccgtaaaccttcgattcacccacgagatgggtcattatttccgtattgatctaaatcagcttttagactggtttaatctctaaattggctctcctagccaattttgatcttttgtgaactcatctgggttgagaggttttcaagttggaacgttcggtgactcaattaaaactataaatctttagccgagtctatgttggtaaaaaaacgtcaatgcaaatcaaccatagagactagttccattgtttcacattataggacgtcttgggtttttaatagatttatgtatagatccatatatgtgcttcatatttatatctatattcatatgaatattagtgaatctagaaaagggatgagaaaggctaaaacgtcttaataatatggaatggaattctgattaccgtgtctattgatattgctcatccattccataacagagttggttagaaagacaggctgatagagttctctgagtctcaaacggcatgtcctatacagagtagttttttctttaaaagtaaactactgctagcttctgccaacagttaacaagtgtttctctagctagttaaatttctgttgctacga

SEQ ID NO: 48918 - DNA, 1501 bp, Oryza sativa
ttagctataaataattcaatacagagaaaaattataagttaaaaataatttttagtggatcaaatagtgctaaaactaaaattgtaaatgaaaaaacaaatgaaattagctagaaattgaaaaagcttactttaactcatagatgaaaatttgatccattaattccgaacgggtgcccgtttcattaacataaattagaattttcctattatattcatattactatggtttcaatattatgtgagtgattcaggagcatggttaggttggacaaagaagcaatagcacccaacaggcattgtgatcgtctttcctagccaaaagcgagaaacaaaaaggagggaagatggatgctggtgcttcggtgaaccaataatagtaagtaagatggtaggatgtgtcccacgatgtgactcgtccatagatgatggatattggcaacgaagaaaatcataacagcaagaacgtgaccgataatgacgtggtcccgatagagagagaaactacaacggcgagttctgacgatgaacacgacgtgaatacaaccggtacctcgacggttcatgtaaaatataaatgcatgtgattacgtcagtatgcaatactggtcatcattgatggtttcaattattttatctatatttaaacaatattcttttcttattaagattcggattttaccccaatttcaattagcacgtttttcaaactactaaatggtgttttccgtgcgaaaattttttatacagaagttgctttaaaatatcaaatatatccatttatcaaatttatgataatttaatttaattaatcatgtactaataactttcttattttatttgcatctacttaatcttcatctcaccagtttcgaacaccaccggttacttttagcatttaactacttttgtcagtttctgctgctagtccagcatataaaagctcaaataccacatgatttgttgcatcaactggtcattacagttttcatagaccgtccagagggttaatagaggcagtctaatcctttggaatcaactgatcgatacagttttcaaccagctagaacctactccccccatcttataataaatttatttttgactcctcatttatcttaaaataaactcattttttaagtaaatgtatcagagtttgtgaaaataagaaataattatattaaaaataaataaagtgaagaatatctatattgagatttgataaagtaaaagtattcttatcttttaagttttgtgttgatgtgtgagataggtgaaaaaataatttattttggaatgaaggaagtattagagaagcttagtgatccgataacaaccgtagtcaactaagaaatcttaggttacatccttgcccaacccaaaagagaaaaacatcgagtgattcaaactgccacgttatcaaaagatcatactcatagagtacagatcctgaacagagcatccttgcctgataaagttccattttaagctgcaaacttagg

SEQ ID NO: 48919 - DNA, 533 bp, Oryza sativa
tttgccgtgacatatctcatgagttgggacgaggctcatgtgttgggcagtcgcggagtgcgggtaaagtgtacatccactgcagtgtgagtaaaccaaatctattcgaatagtcgtgctcgtggttattgagcaccgggacatgtattacacttggctagactctaaattcttaaattgtatgggatgggatattgcataatgatttctatgctgatggagccacttcccgagaggcgggaaggtggacgtcctcagtaaaccatgacgactcaatggcgggaagccatccttgggatcataatggatggtggacagaaccgtcattgtttaaatatgaacactggtactaaaatttgatcagtccgtgctaggtcttagggctcgtgaaaagaattacaaaacttgctttgcgcaaaagaactatagccaccctttgaatacccctgtcatgtgcattgttgctgtggtggcttgctgagtacggttggtactcacccttacaatatataaacttaatcagaggtcggaga

SEQ ID NO: 48920 - DNA, 1159 bp, Oryza sativa
ggagtgtgggagtgtgggagcagccggccgggcaagggaaattaagcaatttggcatgtgtcggagactcgggagttgccaaattggggttgccgccggaaaagtgataggactatatttttgccgttccggaagatgacgcggacaccgcgtgtcgtggggcattgttcgtcaaattttctaaaaatttgacaaatataattatagtataatcatgatctaattacaccgtatcttatatgtaacttgtatatcactttcaaaaatttcttcgtaacatgctatttcggtgaagaggtcgtgggaacgaatcctcttgcatatatgcgcgcaatgacatttttccttctttagttgcacaaatcttgaaacaaatctaacggttcaaaattatgtaaaagttacatacaagttgcattgtagttacatactagttacattacgattgtactgtaattacatccgtcaaatttttaggagaaaatttgttgataaatatacagcaaaattgcatatacgtacatataatatttatatgtactagcataacgtttgtgtattgtaatagattctagataactttcattgacataaattaaaatcatatatcataattcggcataaatgatgaaagaaatataataaaaaaataacgacatgaaaccacaaataagtttggtcggaatgataatttaatattaaaacaattatataactaaatccccttttttcatttagctataaataattcaatacagagaaaaattataagttaaaaataatttttagtggatcaaatagtgctaaaactaaaattgtaaatgaaaaaacaaatgaaattagctagaaattgaaaaagcttactttaactcatagatgaaaatttgatccattaattccgaacgggtgcccgtttcattaacataaattagaattttcctattatattcatattactatggtttcaatattatgtgagtgattcaggagcatggttaggttggacaaagaagcaatagcacccaacaggcattgtgatcgtctttcctagccaaaagcgagaaacaaaaaggagggaagatggatgctggtgcttcggtgaaccaataatagtaagtaagatggtaggatgtgtcccacgatgtgactcgtccataga

SEQ ID NO: 48921 - DNA, 357 bp, Oryza sativa
aaaaataattcattattgcgtcataattcaattaaaatccttataagtgttttaatccgatttaatctttaaaaattcataactaattcatttgaactcagtttaatgtggttcaagttgcaaaagttgtataaaataaagatctacatattaaaattatccataaattggattaaatttatttaattccttttaaatgggctttaaatagatttaatcttgtaaaattcataataaattcatatgaagtcagaatgaggccgttcaagtctcataattcatctaaaattttgatctacatgtttgtttactttttatgtattgtttatttggtttttattagtctttttcttcgtt

SEQ ID NO: 48922 - DNA, 202 bp, Oryza sativa
aaaacccatttttttcttgctgccgctgctgcttcggcttcgcatcagtaatctttgacccgtcgctcgctcatttccttgcgacctttgcccacattcttcacgtttttacctccccgcccgatacaaaacgcctctcctcaccacgccacgccacgacacaacgatctccctctcggcctcctgtgtcgccccgtcggta

SEQ ID NO: 48923 - DNA, 1501 bp, Oryza sativa
ggccccttttccatttttgtttagggttaaggcaaaaaaggcttgttgacccttgggttcacccgcccgggccccattacttgcaactcgtagaggctgtaagtaaacagtgccccactaaattcaaagtgacggtggggttgaaagacgagagtgcctacctccgagccgagagtgcccgccctttctgtcaagtaggctactttttccggaacgcagtccggaataagcgttcctgtgtatatagatatcttcgatgctgtcatttcgaaatgtccgcttcaacccctctttcacctcccaaaaagctaagttggcttgacgagcgcagatgaggagcaataaaaccaagaatctctttcttttccaaatactttattaagttaaggggcaaagagaagcgcttttgctactgagaaagtgaatggtcagcgcgagggttcgacgacttagccgagcgttagcgaagcgtcattctcatagcgaggcgcttcgagttagcgaagcgctgtagtagcgtcggagactatgtgctataatgctgaactaaggacgttccgccttatctatagaagcagtcaactgagttctgaacgaatgggatccttggtgggtaatggctcaatcaatctatagatggaaagccttatgatgggaaactaccacgttaggtttggagagagatgggacctgttatagtttaaggggagcagatgcaagctttttctttccatagccggccaaatgactaccggatcatcggtctactctacctcaattcaccatttcgaactttatacagaaggtttttccgtaccagctccttctacctataccgcagttgaagcacctaaaggtgaatttggtgtctttcttgtcagtaatgggagtaatcgtccctaccgttgtaaaataagagcacctggctttgcccattcacaaggactcgattctatgtccaaacatcacatgccagcagatgtagtcaccatcataggtactcaagatattgtgtttggagaggtagatagataggacgtagtcttgctcgatcaggaccctagctttattgcgagccaaaacagcctgaaagaaagcaagtgtgccatgtaaagccatgcctgagtttcagcctttcaggtgatagaagggccatccacttcaactctcgccctcccttttaggcatttttttacagaggcgtggaattggcaaaagaaaaaactacaatttggtaataaaatctacatggttagaattgccataacgactatattgaggagtttctgaaacgagaattctcatagatgatacgaaaagcaatgtactaaaagcaggaaagtagcagttctgggaaagtgagaaagcaaagagaggcacgtttgttaacaaagcggaaccaaagacttctgcctacagccaaacaaaacttgcaactatattcaataatgcctgaaatgctagtaaaccaaaccgctccagatgggcttcctaccggcag

SEQ ID NO: 48924 - DNA, 1006 bp, Oryza sativa
cagtatgaagaatcaaaaaattgcaaatttgctggttcaaagaaagttcaaactgacctgtcccatctcaacaagtttctatttgacagaccccaaccaaaaggaacctggattagctttttttaaaccttgaaaagaaattcaacaagattggacgtggcttaggcttttcgtgcactaacacatgtcaagactggtacagctttttcttttcctgtattaactcgtgtcactcatgcacatgtactaatcagttaatacattcaaacacatgaaaaatgaaacagattcaatagaagaactcacagccaatacaagcgaaagaggaagggcggaacatggattgcctttttttcctaactatcagaaggtcgttgctgtctttttcgcattggatttctttcacgagactcggaaatcaagaggatgggaacgactactgctcaaacgcataggactgaaaaggagggagactctcaaccagagccgttagcagaggaaatctttctgcctggatctggaaaggtccgtgccgacgacttctgtcacaatccagatcttaaaacgacaatatgcatttctcaagactgaatgatattctcgtctttgagagaaatcttcgtgcttatcgatttccttacttggatgatttggcagttacactatcagtttcatccatagctgatcgatatacatctcgggcagtacgaacgaacgacttccaatagagcgtcgatctatccaaatttagatagaacggaaatagacttgtaaggaacagccgtcgaggcagtacgaccagtagcctatggcaccaataaaagacaggaagggactagatagactttgaatagctcaaacccgaaagaacacacgttttgcgaatcgaccgaaccagatgaaatgccattgaaggaacgttgaatgcgataggggcggtagtatctacatcccatctgatgatgaaatttatcccaacggaagcaggagtgggagtagagtccgg

SEQ ID NO: 48925 - DNA, 304 bp, Oryza sativa
taatattcatatgaatatagatataaatatgaagcacatatatggatctatacataaatctattaaaaacccaagacgtcctataatgtgaaacaatggaactagtctctatggttgatttgcattgacgtttttttaccaacatagactcggctaaagatttatagttttaattgagtcaccgaacgttccaacttgaaaacctctcaacccagatgagttcacaaaagatcaaaattggctaggagagccaatttagagattaaaccagtctaaaagctgatttagatcaatacggaaataa

SEQ ID NO: 48926 - DNA, 1501 bp, Oryza sativa
gatggttgtagctgtcatcaacccggagcggggccaaggagaatcagagcaggtaaggaaacaggcactaggtgtggcacaagcccatgaatcaccccatttgatttagctgtttccagtatgttagctaaagcatccaccactagttgaccaccaatagcagttgtgaaactagtagctctagattgatagagccggacttgcttcattagttacatatcctgttcctgaaagaactccagaaggtgaagatccagcaggaggtggtagccattcttattgagaaagataaagaaagcaagctgtgttcccaacagcgaaggcaaggaacttctgtatgagaaacatttcctgggcgggcggagatcttgattgaccagaaaagaagcaagtctatgtcacaagcagggtttgatggcacccgctactcttcccgaagagcttctattccaatagcggattgtttcattccaatcttcgagagaatgcgagcgaattcaagagcatggaagctacagaagatttttccgtaaaggatttctatttcaagagagcagatcttttacatagttttctcggttctcaggttagtgacttccttcccagtcatagatggtcgacagatcttttggattggtggttttaagagaagtcccagccgtacgcactagaataaccttgaactacttgaacgacaacagatgcggatgaactcgcttagctgctcgctcggtgaaaggctttcctggaagaaagttgaagacgacttctaaggaacgtatctctcatcttccttctcacctggcagaggacggggatgaactccaaggccactggtctggaaaaagagctaactttctgattactgctaaaaagcaaaaaaaccagttgggtgattctttaaagagcctaaatcgaatctgtactattggtacagagccataaagaatggtcgtaaccggaccagatagatccatcatcttcgaggaggaggaaacataagtccaatacgcgttatggaagactagggattgctaatccgcccacgcgggaagccttctccctctcagactcaagagtcaagaccctaaacaagaagcagcttgttctttcgcgctagtgcgctcaatccgttgcttgttcctttcctttggatttattatcataggtagtgttcgagatcgcctctgtgcggtgaacgctcgaatgtagctaacatcagttttgtcctcgcgtggttgaaggagatgctgctgctggatggaatgcttccgttccggggcgccatgatccttctatcaggaataatcgagggcactgactgactgcatcaatcatcgctcagtgagctattaattgccgccaatagcgcttcgcttgcatgcaaggcggctaataaaagcgccaggtagacgcgcggagatgcattttgagtactggtggtactggacaagctctaggggaataatctctttcttatttctttcttatttctttccca

SEQ ID NO: 48927 - DNA, 467 bp, Oryza sativa
tgatttgtgtgagatgtgaatatgtgattgaattttgtagaagttgtgatgtaattttttttagattttgtgatgtatttgagatgatcgatttgtggatttgaaggcaatttgaggatgattgttttgggaatttagggatgggatagggttagggtgaaatcaatatattaaaaataatgaaaaattatgaagagaagaaaagaataaagaagcaaccggatctgtctctttataaccgggactaaaaatcgatttttactcccggttatttcacccgggactaaagatagcgatctttagtcccggattcgtagtcccggttgaaaaaccaggactatataggagtaaaaaccacttctccaccagtgtaaggaaaaacaaatatcgaattagcaggattatcaattaatactgtaactgggaacatatacagaaattatcacaattcataagtagtaaaacca

SEQ ID NO: 48928 - DNA, 633 bp, Oryza sativa
  unsure (1)..(633): unsure at all n locations
cattaaaacacactcttncantgtctattaacgtcgtntttaattatattaaanataanttnnccctctttcactttnggccgctttnatanaaaggngcncncatttannagcctgtctaaccaatcctcccccccccncncccccatgttttgtagacctctcntnnncncncgnnnnnnnngnctncatgtcgcacgacctcttaacattacaccactgaatccccaatcctttgcttgctgtgcagtgacagtaccaatatccactaatcgttgtttccagatacggttgccggttgacatctcttctaattcgtcgatacgagaagcaaattgttgtgtggaggaatcaatatctcgacataagccaagaggcagatcttgtgccactccaccaggtcgtatgaaactggcatgcatcctggctcccgggactctttcatagaattccaacaatttctcccgctcctcaaaagcccaaaggaacggagttgatgctcccacatccatagcatgagtagttgaagcaagtgaatgatttgaaattcgagttatttcacagaataacactcgtatatattgagctcgtaatggtacctcacaattcaaaagtctctctacggctgaagaa

SEQ ID NO: 48929 - DNA, 1501 bp, Oryza sativa
gggagggaatcagtattttttttcagcatgcagaaggcagcaggcagaggaccagcgtctgatatttcataaatatctgttgatgaaaaaacatacactggcctgagagatccgcttaactctagtgcaggtccaaagaatctgactattggcgatgtgataattctcttaagggattactaaatttcactgttaacaatatcatatgttcgagctatggcagccatgcagccttgtcgtgttggttatatttgtcctcccgggtgaaccgacagtgatattcatattaggtagtgtgtactgctggtttggcaaccggtggtgatagcctcggaagcccgtcatcggttttttctttagccggttgtgatccggttttgtatagtagtaaagcgcaatgtcgatcttaagagcatcatatattggtaattgtgctcatagaaaggcactttaattttctacattgtgcttgagagactaaagggatcttagttacagaattatcaaaagatgcaaacagttcgttaaaaaaggatgtaaacacttattggtatgtttaacatgtaatgtggcatattttcacaatggtgcataatggtgtgtcttttttcacacagaggagagaacaaaacagcagaatttgacaggagaaataagttgaaacaaaatggcatgctattgaatatataaatccaaaaaaggactaaaatggacatgctaacgatgcattaatacaattgatattagggggtatataaaaattgaagaggtaagaattaaaaaaatgttatgctaccatacttaaaaaaaacagaatatcactggcagagaagactatatcaacgcatgctatataaaaaaacatagacatattaaacaacataaaaggtcagaaatgctagtactgaaagtgtttcaagaggcgggtgatgaccgacttgtataggcgtttagtgaaccacccatgatttaggctctgtatataaagaggaaaactagggggcaacatcctgtcgtaggaacggtacaagttatgagcgaaacattaagtcgccagcaggtagctcattcacatggcacatgtccatctgaccatgtgggtattaccgtcatctacttgtgggcccactcgtcctctagaaagtataacgtgctcccacatgtcctatgcatggaaagggatgagccagccgtgccccacataacatgccatggatttatggccttagtttgtgcacctcttgttgctaactacaccatgcatgggtgccggttagctgctagcagtctaagtattgactacagtaggccactggaagcaattagaaaaaagcaatacactagtactactacttctttagacgtagtaaaattgtagatataacttcatatataatactaccatgcaatctaagtgacacctgcatattagtaccacctatgaacctcagttttatattgtatatttgacatctcggttgtatactatatagtggtacca

SEQ ID NO: 48930 - DNA, 415 bp, Oryza sativa
cggcctcttcaagaccgctacattactcgagcagcgcgcgaatcgggacgagccggtttgtttcgcctggggacatgatgatggcgtttttcgcggttggcgagcgcggttaatgcgcgcacgatctgccccatctcaaacgccacggccgcacatctatcgcgtgcgccgcaaacgggcgagtggggttagtggaggcgcgggcgcgagaaacgagggggcgaggtagtgggtgcgggaagcgaggagccgggcatagcgttggcaagggtacaaagacgccaaggaagggatttgtttccttcctctcgccactctcccccttgccttcgccacttgtgctctgactctccgtttcctgcgccctaaccttgccatactcgctcgctctcaagctcctcctccgccggcgtca

SEQ ID NO: 48931 - DNA, 745 bp, Oryza sativa
ataattaagatctgctccagagtgcagacctgcttgcctttgctgcggctaatgcatgttctgctgctgttgctacttgagcgaccagagagaacaaaatcacaaagaaattagtgaatatcccttatattatcggacggaggtagtattaaggttaggtgtcctaaataaattaaaggttgtagtcatcgttgttatctttctaattaatagggttaattcactcaatttcaataaataggttagaagaaattataataccccagctcgtttcgtttgttttggcatgtgttttgttgttccagtttagccctgttaggcccaagtgctcaatttacgagaatcttgatagatttgagccagcttatatacccaggttactctaaccaaattacctttgggttaaccttttacatgaaggaggacaaaagtgtaagtaagttgctatatgaatgtgggctcatttagtgtgtagagtagactaaggcgaaattagtggctggggtgttacacaaaaatggaaacaatattcctgaccgggtccaaaactagatagcaattcattttcagtatttgggaatgatataggcataatttgccttactttcattgtgccattattattcatgtgattcattaattctttgatctttttatgctataattcatgtatcaacttattatgctgttccattaaaataccatgcatacataccgaatgtatcatatggttcttaattgacga

SEQ ID NO: 48932 - DNA, 193 bp, Oryza sativa
tcctaccagaagaaatgcacacaagcagcgatgagcgatcgcccccctactggtatccaatccaatccaccgatgaggtgggggatgggagtgagtgggacgccgatctccaggggaggggagagcagtagggggtgcgggcggtgctctcacctgaggcggatcgctggggggcggccgccgcgccggagga

SEQ ID NO: 48933 - DNA, 347 bp, Oryza sativa
gccgccggccgccattcccgtcgacgttcccgctcctcccgtggccggctcccttccccatcctataaaatgggatcctcatcccccgttctctcgttttagccccatcccgagcctccccgtggtccctagctccctccccaccgtcgccctctctctcccacgttgccggccggtctccagccgcctctcccgcctcgccggagcgtcttccggccgcgccgtcgcctcctccagcatcgcagctgccccctctccctcggcctaccctccgtttcgcgcggtgaccgccggaggcgcgttcccgccgtcgccctcctctttccttcgcgccggccgcctccagc

SEQ ID NO: 48934 - DNA, 1072 bp, Oryza sativa
ataggtcgggttgccagttcggtccgaatcatcgtaagccttgggttaaggcaggttcgtgagggttcacggccttgtttaataatactgggtagctctaggatcgtctttacaaaatggctttgggcaactaagtgatttttaaatgcggtttactgcaaaacttaatccctatattattattcccttgtacttcccttgcattaatcatgcacctccggtgtggcttgctgagtactgtggttgtactcattcttgctctatcttttcccccttcagtaagagaagctttggagaagatgtcttaggtggagtcctggcttataccccagttgagcgcctgtgaagatggagccgtaggccgctagtccgctgctgtttatttttgcttgtcaggcctgaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttatgaataaaactatttgcgaaagttcctttttctccttcccctaatgctatttgcaaaaggtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagtgtttcgtttgtagtgtgtttccttgcttgtgtgtgtagcgcatggtttgcatcggtgggttgtgatgtgaccatgctaggttgtttgtttaatcaacttgcagaataagcaaaacaaacaacacatcaacaaaaagagttagttcctttaaggtcttgtccctagttctggtctcttctttccttgtatgcttcctctct

SEQ ID NO: 48935 - DNA, 556 bp, Oryza sativa
ccatagaatcctttttccatgcccgtgctttgacctctttctacgcataagttaatgtcgatccaaaggaagccatttagatctgagttcaggaaggaagtgaatttaagcaagagagcgataggatagatataaagcttagaccaataggcatcttaggaaagccggtttttaggaaaaaaagtatattagtatactacctcttggagtttcagttgctatccattctgtttgagtgccatatagcttttcctattcagttctagaactagtggttacagcgaatgagcaatcttgtgtatatccaaggtaaagggcaagagactctgtcaattcatccaatgagtaagcaggacagtgaagttagaaatcctttaagtccctcttgaatttaagtaaactccggccctcaaaagtaaacaagttttcaagggtaggggtagcgtttactagccagcaagtaagataacaaagctctttttttcaataagaaaaagtagtagtattccacgggtctcaatggaggagaactttcctgttcatcctactgcatagg

SEQ ID NO: 48936 - DNA, 162 bp, Oryza sativa
ttacgtagatcatcgtaccaacgtacctcaataccctctatatccggtctacgggtacccaccgtcgacagtggcgcgccaggtagggggccttggtgctcaaggttctactattatgacatcaagcttcgtcaacaatagcgtcaacaatggagtcaagca

SEQ ID NO: 48937 - DNA, 580 bp, Oryza sativa
tccctactttacaattcagcaagtcaacaacccccatcacataagctgataagaacattactaggtcggatatgaccatggataccttatgtattcaacaatcaaaggtgcatactttctacaaacgatttacatgttatatatttaaagaaaggatattgtaccatgagttttgtgtgctttcatttgcagaggtacttacttgggtgaaggaaaagagaccgagcgcaaggaatcttggggcctatgagtacttgttagaagcttatggaatctattacagatggatttggtctcacatcaaaattcatcttagggtatcaggaatctgtaaaacaagccatgtgcctcatctagtccgagtctgatttggcccttgggccttggtacttgtgggctaagcccaagtgggtggtgccctagcgcaaccctaggacgtcccaaatcatatttattcagtagctatcatagtttagggtctgcgttgcagtttcgccacttgttcgatttgtggaacccaaattcaagtacttaatcattcatatgtaattgagttgcaatctaacttgttcttgctagt

SEQ ID NO: 48938 - DNA, 320 bp, Oryza sativa
tttgctgatttccctttctcttgtcaactacgctatttctcaggagtgcctacaaagcataacgaaagatcatgcgttttgattccatttattctcttgatttgatgacaggaatatatatttccatgatagacttgatctagtaggtggagcagcacaaacctgtgatctttcactggattcagcaggagataagtggaatgtgttgctgtgtttcatatagatatagtagagtggcgggaatagtatagtaagctatcctccactatcaaactagggggctatcccttttaggctttggattcttatcttcctacagc

SEQ ID NO: 48939 - DNA, 338 bp, Oryza sativa
gaggaaggtggtgacgacgtcggccggcgctccggggacgtggcagaggcggccggaggcggagaagtggtggcgacgccactggacgccggcgaggacgcgtctccggtgctttccccgcgaaacggagggctgaccgagggagagggggcagctgcgaggccgagggagaagacggcgcggccgggcggcgctcgggcgaggagaggaaggcggctggaggtggccggcgcgaaggaaggaggagggcgacggcgggaacgtagttccgggggtctcctcgcgaaacggagggcaggccggcgtggaggaggtggcggcgacgctggaggaggcga

SEQ ID NO: 48940 - DNA, 1501 bp, Oryza sativa
atgcctttcgctgcgcgcctttatttgcttcggaaatcaaacaatgcatttcttctcaacataaacatataccggtctttctctctagcctatacttgaccttgcgtacaagcctattatcctatcggtatgcctatgtgacccatatgtgctaaaccggtacttgttacttacttctatctattaaacgttaccggtacttagttaccgtgacttaatcatgcttagtactaaaccttactacgtagttcattcaagctatactgacctttccatgttttgtactcatcacttgcctcttcgcttagtgcactcgaaacagagcttcaagtaagatgtttgtggaacatctctatagcttgtcttacccacctcttttggttccttagaaagaaagcttcaaacagcaccattggccgaagcagacctggaagctgatctgcgagtgaatgaaattgaacgattaatatcgcctttcatgctaaaatcggacgatttcgacctttccggatgtcgattgggataagggtttgatcgagagctaggagattcggttgtttaacctaagagaagagatccagtttacagaggagatgccaggggcggtggctgttcaaggctaaggaggaaggcttgatttcttaaaaaaaagataagatccgactatcaaaccaaaggaaattgccaacaagagtagcttaaaagcacctagttaccgaggcagatgagaagaactgaacaagccaagaagagtactcaatcaaagcgagctttcatttttgcgggttatatttaaacttgcttttttttaagcacactacacactactttctataggacagggtcaggtaagagaggacgacaagccaatggtaaatccgagttggaaaaagagatgcaacacccaagtcaatctatgaaaaagctggcactcatcgctacaggcactcactttctttaggtcccagaagagagcaaatgctaaatgccaagacaattcaattcaattatatgataaaagggccaaagtgttgaaagaggaaagagggaggaattgatacgaaaagcgtaggaaatgtaaaaactacacacaccacttagtaaaatatgctctagtaaattcaatactatatataggaagtacggcggacaagcctggtattgttagttaagctagtaaattccttccctcacttcactacgacgaggaaatgcattgggctagctatgatatttggctagatagagttgaatgtgaaacacaccaatgttcaagtgttgagtaggcaattagcaaggagaagaaaaagtttttcaatccaggagttctaatctctcctcctcgccgcgggtaattcgctgacttaagtcaatatgaaaaagtgtggaaaatgggtggttgtactttcatcgacgaaaggaacaaagaactacaacaataataccgatcaatagtttttctttcaatatctactggtgcttccatgtctcattggaccga

SEQ ID NO: 48941 - DNA, 411 bp, Oryza sativa
aaggctcagaccccagttgagttttgcctgtggagtggagctgaagccccgctaggatcgcctttttccgctgctgctgttttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctaaatttctgggcgtgacaaagtggtatcagagccaacttgactgtaggttgagccaaatggtcaaaccctaaggacaagctttctgaaaaccctatttgaaaaatgtctcccctcgcccttcggcttttctttgcgaaacggtttttcaaaattctcctccctgcccctccaattcctttagt

SEQ ID NO: 48942 - DNA, 1501 bp, Oryza sativa
tcatgcaaagctgcttctgatctattaccgctatattctgcctcacgtatatacatgcatatacatctgtttactctataaacatgtaaaccaaaattaaaattttacaagtctattactattataaaaataaaagatatttctgcggtccatcatccatgtttgagtcggttataaaaattgaagatgtttccacggttcgtcattcgtgtttgagtcggttttaattttatgctttggttttaatctatatcaattctcttctctatctctatctcttctattctctatctctactattataaaagttgaagatgtttttgcctgtattttggtacgtcattcttgtatgagtcagtttttaagtttatttgcttttagaaatatatatccgtatttgaatcggagtatttgtttaaaaaaactcgcatgctaacttaagatgatcggactcctaactgcagcttataattttataaaattacatatatatccaagcgaactcctacaataaatttcatcttaactaaaccatataacaataataaaattaaaatagacttcacccgtccaacgatacgggcattttttctagttactcactggtagagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggcccccccgggatctttagtcccggttggtagcaccaaccgggactaaagatcttaactttagtcccggttgagatttgaaggataccaaagattcaaagggttaggtttttctttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgattgattcgttgaacgagggaagtggaaagacaaagagggatagggagctcgcctcctttttttgaatcgccgaaattgtacgacgacccttcttgttccaggcatacgactctgagacgtgacggtgtcacttttccggcccggtaaagtgacagttatataaataagaataagaaagagaagcgtgatgttgtcagcaatcaaattatcgtaaatagatagtacggttgcgttgtttcaatttctgttcgtcggtccttgggttacgaaggtgtgggcttactaatacggagagggttccgaatgataaagtgtcatgaaagttcgtgaaagaatgttcttgtttttcgttggaaaacccaacgccacggccacaaaacgaaaaagtctcccgtttgttttgggagcagagctttaaaaagatatagttaccctatga

SEQ ID NO: 48943 - DNA, 1392 bp, Oryza sativa
aaggtgcaagcttgtgctaaggctattgactagacctctagggccatgtaatagggggatccctaaaaaattttacgaattaatacaattgcttttacattccaaatattgttgagagaaccacgcctttcaatgtgacatagttgtccattcgacaacagctggcgccgtccgtggggatacccagaccgaaagggcaaaatgggacccttctcgccacacgccacgcccttcgccatagtaccaataaggtacgtcgtcaagggctgcgggtgaataggtttcgccacacccacgcccttcgccatagtaccaataaggtacggcgtcaagggctgcgggcgaagagttttcgccacacgccgcgcccttcgccatagtaccaataaggtacggcgtcaagggctgcgggcgaagaggtttcgccacacccacgccctttgccatagtgccaataaggtacggcgtcaaaggctgcgggtgaagaggtttcgccacacgccacgccccacgccacgccctcgccatagtaccaataaggtacagcgtcaatggctgcgggcgaagaggtttcgccacacccacgccctcacgcccttcgccatagtaccaataaggaacggcgtcaagggctacgggcgaagaggtttcgccacatgccacgcccttcgccatagcgccaataaggcatggagtctagggctgcgggcgaagaggtttcgccacaaccacgcccttcgccatagtaccaataatgtacggcgttaagggctgcgggcgaagaggtttcgccacaaccatgcccttcgccatagtgccaataaggcacggcgtcaagggctgcgggcgaagaggtttcggcacacgccacgcccttcgccatagtgccaataaggcatggcgtcaagggctgtgggcgaagaggtttcgccacacgccacgcccttcaccatagtaccaataaggcacgacgtcaagggctgcgggcgaagaggtttcaccacatgccacgcccttcgctatggtgccaataaggcacggcgtgatgggctgcgaggcgaagaggtttcgccacacccacgcccttcgccatagtaccaacaaggtgcagcgtcaatggctgcgggcgaaaaggtttcgtcacacgccacgccctttgccatagtaccaataaggtacggcgtcaagggctgcgggcgaagaggttttgccacacccacgcccttcgccacagtaccagcgaggtacggcgacaagggctgggggcgaaaatgggttaaggagttgctcccaagagcagccgaaagagatttatcatttttcaagatgctccgaggggccggcaaactcaattggacacctgagtgtcaagccgcattcgatgggctaagg

SEQ ID NO: 48944 - DNA, 291 bp, Oryza sativa
aatcatagaaactacactatatatgagttgttgcttgagttgtctgtattggaagtcgtgtaagcggcttcttccgccttccgggtctagtacgtatgaaaagatgtcagcgtcgtggcgattgcctttcctggtggtgaaggattctattcccgagcggctaaggtccaatccggtattctatttcgtctgtgcgagcattaaaaccaaccatttccgacgtcaagatcaataggaagaaaagggagtctttttctgtcttgaaggttttattttaaatccaaatcgaaa

SEQ ID NO: 48945 - DNA, 259 bp, Oryza sativa
aacatcctccttctgtcccgaaaaactgtactaattattcctaagggttaattagatacctatcatgtgaaatcattgtcatgattaatatttatgatgaacaaattgactttgtaaatgatttaatcaatgaagtggtttggaattatgtgtggatgtttgtgtgagtgcgtgtgattaatgtgggtcaggttatgatatatgtactcaggaacgattgttttatctaattcgattgttttatctaattgtgtgcagg

SEQ ID NO: 48946 - DNA, 460 bp, Oryza sativa
caattctttgatgcaaggtatttacattgatgacaatgcttcataaaaggcaaataattcatgattccaacaagtataaataatttcaaagaaatgcttattatctaatgatgataataagaaaagaaattgatgaaggagagggcaccactccatgtgcgccgtcctagttgacaaatgcatgaatagagcccttttttttgtaagagttaacaatcaattctttgatgaacggcactaatctgccaaaatgattccaaaaaatcaaagaattcatgtgtccagcaagtattttaatttcaaagaactgcctaatagtatcatcaaaggatgaagataggaaaaggaattgatggaaggtagggaaagaatttgatggagggggtctctccatcagaggccatcctagttgacaaacatatgatcagcggaaatacagaatcgcgcaattgttattttg

SEQ ID NO: 48947 - DNA, 278 bp, Oryza sativa
ttaccctagaataaacaaaaccccaactagtggacactctactcaaggtaccactagtatgattttaggtagatgcttcgccgcttaattaggtaacattaggtggttttacaactctagactttgggatattcatatcacctggacactatggaattgttggatcattgtggaattggattcacacctcccctctattcaaaaccctcaaaatggttttaggctgggctcggggtgcatggttttgatagtagcacctcggccatataaggacaggt

SEQ ID NO: 48948 - DNA, 1501 bp, Oryza sativa
tggactaaaactagggtaaaataaaaaaaatagtaaaaggacgattcaagtagattgtattcgggggttttacaatgaaccaaactcgctagctcttgaaaggatgaccatagagcttgacagtaggcacgtaaataagagccaaaaagatggcatacaagtggttttttacatacctcattatggcgggttttgggtccattgtgcttgggaagaatgccatggatgtagtgatgccacgatatacgagtggacaagagagaagccaaaagaggaaacatgaaatttatctatatccctaacggaatatgcatatacagataaaatacagtcgtagccgactaagtctcaaggtatttccttgatgtacaagttgagaaacaaacccgagacacaaataaaatattctatctatatttggtatcctgtattcagtccaaataccatcgccgtgtagatatgggatatccataatctccacagtagccctcacgacctttgcagtcaaccatcatagccttctcaaagataatgatccgagtgcttcaaacctttcatgccaagatctgccgagtagcgaagacaaagactgtaaagggcgaaaagataaagaatatggtgcatcgaatagatgcacctaattaggtgtagcccccaactatgtgattagttaacaaactaaacatatagttgagaacaaaataatagcacaatcatgcatcatatgacaaaagcatacgcgacgcccaaagaggcattctagccgactgctttttagccataataaaaagaatccgagtggttaacactctaaaaggttcacgaatgaacacacttgacgggcatccgaatagaaaactctaagattacccaccaaaaattataaaaattatggtaataaataagtctaatagcctaggctatgactatttaccataatgagaacaggcatataacataccaaagaaacgactatggtaaaaacaagtcattccaagttaacccagacagcttttgtagcctaaaaaagcttacaaaaacagcataacacctttctgtcgggcaccttttaatttgcattgcaataattccaaagaattatatgaccacgtaaaaaggattttatcagcattgggcaacactattatgcgcatagattgccaaagcaaaaaatgcctaagtccctaaggagcacaatgggccacgctgtcaaaagtactgggctgaggtactgttcaggcctaagcccatttgcacctccgatacccttaacaagaaatcccgagatccaagcgtcacttcgtcttccccgccggaactctcgccattttccccactccctgctacagtacagagctgcgccggcaaactagggttcaccattccactcgaatccaccttcaaaaagttcatcaaaatccttcccgtgatccaccgcctcaatccctcacctctccctagccatccctcgaatcaaatcagcgcattcgggtaaaatcga

SEQ ID NO: 48949 - DNA, 176 bp, Oryza sativa
cattgcccataattggcttcccagacacaaacttctttggtataaagatcgatcatccacaggaaggagagagcaagcttacagctcacagcaatcagctaagccagtagccaatcctcactcactactcatcttctcttcccatctttgttgcttgcattcagagatcatccaat

SEQ ID NO: 48950 - DNA, 297 bp, Oryza sativa
tattccaaatatatttcactaaatctgtaaatttgagttttagaccctagattcatgcctgaacagttttttcatctattaatatctgcaggaagctattactgaaatctatatagcatattcaaacttttcactactgtgatctagttcatgcccattaattgtcatagcagtaaggatcccaacgaaaccatgtctgtgaataaacacaatgtagctcgtttctggagagatccaaccatctgtcatgtgcgcacatgacaccatctgatcttgttaccttaggacatgcaccat

SEQ ID NO: 48951 - DNA, 1501 bp, Oryza sativa
aggtggttggcgactctaaatcactgcaaggcgtttagttgttgcgatcgtgcttgtcgacctatcaaaaaagttgccaacacgatttttggcgactccactggggaatgatctaatcggccatattacggccaaatttcgtttaatctagtagctaccgtttcgtcaaatcaagtttcggctaaacggccgaaattaatctattatcgctggattaatataatcggcggcgagggtatttggtcatcaccgaatccatctgaacacttgccgtgtgtactgaagatcatcgtcaggggcagcagccggctcagcaacgctgtttcttttgtttcgcactgcaacagagaaaaagatcaggctactagagccgatctactgagagacaagcagcaggaatattgtttctttttattgctgcacactgttaccgagaaggatcaaaagaaaaaatcaaagccggttcaatttgcatcggctatcaccaggaagtttcagtttttgtaaatttttgctacgtacacacacagtaacataccgacggaaatcaagaccgtatattaatctattcggtcaaatatttcggctatgagctatatggccggatttaatcaaggaatttcttcatcaactaagacgagcgggaacgggtccatcaatattgctacccaatacattagatccgatcaaggcgtcatgagaggaaatgtcctgctacctcaagttgtaatttcaccaaaggtaaccttcgattcgcccaacccgtcctttgctattcaaaacgttaataatcattgtgtagatgcatatgctacttctagttttgctcctatacaatatgcttataatactatgggagggtcaacgggtgtttatacggccgattacacgggaatcggctatatgcaaaacctagctaacggtatgtcacaccctgaagttctcctcccaagcctaaaattaaatttataaatcaccctaagaaaatgccggtgcaaatcgagagaaaaccctaagaaagtaatacaaataataatcgaatctggcatgtggaatttttcttgagttctacatgtcgaaattcactaacaggatttttagtggaatttttagagctctcaaaataattttaaccaattaaaattgagcaagcaatattttaattccagggaaaatccttttcttccttttctttttctttttcccccttttcttttcgagtgggccgccggcccattctccttcctcctctcccctccgctgggccggccgaaggccaaggcctagctaggccggccgcctccctcctcccacccgggacgccgataggtgggccccacctgtcgggcccgtctcctacctcgcgcccgcgccgccgcgcccgcaaccgccgccgcgcccacgcctccgcctcctccgggccacgtcggtcacgcccgcgcatgcgccgcacctcccgcgcccactctcctctctctcccgcccgcgcccgcgcccgaga

SEQ ID NO: 48952 - DNA, 361 bp, Oryza sativa
catttattaaataaaattcaaactcttccatgtgtgcctcccgatcagaatcagtagtgtcaccaatatttgactcactaggtccttcggtcatttggcattcaatagtctcagactggctactttcaggggcgttttccgatggagcactctgaaacttactatctgaatcaggcgttgcatccatcatgacagcagcaccagccactattacacctcccactatcattaagagaactagtactcttggaaaatcttaatggttccaacaacttcaggtagatattcttcagagttaatccattggctctctcaggaagaactgccagcagtggggcctcaaattccttcatttgtggtg

SEQ ID NO: 48953 - DNA, 440 bp, Oryza sativa
taggtgttctgacgaaagatttgaacggtgcagaaccatgcgcatagtattttgaggaaagcccgtacagcgcttgtggctatcggaagatacatcgaggataaagttcccgctagagttaagttgaccgttgtggagccctgtagtcaatgccataagttgtcataatcactcgcataaacgtaggatgttcttaacttcggatgagccatatgtttcttgaattattattggattagttataggaatcgagcaaatgtataatcgttgtaatttgatttgagatgaaaaatggtctttgttttttgaattatcggcaatatgggcccacacgagccctagtgggtgggcccagacggccctaccttccccgtcccatttccttgcagtataaaaagtactccactccgtaagacgcagctccctccttccgaagcttc

SEQ ID NO: 48954 - DNA, 1045 bp, Oryza sativa
tttttggagatagaactgtgcagccggggtggttgttcagaatggttgggcctatacaacagggtatgttgtatagcgttggcttaatattgtttaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgctagaactttattgattgagaggaactatctacctctgtaatgacattttattcgcttattaatcagagtaatatttgtactctattatcaatttgttattgtgtgcctcggctgattcctggacgagggttcacacacatgtaagcgtttggaattttggatagaaattccgggcgtgacaagttggtatcagagcccctttaaccctaggttatgccaaatggttacccatagaagccctctgaaaaatattgaaaaagtagaactgttctcctccctttctcttttaattaaccaaactaatggcacatgcacttcataatttttttttaatggttctcattcaaaatttattccagtgttattagtactgtacatctattactgtactaatggctcatttaccagcaaaagttttacaatactgttttatttaatcttgctgcaataaaataaatttagcatgttgattttataatttcctttcatttcttttgaaaccagttattcaaaattacaaaatttgtgacctcgtttccaactgttttaatttatttcgcaaagcttggtttactttatttacttccctttttactctgattttctaactttattcaaattaatccaaaaacttgtgctattaattggataaaggtcttaactccctcctttcacttgtctttaga

SEQ ID NO: 48955 - DNA, 246 bp, Oryza sativa
cacatatatatatacatacatacatatatatatatatatatatatatatatatatatatatatatatatatatatatatatatatatatatatatatatatatatatatatgcttgcacagtaatgcctccctccctgtggaaaactctagtagtactagcacatttgcattcttactgcactgcaaaactgaattctagcattccacgatgctgaactaatgatctctccacgccggttttcaga

SEQ ID NO: 48956 - DNA, 1501 bp, Oryza sativa
actagttagagaaagattagcttttcaggagttcgtgtcgtctaccactagaggagcacaagttggaattgagttcgtgataggaagggcaattgggaggtaaagatctgggaaagagttatttgacatgtgcctaggctagttgtcctaagaaggatcacccgtcgagagggcagcgaagagtaagtagagaattactttgagcttgtaccttcaattttcaatgaaagatttagtacttcttggatagcccttgagtagtgctaggaaacgaatcctgtagtttacgtacgttatcagtagtttctttcctttgattgacaagaaggaaaagaagctttgcgcgaggagcggcggggacagagagagtaggcaccgaagaagcttacccgagcaccgaactaaccaaaacctatccttttgctcttggaattgacaccggaaactactgactgaaagtactagctttcccctgtagaaaagaaagcataagcaactagtagtatctaaaggaagaagagtataaataagcatcttactctttaagggcaagctaagcaaggagaagttttcctttaaatctctagtttcaagcggttaggtcagttcgaagcttagagaaaagtggagttgaagttgggcatttaggaagttatgttgcggtatcagaccactctgtcgaatgagttgaatacacttattcaaaggggagaagcttcagttcaagtttccgtttttgttggaaatccagaaaccatatcagtcgaggtatttactttgttagtttccgttgctagagtaagttcaaccccgcggagtggagatctttttttcaagactgaagtgaaagttgggaatgaatagtatcttcaatagtgaagtccagttgttatagttcctaaaagtaaaccattggctggctcacgtactggcctggctgcttagctttcttaaacacagaattcctggtagatcgattggctttcttatccttactcagctgctcttcaagtgcttttaccaaagcaggtatttaggcaagtaaagacaaatccaaatcttacttatgaattgaaaagggcagatactagccaagttctccttctgttaacagctcagttcttacaatctatgatatcaattggcattgcagctttttgttatgctaagtattcttcaatgcaagttggtgatatcactcattcaggacatggctatgggctgaagggcaggccaaagaaatgctcgccgggagggctgcctagggccttgttttgtattctgaaagtagtttttcaggtatatttagcccatgaggattactaatattagtagttagtagctatttgaaggtcagagtgaagtaaagcagcccatttgggcattgtcccccgctcttcttgcatagaaacacaagctagccagtgaccttctagctaaagtagtagcagttgcagccattacagaacaccttcaacttttccttgaacatatattgaga

SEQ ID NO: 48957 - DNA, 498 bp, Oryza sativa
aaaataatggtcggaaacggtaccccttatacgaaaacgatgctcgctcgatttgaaatttccgtgacccattttcactcctaccggtgagctcttggatgaccaccacactccctccaccaacgagtcgataacgagttcgctgttaccaccgccctacaagagcatgatttttcctgtctcgttgccgccaccaccggcatgctcatcgtgcgtccccgagtcccaccgcctgcgccaactcgatgtcctccgcggcggcggcgtcgttgcacccgtcatcatcgtcatgcccggcgactcggccagacacgaggggcgccagtgcgccgcccgtcgcagccatagaattcgaagaagcagtctgaaaaccggcgtggagagatcattagttcagcatcgtggaatgctagaattcagttttgcagtgcagtaagaatgcaaatgtgctagtactactagagttttccacagggagggaggcattactgtgcaagc

SEQ ID NO: 48958 - DNA, 774 bp, Oryza sativa
atcacgatacgattaatctgatggcgcagcacgaacaggaaatagataacctagccctgggaaggaaagggaacagtttagtccctccaatccgtcaatcaacgatagggttacccagaattctaattaataggaaggttggactacctcgaatggcaacatgctcgctgattcctaccactcctatctacataactgctccagagaagggaaggcagatgtcagtgaaacgggtaataatacaccctcgactactgggtgagtgagaaaagacaacatcctcctccggttacactccctgtggtgctttcagcgggggattcgttatggaaagcgggaaactcaagtaagtacggcttttcgatagctaatacgagttgggatgacttgttccttttttattcatgtccgcgtttcttatagaggttagtaaatcagcaatagtgtccttgcccataagactctaattctaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgta

SEQ ID NO: 48959 - DNA, 152 bp, Oryza sativa
ccatcataggattgcaacaaattaatgctagctcaatgctcagttgcaatactgaaagaaataaagatatgctaaggcgttgttcagttataacatataacaacagagcaagaagtgctaagacacacaattgctaggaaatgtcggcacca

SEQ ID NO: 48960 - DNA, 1012 bp, Oryza sativa
acaatttttttttaaaaaagttgacttggtaatttaggcgctatttttcgtgcgtgaacgaggtcccaacctgggaagtgacacatcttactgtgatcaagaggtgacttgattaaccaattcgtcaatgcgctagtgaaactacaaaagcagatgcgatattaattgaaaaaaaaatgtctcgaaatgtccaaaaaaaatgtcaacatttgaaatttatagtttttgaggtgttacgaaacaactccatttgaagatataaaatgctctggttcgtagctagaataattatattttagttttttttaaagatttttagtcaggaatcgacgtcatatttactacttataaaaaataatcagatagtttttacaccataaattacttatacttacattgtaattatacattgaattatattgtaagttttagtattcatattatatttttttaagtacgcaatgtataaaaaattgtgatcaaaagtaacatattatataattgaaagaggacatgagagggatattatccggaacaagtagcggaagagcacccattctaatcagcatggacggcttccaaagcttcaatcggcatgtttaggtcaggatgaaaacggtcggaaatgatcggaaacgatattattattttattatttttttgaaacaagtagaaacaataggaaatttttcatatttatgaattgaactatttagtgtcaacttcaatgacactgagggcctgttcactttgatgccattttcaaccttatcaagttttggtaaaattgctaaaaaagtggctacatttagggtatgtttggtttgaaaccctaccaaaatattggtagtaccaaaccttgggcaaattttggtactaccaaatttttgatagtatagatttggctccactctattgatttggcaaaaattggttccaatccaaaatgctaacatgcactattcaaaactaacaaagaattggtagggcaagaattggcaccaaaccaaaa

SEQ ID NO: 48961 - DNA, 1501 bp, Oryza sativa
gtcaggttggagtcgccgccatcattacgattttttaagtattattatagatatagatatagattaaggagttgctagagagaacttcattagatctaccggtgcctcctctcttcccctatccactcatccagccgatagaggggcggtggtaagaggcggctatcgatatgacaaggccgaagcatggtggctatggtggtgaggtggagcctgaggctaggaagcaccgctgtgatggctgtcattgacggacccagaagaaaggggagatgtgggtgctgatgatttggccctataactttttatgtggagttacctgcacacagatcccatcataaaatatgcttgttctatcccatgcctaagcataaaaaatcatcttgctttgttcttagccttggcatgtgtcaatcctgtattttccatatccatactatcaaatccttaggtttccgaaatattgtaatggaaaaagaattgattcgaattatcactatttgactctgacctgttctaaaaaagtcaaggtacttcgaatgacatggacaaagtaagggagtacaaacaagctgaagcaaagtgggtaacagatcccagtaggccccatatccattttgttttcctgactgtcttgtggacaccatatcagtgaaaaccgtctaagatagtcattttgcaccggtttcatgatatctggtattatgggtgaggtatacaagttagattgatttgatcatgtttttacctttgatgggctatagataaatgggctgacttgctattacttccggcccattgggagtattttgggtctttgacatctctcttctcacaccccgctcaatccccaatccggttgaccatgtccgccattgatttgccgacgggaggcggcgctgggttcccccctccgggttgccacccaaaccggtcgtctaggccgcgtggccatgcgcgcaactttgaggtccacaaacttactatcatttcatttgagcttgtctttcgtgtcccatcgtagttcatatgttttttttatcttagctagaattcactagattgattgtgaatgtgttgtgcaatgtacttatcgcgtggagaaaagtgttttcgtaatctttgagaggtacggtacgaataggtattgctaagctagacttttgtttattgattctacaaatatttcggtatctccaaaggtataccatagataactcctaggaattaattggaagacagttatcaccaacgtaactcactaggtatgcattataacagttggtgagcttaagagaaaccaagatagcaatctaattaatttactagaacattatgtttccctgtagtaaaacatcaacagagagtgcactattgtgaatttagataatctgaatgactacatataatgttgtaatagcatgagaagaaatggttgtaacactacatggtagattacattggattgataatccccacaaccgaaaactgcatgaacttt

SEQ ID NO: 48962 - DNA, 1501 bp, Oryza sativa
ccttctgtttgatgagggtagcgtatccacctagcaacaccaccgtggcccatgcgaaagccagtgcaccacaaccgttcatcaccctgtagaagaacgcaatgcgtacggccatggtgttgagcttctcttccggcagcctctcatcatttggatcaggctgatcaaatgcctctgcatcattttttggtggcactgccatggcgtcgcaatcttggtgcgtcgcacatttttgatcgggtttgtgagacattgatcgggagtgttggtaatttatttcttagatctgtcttctcgttgcatcaacactggggtggcatcacccccattttatactggtcggacgagcatagtagaaaataaggtgtggtacgtagtagatcgaatacaacctgtaacatatgttagtttaggtatatatggagatggacgccgtcagctttataaaaaaaattagtaataataatagtgactcttgggaggtagatcgatctgcgagtcgttctatagttatgcaagttggcaaagtcttcctttgccctggaacttaattaattagccaatgagcagggcgtacatggacatgatataaatgctactaaaactgactttctaaagggcaggcgtggtcttccctaacgtaacatggtcgacagttaaaaataggactacgctccatttattaatactcctgaaggagggtaaaaacactgaatcctttaataagtttgcgcggacattgtggagtatagtcgtccaatggagggatgtgtattttcagaagtctagatataatcctggtattatctatgttctccctctgttttcacttttaataaataacgttattgacttttagcattatatttgattatttgtcttattaaaatattatataaactagaaaggtaacccgcgcacatgcgcagtacgttgctgacagcctgacaccttgtttattattgttgcttgaatttttatgagtaatattaacatgttggtgattttttattatattcttttgtccatagtttgtttaggattgctttaaatgttagtcatgattttcttctaactaccctatcaacatataaattctaattatttgaattcgtaaaatcttgagtttatgagaaaatatcgtgtcgtggaaaatggagttgattcacatgtaactatcatttgtactatatgtgtttttaatatttagtatatcttacttttggagtttctaaactttaagaaatagcttttcttgtgtactatagatatctttatggaatttaggatattttaatggaagaaactttctattaagatatatggtaagaggaaaattttatccaattatgacaaatttatatttacttttgctacctccttttgtcatattcttactatgttcttggaaaaatgaatttaaaattgaaataagagagcaattatataaataaaatttttccatttaggaaaaagtacaaatcacgcccctctccccgaa

SEQ ID NO: 48963 - DNA, 348 bp, Oryza sativa
gagagagaaaatagaggatgagaggatgaggagatgataggtgggtcccacaattttttttataaatagagtgctgactggactgccacgcgtacgctacgtggaccaaaaccaccgtggattgggtcgaggggggtaatttgtccggtttgtatagttgagggtgaagaatgtccggttttgtggttcggggagaggggcgtgatttgtactttttcctaaatggaaaaattttatttatataattgctctcttatttcaattttaaattcatttttccaagaacatagtaagaatatgacaaaaggaggtagcaaaagtaaatataaatttgtcataattggataa

SEQ ID NO: 48964 - DNA, 1501 bp, Oryza sativa
gagtcgattaagagccgttgtcatgggtagcaatcatgtttttcttttttcctctctttcttccatgttaccaaatttacttgcatggtaatagagagagtccactaataaagaccgttgtacataccctaagatggattaatcaaatgttttaatatatagcctctttaatacaaaggtttactatgtgatcaaattatcgcaaagctttgtatccaccttttctacttgttttcttgcaatgtgttcataataaattctaaaaatatgaatacatgaaagtagttttcatgatagatctaataatgttgttgtgacttatcacgatttcatattggagtgttttcttagaatagaactcataattaggtacattttatttatcatgacaatcatcgatataatttagttatcaatgtatgtgaagttatgtataatgacataatcaatatatgatgttagaaatggcatgtaaaaggttaggatttgacctaaattgttatattcataatatagatagattaaacttgtagttttcatttctaatataaaagtaaatttattataccataatgaaatttcatgatagtgggaatattttttaatattattggtggcaggctatgaggcccttcgtctggcctattgagtcgggttacaagagcggagcgtggcgaaaagcaacgaaatcaaatggtgcttggtgagataaggcaaagccaaacgaggcatggcaagacatgatgagagacggcgtagccaagcgggatatggcaaagcacgtcgaaacgaggtagagacattaagtaaaatggaattgaactaaaaaagtgaccctacaaacggaacaatacaacagtaatggagtgagatggatagggggtcgcggcaacgatgatttcccgtgacaacttcatcaacaagcctatgctataagtgtgcacaccgcttaacgcactgatgaccccttcgacagtcttcgtggaactgatacaattcgaggttcattgtttatagatttgttgtgagcatcaccggactcgaaaaaaatttaggcatgcaaatctgagtccggctttgcgctcgtggagcaaccttggacataatccaaccgtacaaatgcatgacagcttgtttgctacatcaactgtcaaaatgctttcatttttcacattttgatgtgcgaattttcccgatcaacacaagaatttccagcttttatatttttttctcctaaaattaaagcagggcctccaattagcgtaaagaaaagttgctgtaaagtcaatgctcgcaggtcttctcgtcctcgtcgttctttaagacgttgatcaggtctattagcgcaaccaacccaactgctaaccaacttcacagtacaatggtacctggtacactgctaacactggaaacgagcgtttacatccacccaccatataaaggaaacctttgctcgtattgtgctgcacactggaaaccatggcgattccaattcttcgtc

SEQ ID NO: 48965 - DNA, 1501 bp, Oryza sativa
acagaattgctgtacttgggcgcggaagctggcggaggtatagaagcgacgaagagaagcctgacgactacacaaaaatatttttggagttgttttcggccttcatcaatggtcgctcctgcttggcggtcctatatcagaccacccttggatatgcacagctggctgcagtgatcggtaccatggttatcagttcgttgcgcctgaaaaggcaagattatgtcgatccaatctatcaacaaaacgatgaccataagaacatcagatggtccctgaacatcttctatggattggcgctctcccagtgcattgtctatttcctggtttcgatcttggcaaacccgttgaaacggatgctacgagttggcctcacatataagctgggattttggggtgtgctatctcttgctcgctatgttgaggaatgtcttctgaaatgcgtcagtggtgatcttcgtggtgcggtcagcatggatttggttagcttttcaaacgagctgctaagttccgactcaatagagaaccagcttataggatttcgtattgtcgaccaccttctcagaagcaaaatgtacaaacagagggtgctgaagaagattcgagtttccattggcacaattcagatggcagtccacatgctgagcttgaagatagacatggatacagacacaagagggcatgctgcacgcgtattgctggagctcgcgcctgacctccaggtggagagctttcctggtatcctgcctgcaatctcctcactgctcagcacaaacaagggggccacaaacagtgaaagctccagcaacccaatcactgcagtggcggacgcagctttaaaatatagatgggacggagaacggagatgttcactcgataagagcaatcgaacacaacacatatcgtattaatagtttattcgtataagtgtctcaatctgttggatgtttataccttgttatacctaattttgatggtccatgactactataaaagaataaggtggtcttgaaagtgtggggcaacacgagtcgtagctgagtcggtcgacccaccccgcctaatgggtagatccgcccctgaatcactgtgatgaaagagttcaagctgcttggcgtgcagattcttgagaagcttgtggatgatcaggacaactgcacacaagtgaaagatgccaaggatctgattccaaatattattgaactcaccagagaaggcagattggactgtaaacttgactttgaaatagttcatagctcacttaaggccttgctcaagccagggtgtgaaaaaccgccggtaaccgcgcggttaccgcggttaccgtccgtaccgcgggggtacggttacccgtaccgcgcggtacggtttaataaaattcgtccaaattcaaaaatttaaaaaaaaagaaaaaaatcaaaaaaaatagtgaaggtagtgcttgatttatagtgttttatggtgaagaaatttctcaaaaaagagtaatatttattcaaatttg

SEQ ID NO: 48966 - DNA, 1501 bp, Oryza sativa
ttccttccagctgattctgatagagtgctatttgtagaagcatggtaaggttgccgagcgatggagggacagttcctgtgagattattctcaccaaggtaaagaactttcagctgcaacaacgatcccagacagctcggaatcgccccatggagctcattggcctccacactgaggaacacaaggttggaacagttgcagagcccaacaggaaggtcaccactgaagtcgttgtatgctaactcaagatagtgcaggcgatgtagctgactggtgaagtacacatctccagagagtgtgttgttgaagagatcgaggctctgaagaaaagtgaggttgccaatgacaggagagatgcttcctgcgagacctaatgaactcagatttaaagaggttaccctgcccggatgccggcggctgcatgtcacgccaccccaccggcagaagtcggagccggtactgccattccatgagctcagtgagcccaactggtctgacactgacagcgccgccctgaattgcagtagtgcttctctgtcactgtactcgtcaggaagtgaggaagaaggcaccggccagagtgtgaggaggagcatcagcagtgggatgatacgacgaagaattggaatcgccatggtttccagtgtgcagcacaatacgagcaaaggtttcctttatatggtgggtggatgtaaacgctcgtttccagtgttagcagtgtaccaggtaccattgtactgtgaagttggttagcagttgggttggttgcgctaatagacctgatcaacgtcttaaagaacgacgaggacgagaagacctgcgagcattgactttacagcaacttttctttacgctaattggaggccctgctttaattttaggagaaaaaaatataaaagctggaaattcttgtgttgatcgggaaaattcgcacatcaaaatgtgaaaaatgaaagcattttgacagttgatgtagcaaacaagctgtcatgcatttgtacggttggattatgtccaaggttgctccacgagcgcaaagccggactcagatttgcatgcctaaatttttttcgagtccggtgatgctcacaacaaatctataaacaatgaacctcgaattgtatcagttccacgaagactgtcgaaggggtcatcagtgcgttaagcggtgtgcacacttatagcataggcttgttgatgaagttgtcacgggaaatcatcgttgccgcgaccccctatccatctcactccattactgttgtattgttccgtttgtagggtcacttttttagttcaattccattttacttaatgtctctacctcgtttcgacgtgctttgccatatcccgcttggctacgccgtctctcatcatgtcttgccatgcctcgtttggctttgccttatctcaccaagcaccatttgatttcgttgcttttcgccacgctccgctcttgtaacccgactcaataggccagacgaagggcctcatagcctgccacc

SEQ ID NO: 48967 - DNA, 1501 bp, Oryza sativa
agtatagttgcagagccgccaacggttgatgagacttctagaaaataaaaaataaattccaacgatagttatgttcgatttctagaatcacaatgacaataaagagtaataaagagtaggtggcggacgggctgtataggagcatagtggcatcgttttacaggacttctaaaaattataaaaaatgaaacccaacaagacaataaactctataaactacaatgtccattttttaaaggttcggaacttctaaaaagtaaaaaaaaacaatgataatcatgttcgattttaaatcttaatgacaataaagaagggaggcagcgggcgagccatagataagtacaatgtcaaagccgctgacggtttggcgggacttctagaaagtaaaaatgaacccaaacgataattatgttcgactttttaaatgtcaatgataataaagagaagagacagtggacaggccgtagatagtgaacatgccatagaggagtataatggcaacatttaacgggacaactagaaattataaaaacgaaacccaacgtgacaataaactctaaaaactataagatccaatttttaaatgttccaaggagaatgaatagaaatagtaatagatcgtgcaagcaaataaaggaggagatgacaaaaagggtagcaactggtgtgacttttaaaaactatataattagaaacacggggacgataagatttggtctttcaaagttttaagacaatgagatagctatttaataaatttaaagtaaaatcatacttaaaaaaatatatgattttgtttgggtgctagccgcgcatttgcgcgggccacccagctagttttaataatatatttgttttgcgttaaaaatactactatatttttttattatcttagtcaaacttaaaaaagtatatctagaaaaaaagtctaatgacttataagatgaatcgaacagagtattaatcaaacatctattgaatacttttcagtacattcgaattcgcatacaaaagaactctcttctcaatttgcggtccttgcggatcatcgaccgtggccatggctagttcacggtgccctccgtgccgccgacggcagcaggccgggacaaggacgtcctcatgtgtttgatcgttgattcggatcacggaggccggggagagaggtgcttcctcctcgtcctcgttctccatggccatgattcctcgcggcgggcggctggtggctcacgccggcatgcgcaggcgcagcctcactggacgagaaaaagacggggaggcgcaggaggacgggattcatgggtaggagaggggcaactggcggcggcccacaatatcggattcgtatctttatctacaatatcagatatctcgaccctctagttataaaagtcagtgcgatttatctctctcgacggttttactgacgtgacagtgttaacttgatcttcatcctacgtaatgcatatgtagcattagaataaaaaggtcatatgtggaa

SEQ ID NO: 48968 - DNA, 1501 bp, Oryza sativa
catggtatagggtcggttgagtgcacatcaataaatttatcttttgttctgcatgttccttccattccagttaaccttctctcggttagctcggctattgaccaattcaagtgcattgttgcatttgatgagaactcatgtcttttccaggagaaggggactggaaggaggattgggactagagtgaggcgacctggcgaacaccttccatggacagttccttacataatgaccttgctcaccacagtcataacaggtagcacttactttcctttggtctgacgatgacttggctgtcgttatcttcggggatctggacagcattttgacaggggtcttcggtgccaatattgggaactcctgactctgactctgattcgggttctgggctggcatctggacttgcacctgcggttggtgacattgacgcgactcctgacattgccgttgcatctggtatatttggtaccgacgtcgcatctgttgtaacaactcttccactgtttgagtttgattagccatgacttggggttgaggctgatcttcaagaggctgatgtggaatactattagaattgcactgagttgccccatgaaactgacagggtcctgattcgatgaaattgtccctcatgctgaccatctgctgcaggcaccagagagagggggaaatgggtggggttactagagatgaggtactaaaccacttacctagtgatctgttgtgagtagatttttatggtttaagttgcttaagcaaacaacctagtatggttgcatccctaccaatgatgcaagccatacccctacacacaagcaaacaacacacgatctagaagctaacgaaactactcttctgggaaagattgggtttaggtcatctccgggaaaactcctattgatcatcgcggaacgatgactctggacagatcttctcgctctttgcacgaagcttgaggcttagcttgacttgacttccaaacatgcacaaagctgatggcttgtccttcaggtttgacagctaaaagaattagagggacagggaggagaattttaaaaaccatttcacaaggaaatgccgaagggcgagaggagacattttgcaaatagggttttcagaaagtttgtccttagggtttgaccgtttggctcaacctacagtcaagttggctctgataccactttgtcacgcccagaaatatagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaagcagcagcagcggaaaaaggcgatcctagcagggcttcagctccactccacaggcaaaactcaactagggtctgagccttggtcctctaacttcgtcttcagctcagaagcactacacttctgaaaagggggaataatagcaaggctgagta

SEQ ID NO: 48969 - DNA, 775 bp, Oryza sativa
  unsure (1)..(775): unsure at all n locations
ccccctaacaataataccgctctctttcaatggaggttatcctctttcccccaaaagtaaattttttctaatacatgtntgtaattcattcaccaaaccaccccagcggaagggtgagcgcttcgttgtgacggattgtacgcatctcttgacccatccacatgacccgcttggctaactaaaagaagcttattggagcatctatgcatatgagaacggatgccgagtaaagggtggccagcttcgacctttgctttgaacaggggttagcattatcaaaaaccattgctcataaaagggatctctttcctaaaaggcatatctcgtacgctagggaatgtgcttctctcgtacgctagtacgctagggaatgtgcttcggcttcagcctagctacttttttgattggtgactaaactactaaaagcaaactttagctatcaattcttttctctatgttcagaaatcattaacggatgcagaactggatactctgcttaaagcaataagcctcccttggatagatcgaagaaagaagcactgtgcgttaccaggtgtagtggagaaagcaagggcaaaggtttcatcagaaagagatgctcgagcgataccaggatcacgatacgattaatctgatggcgcagcacgaacaggaaatagataacctagccctgggaaggaaagggaacagtttagtccctccaatccgtcaatcaacgatagggttacccagaattctaattaataggaaggttggactacctcgaatggcaaca

SEQ ID NO: 48970 - DNA, 355 bp, Oryza sativa
gggttactttattcccggccatttggggaatttggaggaaactttccacaggaacagtgttcccttttcgccaggcttttggtaccttaaaattccaattattctaaagttggtccaactcgtgttcattataaggcccgcagggtgttgaattccgcgaatatcccgaagtagaggccccctaggtggggtttattattatagggtgacagggttatattattcccattccattattatttgttcatacaaaggttaaaaggcaggttaaataaagcagtgccacggcgggattttaattaagcgataatgcaattttttaatcaacaatattttaccaactgggattccaata

SEQ ID NO: 48971 - DNA, 227 bp, Oryza sativa
aagattaaatcggattaaaacacttaaatcggtttaaattgaattatgacgcaataatgaattatttttgaaaaggaaaaggggatttattgcgtcagcgggctagggtttgggtggaccggcgcacgggcggcggttcacacgaacggacgcccgagatctacccgattcaagatggacggccgagatcgatcgggtccacggcggttcacggcggacggccttga

SEQ ID NO: 48972 - DNA, 188 bp, Oryza sativa
taaatgctttgaatttaaacatatgctatatctagatttataaccagaagttggttttttgagacaaaagaagtatttgtctaacaaaacatgcatgtactaatttaagctatcgtgcataatttagtttacacactggttgctagcttaggaaattttaagtttcatgcagatctctcttctccagt

SEQ ID NO: 48973 - DNA, 828 bp, Oryza sativa
  unsure (1)..(828): unsure at all n locations
ggaaaggaggccataagtttatataattccaggcttcggttggtacaatggtctccaattctttgcacagggcaccctgtggttaataacaagcccccaggagaaaaacgaagccacaggccatcagccccaccatatcttaagccacccacaccgcaggttctgaattcagagattagcctaaacatacggcatccggtgcctacgnggccggctaanaggattctagcgctatctctgatctcgagaagttcatgctcgagaagaaagactaccttgtcgttgactacgtgttggttatncctgccaccaagttgacgacaanctagataggttttcnccaaatattctacttgtgtgatccagataataaagagcaacacggtttcggcccaatagaatgtagggctattacctgttagataaggtgcntgaacctgtataaaaatccatgtctccatctcttttacatcaatctcgcatataccttggtatcgacgatccctataccatccaaataccgtagtcgcggtaccacccgtcgacagcggcgacgacgacctccccgcggcgacgacgacggcggcaagcggcagcagcgaggtcaggcgcggtggatccagcgcggtggcggcgaggtcgggcgcgacgacgacgaccaccccgcggtgtcacgcccagaaattctcgaactagaatttctaagctgaatgtgcattaaatccctatccaggaccagccagggtacacaaacgacaattgttgacatacagatccacgtcttacaaaaatagaaaagattacaaatgctgcggaaaagataaaagc

SEQ ID NO: 48974 - DNA, 1374 bp, Oryza sativa
cggccgggttgtgggggaaccacacatttccggttatttctccccccccatttttatataaaacagggtttaaattgagggttttgggtggccccttccacaatgtgtgaaccttaaaaaggttttgaataaatataaaaatccaaacatttttttcttcttcccacggttctttaaagtgctttttttaaaaaaaaccccctcaccctctttggtataaaccggaaaaaacctcctcttcgggtaaactttgctaagacagggggaaagaccacagttgtggtctcttttcccccacacaaaagttaaagttctcctagtggaactgtttgttccaatttgttttcgtccctcccgccaagattccctgtaaagtgaattgcccctttctaaatcagctttccggttaagctcgcttttatcttttccgcgccattggtaatcttttcaattttggtaaaccgtggatctgtatgtcaacaattgtcgtttgtgtaccctggctggtcctggacagggatttaatgcacattcagctttagaaattctggttcgagaatttctgggcgtgacaagttagcatcagagccgaccttgaccgtagggcaagccaactagaaaacctaggagccctctgaaccctttttcatatgcatatgcctttttcacttggattttgtttcgggaaaatttggggtttgcctctttggttggtgggaaaaaaaatcttggtcgttcattcggatcggatctttaaaattagctcagtctagggttttagtaaaattttatttggagtttattcgacagtcagtcgggaatctattgggggttatgcattaggtcgtgtctatgttcgatggggcaatgttatgcgcatcattttccatgcaactagtctatgcattaatttattgtttagtcagttgcattagtgtcttttgtctcggttcgtggaaaaggttgttccatgcataaaaatcaccatgctaggttatttatttgagtcatttgttgctttgtttaatttggatttgagcatgaattggttcctatcccttgtctactttagatgtcagtcctatccctcgattgcaagcgccccccgagcttcagagtcgccgcccttagctttatcgtcttcttagtctgtttgcttgctagttttcgtgtttaggtttgttgcttgagggttagtcggtggtcgatatcatgtgtcagtggtatgactgcctcaattaggagttgcgtgcctctttttcagtgttttaatcaagattaagataattgcacttaaattcataagcaagattagtttctgagcctcctgtttttctttcttttctcatatttctacctatccccctcagatgg

SEQ ID NO: 48975 - DNA, 835 bp, Oryza sativa
tatgtacaattattcaaaccctgctggcattgttagcatatttgaaatcaacaaatggcatgtagcattgaactattgtagccataatttctgtttaatactacaggcttttctgatatataattgagatgcctgaaatttgcaatagagaattgtgaatgccaagcattgctcctcaccagtccaaatatggtcagtttctctattgtactgttatctttagaaacaaataattattttcaaactactgattttccttctgttattaaggtattaaagcgaagtatgcatttagctccatggatttggagtttgcaagttccatgaagattatattgctgggatcattcttcgtcgatcccattttttatcattaaagtggatggcatctgaaagttgttactcttaagacaattccattttggggccatgtcctactctcctttgtacagaagtgatagtttcttgatatgatctcacttttgttttcactgttgggcagtgagtgcaattccatcgttacacactggaggaaaatgattaacttgttgaatttcccaacatcagttgtcaaggtcagctgcaaaggtacattttctgcactttcttcctgccatatcttacttttaaatcaaactaattgcggaattagttaataaaagtgtgttggacctgaatattctgtttatctatttgatgcaaataacacgttcatcaacaatgccttttaaataagggcagaaaggagatcacattggtatctagggttgatgctggcttagttatttaaaaatcaatttattttcaagcatagctgcaaacaataaactcaaca

SEQ ID NO: 48976 - DNA, 1501 bp, Oryza sativa
gcgccgaggagcacctcggccgccgcttttcacggccgggatcccgccggaacacggttcccctcgcgccggtgagcatccgccgcccattctcccctccgaccagcgattcatgccgctgggagccctctctccccctcctaacctctcccccatcctccccaggtccttccagccgccgtctgccggttcccgctcgcggaacgccgccgggccgccgttccgccttcatcccgaggagcgccgacgccgagctcccccccccccccgcctttccccgcccctcatcgccgcgtccttggtgagctcctcctctccctccttgcctccctcctctgtctcccgtgcgcgctgtcgcgccggtggccgccgccggcgaccaccaggccgtgcgccgctgccattaggtcggccggccggcttgccgccgccccgctcgcctgggccgcccggatccccttgccgcgcctcaccgccgctttctcgcatgcaccggccgtcgccgcaggaggccgcgccgccgcgagccgtcgctcggccgggctggcctgagccgtgcccgtgctcaaccgcgccacccagtggtcccggtccacggtggaccgattcccttgacccgctgacgtgtggggcccgcctgtcggcgccggcctctttgatgacgtcagcgcttaagctttttcctttgagaaaataaataataattgcgcaataaatcgagtttaattctagaaattcatttaaatggctcaaaacttctaaaattcatacctaattcattcgaactccgaattgagccattcaacttgcaaaattcatctaaaattgagctctacatgtttgttttgtttttatgtactattttcttggtttttattagagtttttcctcgttttgcatgccagcgtgtagaatccgtcatttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggtttttctagtcgcacccatggcaattaaggaccggttcgcgggatgccctggaagaacttatcgtacttaccacaagccagcgtgggcaacggctggacttatagtgtagctttcctctagctgacgcatccaggcaagggtgggcgtga

SEQ ID NO: 48977 - DNA, 1501 bp, Oryza sativa
tagcatactcttgaactgttctcccttcttgtttcaaattctctaccttgttttgagcctcaaccatcatcattacacttccctcttctgagtacatgctgctcaatgttttccatacaactgctgcattttgaatggtttctagcatccgagcaatagatggagccaccgaattcctcaaccatgacaccacggttgaatttgtagtattccacatcctccaagctgaactttccttatcagcaggctctttataatcctcctgcaaaaaatgatccaccccttttgccctcaacattagttgggccctccttgaccaactcaaacaattcttacttccttccaatctcaattcatttggcatcaattctagtttcaattcggctgatcctccacctctagtacctatcattcccaactttactagatcctccaacaaatctttcatctcatcctttatgacaagggatgatgaagcaatcactacttctttttcctgacttcccacaacaccttccccttgcatggtaggatccatttcttcctcacaacagagtattgaaccggaccaggcttcaggcccctctatcaccaaaaacaaaagacactcacctcaaactaacacttctgacagccttccctgctgaccacacatcccaaaagccacacagagcagcagcagcaactttctcctctcctccaccacacaaatcattagcagcagccgcctctcctcccccacacaaatcaacagcagtagccaccgcctcctttcgtccacgcgttgtgagggcgcacaaccccctctagccccccaggatgatgagccttggctatgactatggatgaagggaagggaagggattgggtggtggagtgaggctaggatttggctctgataccatcttgctcgatttggggaaattttcaaggtgtgttgcttctcctacacaccccctcctctattctattctctgaacattttacaaataggtcctagtcacaacacatatttataccaacaaaatccttatgtgtatactgtgttagtcccagatcaacactagcacgcacggtaacaaaagataatataacaaccacatcacaattttattaataaaaaggaattaaatataattttgagttgggtcttaagaccaggtagggcttgttaatctccctcaatcccctccccacccccccacccccaatttgtccatgaggattaaacgaacaaggcctaagtgtgtttagattgaagcaattggcaaaaaacgaagagcattcttgtggacacgagaggatacatgggacaaagtttgcctgccgaacgacaaaggtcgttcggggggataaaagacctgaagcttcagaatgaggcactgctcatcaagagatcgttccagctgcatcaatctgattcatcatgggcaaactggatctggagcaaatatggtgaaacctcaattgtgaaagaactctacctagctactccattggc

SEQ ID NO: 48978 - DNA, 1501 bp, Oryza sativa
tcttacttccttccaatctcaattcatttggcatcaattctagtttcaattcggctgatcctccacctctagtacctatcattcccaactttactagatcctccaacaaatctttcatctcatcctttatgacaagggatgatgaagcaatcactacttctttttcctgacttcccacaacaccttccccttgcatggtaggatccatttcttcctcacaacagagtattgaaccggaccaggcttcaggcccctctatcaccaaaaacaaaagacactcacctcaaactaacacttctgacagccttccctgctgaccacacatcccaaaagccacacagagcagcagcagcaactttctcctctcctccaccacacaaatcattagcagcagccgcctctcctcccccacacaaatcaacagcagtagccaccgcctcctttcgtccacgcgttgtgagggcgcacaaccccctctagccccccaggatgatgagccttggctatgactatggatgaagggaagggaagggattgggtggtggagtgaggctaggatttggctctgataccatcttgctcgatttggggaaattttcaaggtgtgttgcttctcctacacaccccctcctctattctattctctgaacattttacaaataggtcctagtcacaacacatatttataccaacaaaatccttatgtgtatactgtgttagtcccagatcaacactagcacgcacggtaacaaaagataatataacaaccacatcacaattttattaataaaaaggaattaaatataattttgagttgggtcttaagaccaggtagggcttgttaatctccctcaatcccctccccacccccccacccccaatttgtccatgaggattaaacgaacaaggcctaagtgtgtttagattgaagcaattggcaaaaaacgaagagcattcttgtggacacgagaggatacatgggacaaagtttgcctgccgaacgacaaaggtcgttcggggggataaaagacctgaagcttcagaatgaggcactgctcatcaagagatcgttccagctgcatcaatctgattcatcatgggcaaactggatctggagcaaatatggtgaaacctcaattgtgaaagaactctacctagctactccattggcgatcaatgcagaacctacttgaagctctgcagacactttcaactgttcgactaggggatggcacatgcacttctgccttcactgccactttgcgcgcctatcctgggaagccattggaacccgctcgtcaatacaggaggtgctctcaattactgcctgaagccaacgccaagactgcggaagagtgcactttcaggtgttttacctcatctgcatttgggttctgtggaacaattgacatgacgtcatctttagaaattcgaccttgtccatgggcaatgccatgaggaggtgcattgatgaggctggcctatgggccgagcgattgaa

SEQ ID NO: 48979 - DNA, 968 bp, Oryza sativa
gttgtacaaagtactccactcttatatggaggagcaatagtaaagtagatgtttcaactactagggtatatgatatctgttaaatgaatttctgcatgcaagttgtggaattgtccttagatagttttggggtaaatagtgccaagagatgactgggtggtaactggtaatgacctctgatatgagtagagactagagatgagaattaacttgtttactgtttctttgcttgaaatttaatgcatgcagaaaatattgtaccgtgtcctgattctgaaccatacaaaatattaacttgcttattactagagactagagatgagaattgcaatccatgcatgtactgtgtcctgattctaaactacagaaaattttctatgaagaaaatgctgattgcttcgatgtttatgcctaacttgcaactattggctatttttgttacagccttatatgctcattatgaatttgtagtatgaacttgttaccgtgatactattttcttggatttcttttgagttactgcatctctatatgtgacttggtgtaaatgacatgtggacctggactcacttggtcattgagataatgagggactgcatagatattcagtggtgtatatggaataatccttgtctttggcatgccaatgatccaacattactagatacagctgctagggaaatttaagattggtttaacataaattgctgatttatccaaaaatttagattgtagatagtattaccttcataacaaacaagcaatgctctccagtatgtgtgaagttcattacgtctagaacttattacatacctattgccttttgttctatagaaaccaagttcttgttaatataccagttggtacttttactgtttttcttttttaagaagttattacactagttcaccatgtcaggaaatttctttacactgatgttttctctggattattccctttgttccaga

SEQ ID NO: 48980 - DNA, 736 bp, Oryza sativa
tactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggttgcagacatattaggcctaggccaaaaaatatgccttcgacaccctttaaaggatgacgcatgtaacatgctcccgagtaataaatcttccgggtaatatagaccaagcgtagctcatatgaatagcttctgatctgagtgattatcccttatgggatactccaaaatagatataacaattgaatcccgactggcgcaagtattcagttgataacccttacggggaataataaatagaccagtctttgagcatataaaatagacccgtgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccatcagaggtggcaaaaatattggtggtagtgaagatagtgataccaatcaaaagtactgaagtcgcatagccatggaggcgaagaaaccagtcggcggcagtcaggtcagccagcaatgaatatgaaggcgctc

SEQ ID NO: 48981 - DNA, 1501 bp, Oryza sativa
ctcggcaaatatgacctatgtcttgtccttcagttgtgctgtcgcaagtttgttagtttgtttttcatgtgggttttgtccggttttcctctttaaaccgtgcttatgttaggattttgggcccagttttccatcaaaagctgggccaaatctcttcttcttaaatgaaaacaggcactcctggttctctatgaggttttcttcaaaaatatatataggtaattgatctggtctcgatacaggtagttgatctgtaacagctcaagacaattagtctgtgttgtattgtacgatggtggtgtgagaaaacttatcacagggtttgcattaagttcacctcaaaatttacagataacttaaatggaattgatgctgcataaattttcttcagaacaaagtaaatttggtgaaatggtgtaacggttttataattggagtgcattttcctaacattgtgcggagtacagttatagttaaattataatatgcttaacacggtgttacttgttttagaaaggtttatgttgtttatttaacagatatatctctttcactcttttgggtaagttcagattaagcttttgtagaagtaggaagctgcccatatgctcatctgagcattttgcaaaacggcgattcaattttttttatctgtaatttgtgtataccgtgcatatcagatgtttgaagggtgcacttgtgtcaccttttattttgttcatggagcttttaataatagtatggggaaaatttgatgattcatcagtccttaagactggtacttgaccctttgccagttgccacttcaagagttcaagtcgtagatatgaccgctctaaatgatccaagaactaagcaattgtggtaaggttccgttgttttttcatgttcccttctgcatatttaattaatagtatatggtatggagcttcgttaataacttctgtaatgttatgtttacagatacacaaatgctatgcaactgggtgttttgttcttggtaaagtttcacttcctaatacagtatataccactgatccgtaccactgataacacaaattcatcctacagtaaacttctcatatgttatttcttttttgtaattgaacgaaaaatccgttgctggcttgcttcagtgcttgcatcgtactattaagttgcagaacacaaacttagtttattctcaaatataaagatgcatggttaccatgtcgatctgcatgacatccatttaacacactgcttacattgttcggtctgtgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccgtcctatataaggtgggcaggaggccctctagggggcatata

SEQ ID NO: 48982 - DNA, 1501 bp, Oryza sativa
agtacttgtttttgcttgaaagtcgcaatgcaactaactgcttttcattttctgggctacattcaactatttattgtatttttttgaattggttgtaggttactcgaatattggcggcggatgagaactcgccatatgatgttgtgggcatcaattggaagatgtcatctgataacatcaagaaaaggtagtaatttgtatgcatttgcttttcttgtttgcagttgtgtaatttgcgaatgacatgcatacatatacagtatacactgcgaagaaatgcacatatttcataggcctacaaagtagtcactgaaaatatggtacaggtcacaagcacaaatttaaagtacagatatccacacaattgcatagtgcaatgacgttttttatgtctgtagcaagatgcaaatgttgcacattatgctttcaaaaaatgatgtcaaggcttcaagaatatttttgttttagtcatttctggtgaatgcaacacctatcatatcaatattttctacttgtagcattagttcttttgaagatgatttaatacattagattgggcacaaagtccctgtatgcggccttgtaaaatttgtttcagaacagtggtcatgaaatgggcccaacattcagaaagaacggaaaacttatatggagattcaatttctagcagtcttactacttaggtctaatttctgctggcatacagccctgggctacaaagttttcatcgtcctcagtcgggcctcaatcctatgcgctgacatgtttttgactgtaaattgttatatatttcttaatttcagagataagtttcacaaaggtcatcccttctatgtaacgatggggttgtatctcttttcattaagaaatgaatccatgtgtcttttatctctccatcttatcccttcccctagtggtgtgcggtgtgcttgtctccatgcgcgctgtcatgccacttgggtagggtctccttggctatgcctgactgcatgagggccctaacctctaacctgcccagaacaaatttacacatgcagttataccatgcactcaaaatgacctttctgtgaataaaactttaagattctcactaaagaacctgatagtagatgcagtttcatgtgaaatagcaccattccattgacctcacctgaaatttgcagtagtgtttcttacacatgaagtaaattgacattgaacctaaggcttcttcttatgtttgtggtgatatattgttttattagcatttttctaattattgtatcttgaggtattcacgtaatatttgtttgctggctgtagctcatgtatcgagggaacagcaaaatttatagtagcatttattacacacaataacttgcagcatagaaatattttataaaggctattgcatacttttattttgtaattcatgtgtaatatatttcatcatgctgcattctgttgttcagaaagtttctttaattgttcttgctgatctcttatcctgcatggcaggtac

SEQ ID NO: 48983 - DNA, 1501 bp, Oryza sativa
agaaggcatcagtggctgggaacttagaccatcattccgtggcccacgtcttcctcgttggatggaaaggttatcttattttcattgacttaattatgctagatatttacaacttgtgatattaattgcactcctgtctcctgccatttttttctctgtggttttggacacaagttggtaactcactatttttttccccatctacaagcaacaaatccacgcagtttatttttgtccctgcaaaaccttcatagctttttctacaaagcaatttctcagtcgtgcatttgtaggcctatataatactccctcaattccaaaatataaggcataaccacccctaacccaaagaccaagaaaataattattatcatcttgtagtttggatcatcctaataaatacaatgcatgtatccaatagaattagagaatatgagagtggaggatttaaaaaagtaataatttaatgtagaaggggtcatagttaattgcctacatgcatgcatgccttatattatggagcatcttcaaaaagtggttgtgccttatattatggaatggagggagtagctttttggcatggttaaggaatgttctattgtaaccgaggaggacaagatagtgagtgatcattaacatgaagtgaattcaataatcttgaatttctgtatgtgctgcttgccattttgcatttggtttgtgccaatgtatgcttaggaggggctctgcccaatgaaagcttctctttgtttgctggaaaaatgtgataagtaccaatgggtctttagaattttgaataaaatttgtaccataatatgtaatgactgaacaatatggaccggattattttcacctgcatgagatcttacgcctaccattttagctttatgaagttttgttttgtattattaatattatgacttatgtatggttaatgtaacagattccacatctatttctgtgatgaaaatttttctctctctttctgatgactacacttatttgttctgatatcagtggggtttcatcgttcaatgagtttattcatgaactctctgtcgattctgatggtgaatcagttactgactcgatccctggggatgatgaaaacgaagattttatatgtccttcatctccattgtcccaaagttcacgattatcacatacaagcagtttcagtaggcgtgatcgccgcttgagaagacctattagatatgcaatttcatggattctttggcctgccagatttcttgtctctttgctggtgattctgttcaacgctatcaaatttcggatcatgcagacatctaataaacccccagaaagtccccatatttctaggaacttccgttctaggagagggcttcacattaaggatcaagttctccaacgaacaactgacaggaggcgtggagttgttgaggtactacttttataaaagtggacccttagtttgtctatcttatggcatgacaaagttgtgattattgtttaacctatt

SEQ ID NO: 48984 - DNA, 549 bp, Oryza sativa
tgatttatcgagaaggattctctgtcgtacactctgctggctaaacctttccggacctgacccttgtatctttctgacccatgtatggaatgatttcttagtcaacttccgagaggcattgaaatgatttctggaagctataactgttgccttaaattaagtaaaaccattcttgatccatgttcacaccactagggtgttgtttccggtcactattttccacataactttcaaggttatagagttctaataatccatatatgatatcactctcaaatattccatccatcttttcatcgtcttggggtacccctaacactgcacctttattgggagaactttaattggttttcaatttaatttaattgatttaatgaactttgttttatttaaaattacttcttgagctccaaaaattcaagagaaatttcagagaatatttagggcacaaaggatattgcaaaaatattttcggccatgattttaaaaggaaattttaattccctcattaatttacttgataaaattaacttttacataatttctaga

SEQ ID NO: 48985 - DNA, 704 bp, Oryza sativa
cgacagtttttcgcgggttcacccatatttgtggaaaaccgtatcccgccctgaggaaagttaaaacgcctccccccacccaactcccgaagccaatagatatatatttacagaaaacggaaataagccccacataacgcgaaacgcctctctccccgggggtgtgtggcaaatcttataaaaccaggtggcacgcacaagtttctcccctcttgaaaaacgggcccatgtgcgcccacccacatataatttggagtgtaaggtcccccccattagggcccccacgggtctttcacctcttaaatctttcggggttcgtatatgttgtgttgaatatgtgtaacgggaataacaattttcaccccaggaaacaaagttaatgccctatgtttccgccaaacttattttgggttcaccttataaaatactccaagcttggcctcaagctggggaccaagctcgggttcaattagaaacggcccgcaatggtgtggaatttttccaaattcaaaaagttatccaatacctaccggaaagatcaaacccaagtttcctgtaaaaaaatatatagatggtagtcatttgaacgtgttacatgtgtaggtttgggcgtccatatatgcctatataatgggcacggtgatgcacacaataatcaaacaagattcacagaaactaccatcaataacaggactcctgcactt

SEQ ID NO: 48986 - DNA, 1061 bp, Oryza sativa
ctcttcccccatgcgacacgcatgccagtgggccccaccatttatcttgcctccacatgccacgtgcccctatcaaacatgtttcaccaaaggtattcacaatgtttcactatgtatatatataatgttgtagtatattgaaatattcttttgcaacaaatcacccacatattttggaaaccctctattaatgaaattcgtttcattttttgttccaccaaatatgtttcacctagtgtactcacaatgtttcactatgtatagatctaatgttgcagtgaacgaaacattcttttacaacaaatcacccacatattttggaaaccctctattaagagaattcgttttattttttgttccaccaaaaatgtttcacccagtgtactcagaatatttcactatgtatagatctaatattgcagtggactgaaacattctttcgctatttgctgaaacattatttttatataaggtaaaacaatgcccgatttaaacgatagttccaccaaaaatgtttcacccagtgtactcagaatatttcactatgtatagatctaatattgcagtggactgaaacattctttcgctatttgctggaacattattttatataaggtaaaacaatgcccgaattaaacgattgaaacattttcgatatacttagtgaaaccaattccgatatatattggggaacatcgtgtaacttttaaaaatattcaataataagcttaagaaaaattcgccggaatatatcatgtggtggttttgttttgaagaattaattgcaacgaatttaatggtgcaatcggatcatgatttgaataaataatttaagaaaaaaaatagtttaaagtagttttgtacgcatgtgtggcgctgacgtcatgcccgatcggtagtcccctccgataaataaataacaaaaacgcataaattggacttcgtgttgtcaggtattttttagaactgagttatttcttgaccgccgctgattccctcaaaatttctgcatatatatatatatatatatatcctattatttcactacttgaaacaggcga

SEQ ID NO: 48987 - DNA, 1501 bp, Oryza sativa
  unsure (1)..(1501): unsure at all n locations
attcacaaacagttcaaatgtggaccaaatttattcgtgggctgaatttgttgacgagaattaagtaggccaaattacataatgggctgaattccttgacaggaaatgggtgggccagatttagatttggaccgaactcaatggttacaaacaagaaggcctaattcgtgtctgaaacaaattacacgatgtgactctagcgtgctaaatttcctagtgggctgaatttgtgaacgaaaaatagtgggccaaattctgtggtcggcctaattcattcaaggctgtgagtgggccacaatttgattatgggtcgtttttgttgcaaggaagtaagtgggccaaattcagacgtgggccgaactcgcaagttgttgtgtgggccaaattcatcacaggctgaactcgttgacgggaatagggccgaattcatttatggccttggtgggctgaatttgttgataagaaattggtaggcctaattcattgacgggaactaagtgggctgaattcgtttacgggttgaatttgttcatgagaattaagtggttgaccgaattttctctaggtggggcaaatttgcttgcggacttaatttatactgggctaaactcagtgggacaattagtactgggccaaattcgtggatggatctaaagtgggcaatattgttttttgggccaaattcgttagtgggatttttataggccaaattcgttgattgttattaagtgggccaactttttacatgaatcaatccaggccgaatctgctcgttgccttgggtgggccgaattcgctaactgggtataggtgggccaagtttactcttgggcctaaaactacttggcccgaatgtaggtgggcctaattatttttgggaacttagtgggcctaattcacttgtggaccaaattcgcggacataaattaagcaggccgaattcgtttgttgatgtcgatgggccgaattcgttcatttatattctctaaaaataaaaaaataacaggggggctcgatgcaaaatcccctcaccggctgaaaaatttgagattgtttcgcgagggaaacatacgaaaagctttctcccccatttcaagcggcgcgacggcgcnnngcggccggcgagannggncnacgctagggtttttnctctctctccgccgccgaaatcgaatccccgaggtgagctccatctcatacccaccgagtctcaccgtcccganccatctccttcacccgccgccgccgcttgcgctgccccgccgatcaccgtgagctgctgcagcttccgcctccggtgagcacccgttgccgacggacatcgtcttccttcctcatccatctcgttctacccgctccattcctcgaattcgcattagccttcatcttctcttctggatctggaagcttttctgttcgtcttaaccctagtactaattacagttttttttacccaaaattttttttggtgccctggctgtagagatgaatgcgaatgtgt

SEQ ID NO: 48988 - DNA, 377 bp, Oryza sativa
  unsure (1)..(377): unsure at all n locations
cctattattctanctattanttatatatcttaatattgtagtacttctatcattatattttttnttacttatttctagtangtagtttatgattcnnctccncccccctattgnanttttntatctattanccccncnnnnnnnaanagaacaagaaggacgaacaaaacaagcacaccaacaatttttttttttcnactactttttttttttacgaccatactattaagtgattatttttttttattagattttattacttcttttttatatgtttttatttagtattaattaattttatatttattttatatttttttatatatttttttatttttattatttttttttttatttattttttttttttatttttt

SEQ ID NO: 48989 - DNA, 623 bp, Oryza sativa
taacaagatttttagtggaattttcagagccttggaaataattttaaccaattaaaaatgagcaagcgcaatattttaatcccaggaaaaaagttagtgaagttcttgtgctgagattctagaggtcttccaagtagagcaacccacacttgtggtggatttctattagtaggttgagttggatcttggtggtcactcaattctagaaatttgcctaggggtgtttggggttgaaggctgcggatttcctctgggatttttgcacaagtgaggcaaggggttaattgagacccagctctttggagctcctcaacggagagtaggattgcaagatccgaacttcgggaaaaaatcgctcttgtctctttctgtgatgtttctgtggatgattctgtgatatatcctctgcttagaatacctgtgcaccatcttgtgaagtttggcttagtctcttgtttcgaaatttgaatttcatctctgttcggttgaacaagaaattaatcatcggctgaggaaagcaaaaccgaggcaggagtggcgtgttaagaatcaggttcctctagccgatgatgttgcagccgatgaggcaaaaaggttggccaaagggaagagtgttgtgacgg

SEQ ID NO: 48990 - DNA, 603 bp, Oryza sativa
  unsure (1)..(603): unsure at all n locations
ctgcttggttaggccgaccaaaattcaaacgttacctttgtggtctccagttgaagccctcccaataggtttcatccgtaccggctcgatttttatgccatctacaaggtttgtgcaagtaatctttgtcgncctcgtttggggctgttttgaatacttcaaggtgacggccgccaaacctagacaattaggaagcgtcacaataaattatctgtactagtgtataaaggnacgatccaataaatagttatttttccaattcagcatgaataaccntataatgatcttaagtcaaacnaatcaggttctcattcatactgttttgtatcaataatcataggaaccgtaaattttatttcatggaaaattcattacactcggcttgccaatcttctccacatgatttcccaaacttaatacaaatatatattggccattttacacattacacccagtctatgctctacgcatgcagagaagactagctagcctgttgtgtgtggttggtacacgggcacacaaagatttcattcttcttggaagtctcccaattcagtagaatatattatgatacatgatatatctttattttgtatatgtaga

SEQ ID NO: 48991 - DNA, 1449 bp, Oryza sativa
taaacttttggattaaaatggcatgctttttaaactgctaaatggtacatttcgtacgaaaactttttatatgaaagttgttctaaaatatcagattaatccattttttaagtttgtaataattaaaacttaattaatcacacgttattaccacatcgtttttgcgtgaaacacttaatcttgatcttgatcttcatcttatctttagtcataagaaagtacctccgaatataaatccaaaaatatattttgttatggcagaacctaattaaatattattggattaatcgtttataaaaactcaaaatcaaatagtcgaaatatgtcttatatttttcaatgaaggggggggggggggtataatgttaatctttgttgtaatgttacatttttagaagtaaaagcatgcactaggtcatcctgtaagagttagaaattcagaatccatttccactagctagcagcaacagaacgatacacagattgcacatagatgttcttagccgccaattcacgagatagtggctgaaaaattctggaagctagagagaaccagaatgccaatacagtagacatgagacacatgacatgcgttgcagaataagcttaagaaagaagcagacggaagttgcctttattccgagcagaggaggcatgcatgcatccactggctaagctgcaaatgtgtcaaaaaggcagcagcgaatatattctctcgcctcaccaccaccggcaatatcagtgtgtatcttgcatcgttctcaggctcagcatgaaactaatatgtttacgtgtttctagtctacagattgatagccactggtttctgtgttttatgatgaggaagtcttcttaggtccagttttttggctgtgtacattctatacagagaccgggggtgaactcagttagaatgtatcattttggtgtatgtaactgagtcttaataaagcttctattatctaaaatgaaactaatatggattccgaggtctaatcaagcccatcggtcatagctaatcggtgtatgcagatgatttcatggttgcatcattgttctgtagtcttaagcatacagtaagtagcttggtttggtcagaggcaagatcctctacatcaggaacacactgcatctagccgttctggattctttttcttcttaatttctttcttgagagcatgtggcctggaagaaagttggtatagctttcagcccaaattaattaacatctgcaactccagcccattgaaattataatttacaggccaagcccaggatgctgttaatttgggcttttactcgaggcggcatcagtggcctaaagctaatgatacttgcaatttcctcgatacatttgcaaaccatctccttttagattaagaaaggggcttgttccactgaggttaatttttgccgtactaaatttttgacaacttcaataatgccaca

SEQ ID NO: 48992 - DNA, 1501 bp, Oryza sativa
ttcaccagttgcaacacacagtcatataatactctaggttgcttgttattatattttcctctttcttgctttaaatattttttttcttttacactatttatccaatttgtaatatgattgtaccattatattcgttgtaattaaatctttacaataaaatatcatataattatattctaataaaagaaaaacatgtgtttcaagggactattgagttaggcagcctaggagatgttgataccatcgagccacaatcatagtttctgtttgggttaaagcaaaactgcaaaaccttatcgaataggatttttgctggtttgtttattaccagaattaggctgctgaaacattccttgccaactataaattggaggaccataggaagctttctgtcataagctgagaaaaacaatagacgagtgacgatggcgttcaaagcattcttcattattttagtggtttttgttagcagccttgcatctcctgcagtagcaagagatggacctacgatcaacccaacgatgggtaccaggggcgggcccactattgattcaagggtattcagacgtatacccaagatttttagacaaaaaaaataagtatatgtactctatacctcgtatatgtattcaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacgtgcgcggtgtggcggcgaggacgtgcggcagtgcggcggcggcgacttcctgctgcgtcggcggaaggcggcgccaaggcgggtaggagcctaggcagcgcgtcgggcggcggcgactgcagtctagtctgcagcgtgctcgtcggcggctgcggcagaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccaccaggccaccacacaggtacgcgatgcggcagccgaacgaccacggcttgccggcctggcatggattgcgtgaggggcttgattcattgattcattgcattgatttgttctaggtagttcaatagtagttatgttttccggtggcgacggcttgtttcattgatttgttctatagtagttcaatagttcactagcaccgaaggattcaacttcctcagttcctgtcttctttatttttcagagtgttaactgttaagtgtatatttattgacagattgatagtataaagctgtaaatattaggaatttagataacttagaaccataatatttaattttcagtgtgttaaatttatatatatgatgatagtatg

SEQ ID NO: 48993 - DNA, 1501 bp, Oryza sativa
atggaagaacgggggttggcgagaacgatgagatcggattgctggccggcgagctgggtgcaactattgaccaaactttgaaaggtttgggggctggttctgcaagtcaggcttccgggcttaacaaggcgattgtgctttttggcgaaaatctggattctgtggatgaggcggaggaggatcttttttatgttgatctgggagagttagaacaggaataggaggttaagtggctggcactggcgaggttctattcagggcaacggtacaatgtgaagggtttgtttgaggagatgagtacggcatggggtttacatgagacaagaagaacccgagacttaggagaaaacaaattcttgattgagttcggctgtgaagctgatttgaagagggttattaatgggggcccttggaagcacaagggggatgcattgatagtagttccctatgatggtattgtgagaccgttagaggttgtcattgactctattcccctctgggtcaggttcttcgatctctcggaggtaatgatgaccacaggtttttgggcgagaaactgggtgcggtgattgaagtgcaaggggcgatgtttaactttttgcgagtcaaagtgcagttttcacttgctaatgctctaaaaacctgcattaagatgagaatcaaaggaagaggtattatatcgtgcccaataaagtatgaaaacgtatcgttcttctgcttctcatgcaggcgcattggccatgctgaaagggagtgtccagaggaaggaatgtctgataatcctgtgagatatcggaaggagctgcgtgcttcaccgttgaggaatcgtgtgcagtagatgggttcttcatcagcaccaagagtagtcagagggctaaattttgttggacctcagaaggataaagtcctttctgagtccagttcatctaggaattcgcaggtaagtcgtgctcgaggtggtacgcccgcaaacttgggggttcggaaggatgacgaagctgttactgagttagtaaaggatgatatgtgtggagcagatgagattttgggcaaaagtgtgcagcagatgcaggtggaagatattggtcccagtctgaatttggttgctcgtgggccttgcagtagagagagagtttctatgagttctgactatggtctatcggatgataaagctgatgaggtagattcggcaaaagctggaggagcgcagacataggtcagaaggaagtccccagactggttaataaaaaagatgcagggactgccttctcgtgaggttgaaaaatcgagtagcgccagggtctttatcaggagaagggacattgggaaaccgagaaaaatgaatatcaaactgtctgctagtgatattgagccttttaatcacatggtacagccggatgctaaggatacaagtgaggattctagtgaggcacatgcaatgctgaaggaagcattggtgccagacctggtgggcgctcaggatgagccccaccaggagcaa

SEQ ID NO: 48994 - DNA, 1501 bp, Oryza sativa
taagaacattcagccgcattgaagaccgactaaatatcatatcgactggacaaggaattccataaaagcaacatatccgtgcaaaggataaaaatgatactagtaactaagaagcagcatgaaagagaatactgggacaccagcggttaataaggctaacacgtaactcatgcatttgcataatcatcatatggaacagacaataacagccataaagaacactggcatatccaccagaagtagaaaaattgtcagaatcctttggtactaaccatgtggcatcagtaatgactattgataacagtgatattgccaatgccttaaacattaccacctaaaatatgggcatgatatgtcattctggtgttaagtgttaacacaaggagcaaataaataaatgcacaatggacagttcaatacctattgggtatagaaagactaacacacaaccttctctcattacctatgaattaaatcatatataaatcaggtaaaaattatctgcgtgaaatatatcacaattgtatattctttttaaaagagggcaatgatggtggcagtgaatctgctaccacctcaccaagtatagtattttttttttatttaccacctactccataatgttctctaccaactagcccatgtactttaatgttataaaataacccctctacatatatgattctatcatatttcaccttacaatatagcatctacaggtacaaaattgtcccaaaaaaatcactattaatttgttttaatccgtagcaaagcatgggcatttggctagtatttgtaaaaatatcaatattctatacacatctactgtcattgtgaaaagaataaggagactaataaattatctgccaggaaaaagggcagcagctagatatttaaatgtctatgcatcaaaagatgctagagctactgctatttctcaaggaaactaatgctcttgaacactaccatcaagtggaatgcatgctgcgacaagaccacttagtaaattactaacttagtaaataccaatacttggttcttaacaagcggcctactataattagctttaaactatcaagtatcaataacattataaagatgagacattatagcagagcaatggtggaacaaaaaataattctatctgaaataataacattttctagcagaacaatggagcaaaatatagcaaatatttccaaacacataatattttcaattgtgacgaaaagaaaagctacagcaaagagccatttgttttctcgcatagattctagaacgcaggtaatttacctccgtttagggggttgttcatcagcatcatttttcgctggctcttcaggagtgctatcatttttattttgcacatcaaaattggatgatggttgttcctgtctagttggtgacgctggatttttattttcattatcagccagttcaccgctagctactaatgctgatccaacaacatcaagggtgggtacactctttggtggcaaca

SEQ ID NO: 48995 - DNA, 1501 bp, Oryza sativa
tgcattgtatttattaggatgatccaaactacaagatgataataattattttcttggtctttgggttaggggtggttatgccttatattttggaattgagggagtattatataggcctacaaatgcacgactgagaaattgctttgtagaaaaagctatgaaggttttgcagggacaaaaataaactgcgtggatttgttgcttgtagatggggaaaaaaatagtgagttaccaacttgtgtccaaaaccacagagaaaaaaatggcaggagacaggagtgcaattaatatcacaagttgtaaatatctagcataattaagtcaatgaaaataagataacctttccatccaacgaggaagacgtgggccacggaatgatggtctaagttcccagccactgatgccttctaacatgttggccttccctggtaatagagtcaacaggagtgctgatattccatttatcaaccttgcaatattgttcagtgattcatatgtgaatgtcttcacagatctggccaaacaaatgcaagaattcaatagtgcatctcattcatacagaaaggctaaaataagagcaacttaactggcatcttataaacttcacagtagagatagcatgcatggtttttgtttttttattgaagcatgaaaactatccataaacaagtacaagcaagtaaaccccagaccacaaatgcacttagcaaagacataaatactacattgaaaaaagaacaacttagaaagcctgggacactcatagacaaaatgtcagaaatttgcattctaaggtacaagtcagcaatcagcccatatttgtccaaggctttcagctcttggaatcatctacaaagaaagattaaaaaaaaacaaggccagaactggtctttatggttcaaattccacatccatacttatgtgtgagaccaagaagaggttaacaaacagcatagcagccaacgatggggcaaagcggtgttgagtaggaagttcacacttaacaacggtgtcaagcgaaatggccccatgtcattgagatccttattaactgaaatctcagtgatcttaggccctgttctttttcagctacttcatcaagttatatggtggattatttgctccatgtctctaaaaatacctttaattttcaaaagaaactttcttctaatgcattcttacaccacttgttgtacggtacttattaagtttatttctaaaaatatttaatttatccctacaatcaagtacataatccgtttaataatctgtttcaaactgggacctttgtgcagccggcataattcagtaattcacaattctacacacaaggtatcatggtactactactaaaaaattagtgcttagccaatagcgacgccatatttttctgcccaccccttaccctcccctccctcctctcagcatctcctcgtttaacattttgacattgaacctaatccaacaaattctcgtttcatggctattctggagagatgaa

SEQ ID NO: 48996 - DNA, 1501 bp, Oryza sativa
gcagcaccatagaggacatgatgtgaaacgccgtcgccgcttgtccgaaaatccaaatcaaggttttcacccggagtgtggtgtggtaggagtagggataaaaccccacaatggcgcctacaaggaggggatctgcaccatagggcgtcgctgtcatcaaaccaggcaaaatcacgtctagcttttcgccaccgtttccccatccagccccaacacccaagccagctcaagcggacacataggacagtccgtcatctcgacgtcgtgagctcaacaaaggcaccacatctacccttgccacggagctcccaatgacccaatatggaagcagatcgaccatagaaggggaggagcaacatggaggggagaatgttggccaacagaggggtgaacgacttactgcacacctggaccgtcactgtgccaccaccaaccacaaaaaaatgcagtgaaaggagaaggtgatgaccccgccaccacgcaccacgtgtcgccattcatcgacatgcatgccccgagcctccagattcaaacaccaccaacctggccaaatctggccaaggcggccatggatctgacccctccctgaagctcgggccgccgaccctggccatccaccaccttggagccatagcatgagagggacaccatcgccatgagcacctacttcgtagcgccaccgtgtcggtgccatctccatcaccgcgagtgcccgccgtgtcaccgtcgctgcaagcgagcgtgtgctcggaaactggctccgcagcttacgtcctagtggtcgcgctagccgccgtcggcatgctcagggtggcagtgaggagcaagggagtagggaggagaggcggaggtggcggctagggtttcgctgcccgaaccggtccctcctggagtgactaggggggccacagaccaaagcaactcccacttgatgtttttgaagttatcccacctaggacttgggatattaatacgtagaagctgttttgtttgctcgatgcaaattccctaatcgatggttaaaatttcaccgtagcagtggtttttattcacacagtagtgctgcttggttttatatttgtatctttttctttgcaatttttccggtacattagaaacttgagtgcttttgaatcattcgaaaaggactcatgtactacttatatatgtgttatttcagctctcttaaccaaattgttttgctcacttaccaatgaccactatagcacccatcaaaacatgttggataatggaaggcttacaatctaaactccggcctcttcatacctatgatgcataccgacaacaaaccaagttcaatacacatttaactcagaattaggacgaccctcaaccaaaaccaacccattaaatgaaaagagtcttaaactctaatcttgtaattgagaagatgcatctccctgcacgcggtcagactatctaccacacctagccagtaagagaaggcttatggacaaaaatgttgtgacatgcataacct

SEQ ID NO: 48997 - DNA, 1501 bp, Oryza sativa
aaggcacactaaacactgctaatccccctactttagaaaagcctggtcacccatctctcctcccatgaacaatgaatcatcgcgcagagtaaggtagaacatgattaccatggccagccaaaggggacccgaaccaccacgtagaaagacaaatctacctttttaaattttacgaaattttatactgtaatctactctctccgtttataagtcgtttgactttttgtttctagaccaaatttttagaaaaatatagtattatttaaaaaaacaaatatatattatcaaactatattcaacattagatttaataaaactaatttcatattttagatgtttttaattttttctataaacttgattgaactttacaaaatttaactagaaagaaagtcaaaacggagggagtaattaattggaagatcaaatcggcctataaagttagatcatttataatggcagcatactactcgtatattgtagcgtaaaagttctgtaatattataaggctaataaatagcttagaaaaaaaatatttaattggtactaaaatgtaaagttatagaagaaagtgtatttttagaagtgtataaaacatgaataatccatccataatctatgtcgccattatgagaaattctgatgcaggactaatttctaccggaataagttcacctgccatcccttatttttttgacatcccttatcctcaatatcagaaatctttacccctaaactatataaaaccgtgcaatttaggtcccatagtagtatagatatctagtttcactgacgtggcatcctagttaaaaaaaaagtatatgggagcccacatgtaagtgagaaaaaataatatgggacccacgtctcttttttcttttctttcttctcctcttctctcctgctctcttctcgtgaggtcgccggcggcagaagagggagagacggccggcaagcccagccgagctccgccacctcgagaggctctgccgccgccgcacccgacggcgacgacgacgctcacgtgcgaggctgctggatgctggcctcttcttccccctctctagtgttcacacctatgataactaaagaaggaaggctcacgacagtaggtgaacttattcctgtcgagggcggtgcggccgaaatcgaacgctgcggtggcgatgtggaggcatggtcggagcgtggcgagccggggctccctgcagttgggcagcaacgagcgcctacctgtgaccccaagacggtgtcctctggagtacccagccatcgagaaatagcctgggatgatcgtgccagacggtggcggcaaccgaggaggacgggaccgacggccgcagggctatccatggtgatggcgctgctcgccgggtcacctagtcacccggtcatcaccggcatcttcgacggtggcgggtcgtcgtccatggccaagaccgccaagatttcatcgcgtggaggcggggatcgcagaaggaggggtggatccatggcgatg

SEQ ID NO: 48998 - DNA, 1501 bp, Oryza sativa
acgaggcaagggtgagcatgatggagtttggatgggccttgcgatgacctttgcgaattccggattcacctaggcataagaggttagaagtgtagtgcttttgagccgaagacgaagttagagtaccaaggctcataccccgattaagttttgcctgtggagtggagctgaggatcgcctttttccgctgattctgctttcttttcggtgtgaggaccaagtgtttcttctgaaaatatttacgcaatatttatgtttagatttgtatattaattcatcatattgtgtaccctggtttgattctttgatagggatttatatacaaaataatctgaaaatttggactaaatttctgggcgtgacacagacccagcccaaaccgcagctgagctcgagtaggcggcgtggggtaagcctgttccaccagttggcaggatgggttgttgtagcagctgcagctccgtcgccgtggggtggggacccagcagcactagctcctcgccgctgtgatcgccatggaccttggacgttgtcaccatgttcctcctctgctcacactgactgcatctttgtcgacgacggacgtgcatccatccctctcctaacggtggtgtcgtcgccaccatcgtcctcagccgctaccacacccgcgctctttctcacgacctcggtgtcttcaatcctagaggatgcatgtggcgtggtggactgttggttggcaagggaggggtggagaaaggatttcggacatgtgggtcccacctaatgattattattgtaaaattcatttgagtgaaaaggatcaaggcgacgacaagtcgaaccgtggccacatatgcaccatatcagaacaaaaacatcgtgcaaacttcgaagggatgtaaattgatctaattttgtaagtcggaggatgcatgttctctacgtacctagttttgtggtcgagtggtgttacggaaattcgtccaatagttgaaattccaaccagtccatcccacgatctttgtggatgttggatgggcttgccgactatcgtaataattttttgtatcgtatggtctaaagtttgcctccgttttaggatgacacatttatagatagatctatctctatctctactattataaaagttaaagatatttttatcggtattttggtacgttatccgtgtacgagtcggtttttaagtttgttcgcttttggaaatacatatccgtatttgagtcgggttttaaattcgttcgctttcgaaaatacagaagaaattgtataagaaatattttttaataaaaactgacatgttaacttgagatgatcatactcctaattgtagctcatgattttcaccttaactaaaccatataacaataataaaattaaaatagccttcacctgttgcaacgcacgggtattttttctaattattatatctactattataaaagtttatgtttttgtcgaaaattttcgtacgtcgcatatgtatccgattagaagtaac

SEQ ID NO: 48999 - DNA, 1501 bp, Oryza sativa
tagaagatagatcaaggtcatatggcatttgaatttacttttggactgagtgagtaaatatcatgtataccatttgaacacataccatacaatattgctacaagtaaaaattgcgatagcaaggtgttaatgaccaaatttggtaatatcagcatcggagatgaagataggatcgaagcggaatcgaagataaggattgttgcggaaacagagtaagaatcggctggagtccgggtcggctacgactgggatcggctaaatccgagtcagactgggttaagtgatacagccgattccgacaatacgacttgtgtacgacatcgggttcaagttgatgtgcttcaagatgattgccacgcatggatagagtcctgggaaggcaattgtatctattaattaggatattttattagagataaatgtgggcaaaagtctgccgcaaagacttatggtatcttagagtttgttagagataagagtcgtgtccaatatggacatatcttataattctcgggtataaatagacctcgagccctatgtaattattaacacatacgttcaatacaatttcggcgcatcgccacccttttgctttagttttatttcgacgagttctttctttcgggttgagctgcatcggtttcgatcttcaacaagaggtaaaacttgttatgacgacttgtgttctcgggattagtgcttccatctttatgatactctaatcttgtttatgtaattcatcgagttaccatatattctatataatctctgacaatatcattatctaacctataatcggctaacatctgttagtagaaggcggccgattaggttaaatagcgacgttggcttagattatataagatatctaccaccctataaaatatccagcggcttgattgtctagatattgttcttcttttcatacttaatgctgcatcagttgagtttgatctattaagtcgtgcttagaatttcaatccctagcctgccttctggttgccgattagggtagtatcggagttttagccgatcttatctgatttaactacttctattttatacgctcaattgatatgttaaatctgccctttatattaagatcttgttgcatttaagtacattaggctcctgtttggtgtattctacttgctttaatatcttaatatagagtagtatcggagtattagctgatacatactagatctgtctgatcggctatgctatgagcatatataatcttgttgttaatatatatttcaatctaagtgatttgtactgtcttggcatgacgaccgatctatcccaatcacttgatttgagtatatatcgatataagggttatatattgctaatatctacagccgatcgagtagatttagttccttgttacatatttatgactgccgatcgattcacatatgacatcggctcaaggataaatgatatgtcattggcaattagccgatcggctatcatttatgaatttaacctcggtttc

SEQ ID NO: 49000 - DNA, 1501 bp, Oryza sativa
ttccagaataggggtatccaggggtatcaaattatttgattattctatgatctacatgctagaaccattatgttaagtggtctctctacatcgcgccgcagactgattccatcgccggccggtcgccgcccaatttttcataaactctaaaaatatgctctcagatacgttgtacttattgtccttcaatatataaactcccaatggttgagtgctcaatatatcttatctaatttgggaacacactatttgattatcattcataaaaagctggtagtatccccaggtatactaattgactttgttgtggatgggtgcataactgcagatcatcagcagatgtatcaacatggggaatctcgcctaatttctaccatggcacctcaagctgcatatcaatggcctttgataattttcaaggataggaatgtattttagttttttgtgtttaggtatgagcaccctcgaaaaaaaaggtatcacaaatggttatgagatagtagagatttatgctcccatgagactctaaatctctcataaggatgccgattttctataagtgaaaacaagctaaagtgcatggagagtatctatggaagtaatatgagcactgagtaggcgtctgcatcaaatcttacatttatttctatctacagttaaagaatgctaattaatctgtaatttgtcaacctcctaagctatatctcatattattccttcctgtcattttaatgtgccaattacatttgctttaaccaattttttaaatcttccaacatggacaatataggccctggtattttgctttttttataggattcctgtaagataacatgattgcaatataccttgatcccgagagatgatttttgcaatgtttacccaactttatttgctgacactattaatatccttctggtaatggttaggtttcctgttattcattcgatgttataaaatttgtaacacaagtgcataccaaaaggttattgttgctaatatatcctcaagaattagtgtgttacagacatctgtagatcattttttcttcgtggtctttgacgagcagatcatagtactctttacctgttatcaatggtttgggcattgcatatcaaacaagtatcctgtttacgatatatggttgccattgaaattttttcctaacattttggagagaacctgatcatgctatctcatcagaggacagagaagcggtcatcggcaattatgtgtttgccatgtggagattatgggtacctcatacccatacggcatggttatctgactagtcataggggatagcttatatcaaaggaatatgtaacaaatcatgacttgggtattacgtttccttttatattatggagcgacctaaagtcctgatttgacaatattgtaaaatagatttaggaaaccgataccgtattggttaaggtttctatcttgtaatcctggctcccatcctatataaggtggacaggaggccctctagggggca

SEQ ID NO: 49001 - DNA, 255 bp, Oryza sativa
ataactgcttcaacaaacgacactgtatatattatgtcaatcggggaagaaagtgctgctagcagctcctaattagttggccaatctgtcatgcgcgtgcatcatatggaaacatgcacttgcgtggctgtctgttgatgctcatgatgatcagaaaaataacttggcgactgacgtccggtcatgccgatcagagaaacaactcggcgacgacagtgattggatccatcgcttaaattaatcttgccggctaga

SEQ ID NO: 49002 - DNA, 236 bp, Oryza sativa
gagtgaaatttgacatgtatgctatgcttcttgtttttgtcgcggtgtattttgcgcaatcaagaacatatgccatcattggcagatattgtctgctcagttttgctaccctgaagtggaacatttgattgtaatgcatttgcttttagagagtggaaaaatggaacctgtttttcttctttagtcttgtatttacgcattttttcttcttctgatttatagttaaaaggaagcca

SEQ ID NO: 49003 - DNA, 507 bp, Oryza sativa
  unsure (1)..(507): unsure at all n locations
gaaccaaagtaatattttgaggacantgggtaaaacttttggtggaactatggtttaatcgggcttggtttacttaataaaaataagttcaacaataaggaaagatgtttcagtcaatgcatattagtcttatccaagtaaatattctaggtactgggtgaacatttgtggtggacaaaaataaaacggatcctctaataaagggtttccaaaatatgtgggttatttgttgtaagagaatgtttcgttcactgcaacaatagatctatacatagtgaaacattgtgagtacactaggtgaacatatttgggtggaacaaaaaatgaaacgaatttcattaataaagggtttccaaaatatgtgggtgatttgttgcaaaagaatatttcaatatactacaacattatatatatacatagtgaaacattgtgaatacctttggtgaaacatgtttgataggggcacgtggcaggtgaaggcaagataaatggtggggcccactggca

SEQ ID NO: 49004 - DNA, 196 bp, Oryza sativa
  unsure (1)..(196): unsure at all n locations
gacggcaaagccggtgaaggtggttgagcggcgcagcgacggctaggacggcagtggtggtctgctgaagacggcgtatggtggtggtggctcgggcgtgtggtgaaagtggcactaggcggttgttttggaaaggtggagtggcggctggcgtgcggcaaggtgtggcgaatgtggtgnaggcggtggtccggca

SEQ ID NO: 49005 - DNA, 374 bp, Oryza sativa
ccactgcggcggtatcatgcgatcagcttcttcgccagcggcgtgaggaggagcttcctcctcgagccattgttcaccttgagggacgagttctacaccatctacttcaaccttgcagcctgacaagtgagtgacaacgacatggcaatctctctaattttttaaggtggtggaagataattaatttgggctaatttaattctttgatccttcaatgctcaatttagtaattagtacaaattagcatggcaagtagcagttgaatgggaaaatgagtttggtttacatgtacactctgcctctcagtgtttactggagtagcagtgatgttactctgcaatttcagctctttatcttgccattcttttcttaga

SEQ ID NO: 49006 - DNA, 529 bp, Oryza sativa
  unsure (1)..(529): unsure at all n locations
ccgtcatgatgctctagnacccttgcannagncnngnncgacgagttcttgctttcgggttgagctgcatcggtttcgatcttcaacaagaggtatttcttgtttttacatgtaagtctctcgagtcaacgtataagtgcattgaagaactgcacagctagatgatactgaaagtgcattaatccccctagtgggttttggtgattaatgacaaatgtggttaagggactaatgagttcattgagtaactttcaggtgcattagtccaaaggtgtggaagatggatgcttggagaccccccaaaagtacaaaatcaaagcggactggaactcgagaagtgcataggatagtttatcttttgaaatcgagtttttaggaaaaaccgtactattaagaggggttccaggtgatgctctgagatatgtcaagtgctcttagtgtgaaccaagtgtcaagtttccctaggagtcatttctgcttatactccatctgtccaaaagtgcaggtccggaacttcctgtcttctagg

SEQ ID NO: 49007 - DNA, 345 bp, Oryza sativa
cggggctcggcagcggacttcaaaattttgttaatgtgttgatttttgtgatacttgaatgcttgagtgaatggaaattgttgattgtaaatttttcatgtaattttttgtggatttttgaatacttggataaattactgtgaaatttttgaatggtggagcgttgacggagggcggacggagcggtgtcgctccgttttttaaatttggccagaattaacactggcggctagcacattgtaacccgccagcgataattcattttcgctggcggtcgtcttaagtcagccgctagcgaaaatggatctttgctggcggttggcttaagatgacttccagcaaaaa

SEQ ID NO: 49008 - DNA, 224 bp, Oryza sativa
aggaaataagccaaacgatgggacctttctatctttgtgttaacaatggcttgacctgaccagaccttactctgactcaaatctaggaattaggatgcggcaaattttaggctttggcagtaagaaaatgacaaggaattaggatgcggcaatttcacctcgcaattctgtcgtttcagatacgacacatccaccttggataactcacctctatccacgtcacc

SEQ ID NO: 49009 - DNA, 1501 bp, Oryza sativa
tggggccctccggcttggctcaattcataagtgccatttttttaaaaaaatacggtaattataggtgccattttttattaaaggtttaggtttttttttaaaaaaccgacacaatgtacctggtttttatttataaccgacacctataattacttcaaggtgtcggttttttacgatttcaacccgcggaggtgggaaaaagcctataggtgctggttttagcacttctggcacctatagtgccgacacttatttgatattttgcagtagtgtgaatttggtgttataagtgttaccatattcttctataagtttgttcaaacttttaaaaagtttgactaaaataaaattaaaaaaactagtgattaaatggagggagtatcaactagtgattaaagtaatctgtgattcgtaatgaccaaccatcaatgataaagcactccgtagataaaaaaaatattgaaaagaaaccaacacgcctgccaggtgcaacacgttcgttcggggttttcattttttgctcgtgcgagtttgctatgatgatgcagcatcgtatttggccattttttctctataatacaccctgtgttttcaaacacataacattattaacttttgaatatatataacaattaattattagtcttattaaagtattcggttggtaaatggttttatgttacagtggatattgaaaacgagaatggcgggcacctcagtcatgttgatggaggtgtagaaaatgatcatagtctacaataatttttgattttttttaaaaaaattaagtttgtaattagtaatatttaattaattatatactaattagttcttttagaaacacagtataaacgcagacgctcacaacacgtgtgtattcaaatctatgaacacacaaacactctacccaattaacatctccggaagattgggctaacatatctcctgattggcaaagtaactacgggcatgtcgcctaccgagcgccatgttaaatttatgatttgaatctagttgagctggttccatcacaagaaattaaaactacctagttgagctacgctcgtttcacgtgcaccgtaaatattctaaactcaccgtgaaacgaacgaagcctcgcctcccagacaaccacactcctaaaccagtcatgcgtatgtataatctctaacagttcgcgatagtgtcccccgttaggaatattttgtcaaagatttaagagatactgtcctaccaactacgttgtcatttaaagtaagctgtaataagatttgcaatgaccaatcgtcaacagtaatgcacaccatagatacaaaacaaatatattgaaaagaaacaaacacatgttgcaggtgttacacgttttttgggtcctttattttaacccgtgtgactaggatgcatgtattatcgtatttatttctttcactatagtacacactctgtattaaatacaaacgccctattaactatatactgtatcttattaaaaaaaatcagt

SEQ ID NO: 49010 - DNA, 401 bp, Oryza sativa
tccgccgccggcagcgccgcctgatcccgccctcgagcggtcgccaccgtgctggtgaggagagagaggagagattgggatagagtagtgaggggtagagaggggaggggaactgacaggtggggcccattgatttttttaaaaaaaaattgctgactggactgccacgtagactcaaaaccactccggattgagtcaggggggttatttatccagtttcaatagttgagggtgtagaatgtctggttttcaagtttgggggtgtaattcggtcgacctcgatagttcaggggggtaattcgtactttttcctttaattaatgggacggtatatactaaaaaaacatctcttaaaatcttgtgaattttgaaccattatatcactttaaaattcgtgcagt

SEQ ID NO: 49011 - DNA, 1501 bp, Oryza sativa
aagctgaaggttctacgtttaagagacttgcctaatctaaagaggatggatattcagcaaggtgccatggtgagccttgaaagattaagactaataaacctaagcagcatggaagaggtccctctaggcattgagtttctcatgcccctcaaatatctaagcttcgaggagatcactgttgacttcttactgtcattgcgccaatctagaattggtggtatgcgatggtggcacactttacgagaggagaatgatatggaagctggtgtaagaacgtaggctacttgattccgtggcaattagctactgttatgtaatataaattcaattcaatatcataaactacaacactagctagctatatgccaggttatgcatgtcacaacatttttgtccataagccttctcttactggctaggtgtggtagatagtctgaccgcgtgcagggagatgcatcttctcaattacaagattagagtttaagactcttttcatttaatgggttggttttggttgagggtcgtcctaattctgagttaaatgtgtattgaacttggtttgttgtcggtatgcatcataggtatgaagaggccggagtttagattgtaagccttccattatccaacatgttttgatgggtgctatagtggtcattggtaagtgagcaaaacaatttggttaagagagctgaaataacacatatataagtagtacatgagtccttttcgaatgattcaaaagcactcaagtttctaatgtaccggaaaaattgcaaagaaaaagatacaaatataaaaccaagcagcactactgtgtgaataaaaaccactgctacggtgaaattttaaccatcgattagggaatttgcatcgagcaaacaaaacagcttctacgtattaatatcccaagtcctaggtgggataacttcaaaaacatcaagtgggagttgctttggtctgtggcccccctagtcactccaggagggaccggttcgggcagcgaaaccctagccgccacctccgcctctcctccctactcccttgctcctcactgccaccctgagcatgccgacggcggctagcgcgaccactaggacgtaagctgcggagccagtttccgagcacacgctcgcttgcagcgacggtgacacggcgggcactcgcggtgatggagatggcaccgacacggtggcgctacgaagtaggtgctcatggcgatggtgtccctctcatgctatggctccaaggtggtggatggccagggtcggcggcccgagcttcagggaggggtcagatccatggccgccttggccagatttggccaggttggtggtgtttgaatctggaggctcggggcatgcatgtcgatgaatggcgacacgtggtgcgtggtggcggggtcatcaccttctcctttcactgcatttttttgtggttggtggtggcacagtgacggtccaggtgtgcagtaagtcgttcacccctctgttggccaacattc

SEQ ID NO: 49012 - DNA, 1501 bp, Oryza sativa
ttatctagagcaggtgttcttgacatctacaagattgagaagtacaaagggagggtgcttacaagtattcgagcttccactgagacactagagagagtggtgaatatgctggggctgaatttgaagagcctagaagaggaagaaactagaggtcatgcagcatccatagtgcttgaacttgctccatacctcctattcgagaatttgcctgcaatgccacagcttatagcctcactactaacgacaggccgagagaggatcaatgaaggcccccatgacataaatagtgtggagctcacttgttatggtgtgaaaattcttgaaaggcttgtagagaatccagataaccgcagatctgtggctgatgccaatgtcgttttgtcgaaaattgtagaactgctaaacttcagagatgattgtaaggtacctgttccagatgaaactgagaatagaagccaagaagagatagttgaggcctcactaaatgtcctgcacaagctagttagcactactggtgagactggcgaagctctacgaagcaccatttccaagaattctgagatcatgagcaacatcagaaaaatcctgtatcagcatgataacaagaacagtagtttatctgttcatgctgtaaaaatcctttcttgcttagcgatgcatgagactgctagagaagtgattggaagttcttgccagatcgtcaggaagcttgtttcgtcggttcttccaaggcctatggatattgttcaagatggcaacaatggatccacagttgctgactcagccgcacaggcattagttctgctaagtactgggagtgaatacaacagggcaaccatccttgataaaattaatctggaagagcttgtcggcatgctctttgatgcttccatggagcaaaggattatgatagcacatctgcttaaacatttgcggacgtattcaggcccaggttatggaaaccaactgaagaaagtaattgacggttctctgccaaaggtaaattctgtcatatagttgagtttttgcctaaaattggaattcgatactaaattttctgcatcaccataccactgaagaatagctgaaatatgtgtcaatgaatacaatttttctgaaggtaaaataaagtgttcgcgtgctataagtttcggtagtaaactatctattctttgtcttccgttacatgttccaattctatttctgttaaaaagctaaatcttatgttttccatgacaatctgtattgcatatttagttagaaacttagaagaaaagtaatatatgttatcaattaatgccatttcagttattggaagaaatcaaagttgcagttcagaagctcgataatcctgaattccctgatggacaaccttctcatgtaacaaacctctctttctaagacatcattgattccatgtagcttccctcatttaaaacgtacactcacttttcttgagtaaactcacttaaaattggtgctgtgtacaactaggacctga

SEQ ID NO: 49013 - DNA, 1501 bp, Oryza sativa
ctggctttcccttatgtgaaccgaccataaaaaatattttaagggcgactctttaaaatgtctgcctgtaaaaatcattttagggtgtttcgttaagaagtctgctgacaaaacccttttttctttattctttgataatgactaaactttacttttttagaaaattcattttatgtccgattaaggtgaacagaagttctcaaccttacaacattctgggtcgatgtttccttaaaatacttcttttgatatgattgttcacttatgtcctgtagtctctatatgttgatatattgcataatgaatgggcatactaaaagaaatattaagtagctcatatcaaagaaaataataaataaagataacaatctataaaacttttggtttacctcgattgggccaaatatgaattttctagaatttttcaaactttgaactttctgaacaattccccgtaataatagatatatcaaagcctgtaatgaatattagccacctgaacgatctcatttataatagcttttaataacaaagttgtagatctggccgagctcgataatttcaatatagaacatttctccatccagcgttgtttggaaaactaaaaagtagttacgagaatagtaacaaaaaatttgccacactaaacaacctaaaatgaaacaactttaaactgcaaagttataggtttcatcaagacctacaattttcatattaagtttgtcatcatccgacttcacatgaaaaagttataatttttttcgtattttagtggggcttctagttttaacgtcttgtacagaatgcatggtccacgaaaatagattttataggtggatttctttgggatctgcccaaaaagtatacatatttttaaaggggaatttcagaccaacccgtaaaaatagtttttttaacaggcggttatgaccctaagacaacctcaaccatttccacaagtattttttcttttggatcgtctatgtgaagataaaagcctaatgtccgaaaaaagactttttaagtagcatcactaattaaggtgtagggttaattcttaaaattatttgattttgtcttcatgatcgactaataattctattttgcatataaaagtctaactaattgatataatgcggtatttggttgtttgttcacagctagaaatccccgaatatatggaccgaatcccgtacggggatcagagaagataaccatcaaatgctatgaagccaaattgctttgaaatgtttttgttggcttcttgctaaagaaggtccaacactgtatagtttttgcattgttattatgcatgtgcatgttactatttctgttataggatgttgtaacatcccggcctagggcttaataggattaatagaatactcatatcaacaagttgcaacttcttttccggaagccagtctggcctggagcaatttgggatgggtgaccgaccgggaaattcttcccgggtgcacacgagtgatcagagccgact

SEQ ID NO: 49014 - DNA, 825 bp, Oryza sativa
  unsure (1)..(825): unsure at all n locations
ggagagatggagagaaggagagagggagtgggagggtgggaaggaatataggctagcgattagagaagagtaagagatagggtaagtctatacggatacgaagtaggataggtataggctaaagaggaagtagagagaagagtaacagtataggtagagtagaaataagagtgagttaggatgaaggaaaggggagggtagggagagcaatagtcaaggagagggagtattgaaaaatgggtagcagggcaaagaataagagtacgtatacgagaactgaaggagaggagagaggaggacaggggggaggggaggagggtgtagcaagaaagaggagaggagagggtgggtagggatagggtaagtagaataagaaagagtatggtagagaggtaaatgggcggtcgagagtgaggaggagagggaggcgagattaagagactgaggtaaaagatacaagctaacgataaagcgaatgttgaataaagtgttagacagcaaggttcgaaatggcttaaggagacgacagatggtatgtcaagttgttacgcggggtttgacgaccacaaacatcggtgtacacgcagatagtagcgggtagggccccgaaatgcgttgaacgcaagaggaagagcttaagaggagatgacgactttattaatcatcggtgtgcttacaaagtgcaccagcagcactccgtcgaagaattttgactaaactcgaaaccataactcaaaagtcaaatcaattgctctataaagcgatagagggaagcttnnngntnnnnntntggtngnnttagttcntgnaattngatcctacagt

SEQ ID NO: 49015 - DNA, 225 bp, Oryza sativa
cgtcattgaattgacggtgatatgcgagtatctaatctccaagaccttctctagtagcattgacaccaatcataagactatttggttgagtttaagtgtatatatttttggtttttattggtaaaagaaaaaaatctcgatgttaagatgaggaagcacaagtgaacttatttctttttatgtcaacaaacccatccattctttccctcccttggtcctaccagg

SEQ ID NO: 49016 - DNA, 1501 bp, Oryza sativa
ctcctgccaccgccacctctcctctcgccgagggagcagtcgccgcctccgtgccagcgcgcggaagaggaaggagatggagagagagagagagagattgaagagagcaagacaagagagaagggagggagagggggagagagtgagagagagaaagaaaagcgagacgatgagagcgagactgcgagacgaccttatctcctccggtcgggtggtggtggtggggcccgccggtcggctcatccgatgccggcttggctcgatttgtataggtgtcggtttttaattaaccgacacctataatatattaaaggtgccggttttttaaaaaaaccgacacaaaatacaataggtgtcggttttatttagaaccgacacctataattatttaaaggtgtcccttttttgcgattttagcccgcgaaggtgggaaaaagcactaccggcacctatagtggtgacacatatttgatgttttgtagtagtacaacccattttgatacctccattcaaacaaaatataggatcattccaacccatcatatccctcaaaccaaacaaaaaaacagggttcgtttcatcccttcaaccaagcaaaaaccagaaccattccattccaaaaaatagggatggatccaacccatcccatcccatccccaaaccaaacatatgctaagtgaattgttcaatcctattttttggtgttagatgttcagtgggatgaagagatggttcctagattttttggtcggtcgtttatgctaatcgaatcatacaaatagcgaggatggtgtagaattgcgacatagtacatctggtatgttcactgttagatctgcttatcatgtacaatgggatcataattttggcaatctaaggagaaggtcgaactgaggcttctctctgtaatgagctagaaattacatatagtcttatagatataatatagttaaaaccatagtatattttcatcacaacagataaatcagtgggcttttccattgcatacaggaatgtggagattatggataccccatacctacacggcatgtatatccgactgggtatggggtgccatatgtagatagaatatctttaaagagactcgggttaaatttcaaacttgtatgtcaaggaaatatccggtatcctagttggttacgattgtattttatctgtaactacctattccgttagggatatgggctgtactttgtaatacggaccccttcccctatataaggaggggtccgggtgcctcttgaggtacgatttttttcccagatcatacgatcaataatacactcggcggatcaatccccggacaggagtagggtattacttcttgattaagaaggcctgaacctgtataaaattccttctctaaacccatccacttttctagcttgatagccacccccttttagtattgccgaaatcttgtttcgacagttggcgcgccaggtaggggtagcgtcaagttcttcgccgactagtgcga

SEQ ID NO: 49017 - DNA, 1025 bp, Oryza sativa
  unsure (1)..(1025): unsure at all n locations
ccgcgcaattgaanctcttctnaatncactacaatataaaattaatttacatatattatagaagtaacttaaaacaaaatgaaggtaacatgtcacaacattagaaataaatccgttgtgggggtaactatgatatattgattaaatctaatttctggatagatttatgtttttacccccacaatagatttcttttaataccattggatgggtttgttgacataaaaaggaataagttcacctgtgcttcctcatcttaacatcgagatttttttctcttaacaataaaaaccagaaatatatacacctaaactcaaacaaatagtcctatgatagtatggggcccacatatcttatttctaccagcaaaaccacccatatatactgcttaggatcttgattgcacgatttgtttgagtttagggatactcatttctggttttatggttaggggacctcaaaaatctcgctgttaagttgagggaccttcggtgaacttattcctcatagaaaaagctatgaggttggacctttaaaattgatttctcgatttagggaaatattttacctcgatagtgatgagcacgggttccgatcttgtaaagataactgttgatttagcaaaaacatgatacacattacctcacttcagatcaatattatctgaaccctgcaatcgtagaaccatgtcccctttggttatcatttatctcgccgagaagactaatttctacatgtgaatcgaataatacaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaa

SEQ ID NO: 49018 - DNA, 1501 bp, Oryza sativa
gttccttgtcgaaacaagatttcggcaatactaaaagggggtggctatcaagcggaaaagtggatgggtttagagacaaggaattttatacaggttcaggccttcttaatcaagaagtaataccctactcctgtccggggattgatccgtcgagtgtatttttgatcgtatgatctgggaagaaaatcgtacctcaagaggcacccggacccctccttatataggggaaggggtccgtattacaaagtatagcccatatccctaacggaataggtagttacagataaaatacaatcgtaaccaactaggatcccggatatttccttgacatacaagtttggaatttaacccgagtccctttaaagatattctatctatatatggcaccccatacccagtcggatatacataccgtgtaggtatggggtatccataatctccacagtagcccctgagacttttacagtcgacgaaattgtcttctctcgtagtgcaaaatgataatccgagtgcttgaacttcttctgccttgatctcccgagtaccaaaatcaaagactgtgaagagctgaaaataaaaaatcgggtgcatcgactagatgcacctaattaggtgtagccccagactatgtgattagttaaaaactaaacatatagtcaaggtgcaaataacatccaaccgagtggtcttataactaaatcatccaaagtatcatacagctaagcatatgggacgtttagtaaaacattcagccgactgctttaactttattataccaaaaattgagatataaagaggcccgagtaaaaaatactctaaaggtccataaatcaacacatatgacaagaatccgagtaaaaactctcaaaaagatccatcaaatgtggtataaatcatgacaatcgatgagtctaaatagcctaggctatgactcacgccataatcaaaataagcatataacatgccgagagaatgactgttcaaaaaccagtcatctcaacaaaacccgaacagcttttgtagcctaaaaagacttacaaaattagtataacacttttccatcgggcacctttttatttgcatcatagtaattccaaaaaattatctaactgcgtccaaaaggattttagcagcattgggctaccctgttgcgagcaagtattgctgaagcaaaatgcctaagtccctaaggatcacaacttagccacgctgatagaaagaagtgggctgaagtaatgtttcgggcctaggcccattagtactcccgataccctaataataccaaaagccaaacatcgcgtcgtcttccccgccgagactctcgccactttccccattcccagctacagtgcgaaaccacaccggcgaagctagggttcgccgattcactccaatccgtcctccaaaactccacagaaatcttccacacaacctccgcatcaatctcccatccattcccacccacattctggaccaaatcataccatccagttcgcatcca

SEQ ID NO: 49019 - DNA, 338 bp, Oryza sativa
  unsure (1)..(338): unsure at all n locations
gagtttggttcgtggctttaggctgcctaccccatgtataaatagagatgtgaatcgaataattcaagaaaaacatggtagattaaaaaaatattgtttagtttcgagtttacaattcattaataattttttcttcattgggaaaatttaacatctcggtgtaagatgaatattatatgttcaaaacttgtcgtcaaaaattaaaaacatagagtgaatctttgtccggtggagggatgccaccaccgccttgacatcggccnnnnnnnnnnnnnnnnnnnnnnnnaaccacctaggccacttctccatgactgacgccctcgaggcctcaccgacaa

SEQ ID NO: 49020 - DNA, 890 bp, Oryza sativa
ttgctacccctactttacttcaatataagatactctcaattaaaacaacaccataaatcactgctccactcttctaaaattctctgtatttgatctaatttaatctaaaaccaataggccatcaatgtcgttaattctaacaaaattgttaccatttcattaatatctccagtttcaattgcacaaacatatccttgataaagaattaagaatgtatccctatataagatagcccatatgtttcgtttacccacaattcccatacgtactgctcaatgcttaatgtaccattaatatgaaatcaggtgccagtcaataacaggttagtctgttcatatttcatcattttattttattttttatcttcttacacccccttcccataattatagtgtaatttccccttctgttttggacaatatgtttgcatgaaatattttctttagggtgtcagtgacactatgatgtgcccaattctcttccatataatatccaaaggatatacattttagagtgataaatggacacagagctattgtagcacaaactggtaacacttgactaaatgtgttacagggaatactgcagtagcacatagtatgtgttacatgaaaaggttgtaacacagtgtgaaacagtgttacagaaagagctgcagtgacatataataaaagttactaaggtttgattaccagtatttgcagtaccgtcggactcttgagcatattatattactttacttaaacaccgtgggaatggtggaagattaggtggccaactcatcaataactttacttaaacaccatgggaatggtggaagattaggttgccaactcatcaatattttcagaaacaaccctcatctctggttaattgtgttttggctcagg

SEQ ID NO: 49021 - DNA, 432 bp, Oryza sativa
  unsure (1)..(432): unsure at all n locations
gtgttggagtcaccgtggatggacgctcgggttacggagaatcgcacgatcgntatttcatgtgaccggtcagactgggctctggtagccggtcagaccggcgtgttatacgcggtcagaccggcgcagcccgcggtctgaccggccgacactgtgtcggtttcggtttcgggttgtttagttggatatccgagtttatttcatgattatgacttctagatggatactatacgtatgtaacactattgtttgctgctaatgagtcaagttagagatagcttggtcaaagaatatggtttctttgtttgttccatgagtaggtgtctcgatgtctccggagagtatttgcggtgatggaccgggagtcggcttggggataagacaacgtccgtggtggtcagagatcatgcgggatactagggctagagttga

SEQ ID NO: 49022 - DNA, 737 bp, Oryza sativa
tcctgcaccccccttttgcaaacctgcatttgatgcgatcatttcatatatcgcacgaaaatgccatttctattcatgtgatctgaaacttaatttgtaacgctgcaaacaacatctgccattgctagcagtattcatggttatcatggctataccttgataatagtgaatgctatgtggaatggtttaagttagctaatggattcaaacaccttccttaatctctgtttattagtctgctcagtgcatcgaacatacagctggatgtttttgtttcacaatctaatagccaacgttcgtcaatcatagttactgcttaaagatatcacatactcatagcgagcactgcgtttaccgctcacacatttccatcagcttaatgaacaaagcagaggccgacaattaacgattcctctggaattcacccgtttcaaccaacgctatacagacataaccagataacatagctacattcaaacatatccagcataaactttaaccgttgcagcttcttgaccaggacttgacaagacaccacaccaacccaaattcaatgtagaaagcatcctctatatagaacgctgagtccctttgagcaatgtcacactagctttcctctatcccgcgttgctgcttcagcgatttctccttgctcagtgtcttcaacaaaaggtaacaagctcaaccattcaatctacatttctttctcctgtctacttcagtgtttgtctccttca

SEQ ID NO: 49023 - DNA, 461 bp, Oryza sativa
  unsure (1)..(461): unsure at all n locations
ccgccgacgtttatatgtggacaccaacacccgcagccgcgagngagagattttttctncccaaagcttttcggcgaggccgttttttgtatccttttggattgagccccctaagcccacaaaagaagccccaaatatttggcgctatagaggtggatatccaaccagggcccatggaggtgttcaccctcccgcggccaaattggcgncattgccaatcaagaggaaagtttgtacaattcccgttcggggtccgaagcgaggacggcaggccccaaaacggnccgggctccctccccgaacaatggagatggttgcgggaagcacaaacggtgcggccttgaacaatgttgtacgggggccgccaacctctgcggggcgggttntgacaccaagcacggaaagcgcaattgtcgcattggcctcggttgcngccgcgcaagaagttgcggcgtcgacaa

SEQ ID NO: 49024 - DNA, 218 bp, Oryza sativa
aaaaatcaaagagctaatgcaatggaggttaattgacgacaattgtaaaatgtaaaaaagatacttgtatggtgacgcattgttgaacttgtgctgaccaaaagtcgtagaatcaattttttttataataagcaagaatcatctcttctaaaaaaatatctgcatgtaattattcttcatgccatcgttacatcttatctaacattgtatcatatagc

SEQ ID NO: 49025 - DNA, 460 bp, Oryza sativa
cttcagcaaaactaaaccatgaaccatcatgcagagaatccatcttcgtaatgaggccaagaccgcaactttagaaaagctggttcctcatttgggaactcttgaagcagttagggaccagctacacgaggccaaggagctcgccaaaaagacagagaaggaattgagggaccaaattgctcagctccaggattcaaacttcgagctgagaggttcatcaaaaggtaatctctagatctgtcccattaatttacgctgttgtaactgtatcctcaaccatttggatttcaaatagcgcaaaccaccaggatggctcaaatggagaaacaaattgaagccctggaaagagacaaggtagaactggctgcgcaaagggactcggccttgaaggaggttgaaggtactgccagctaacaatctgaacttctctcttttcaatgcagctgatttttatcataaa

SEQ ID NO: 49026 - DNA, 196 bp, Oryza sativa
  unsure (1)..(196): unsure at all n locations
cttcttatcttatactcatacacacctcgncaaaaacnannnnnnnaaacacaactgcttggtctaaaattttaatttctcctaaacccttctcacataaatgctatttaccacttcattcccaaaaaaaaatatggcgagggtgtatatatatatatatatatatatatatatatatatatatatatatatatag

SEQ ID NO: 49027 - DNA, 1501 bp, Oryza sativa
aatctccactctccagtgatctcgtgttgttctaacagagacataagctacatatttttggttttgttttcgtgtgacaaggattttatcctggcatgaaaatttgtctggggtttactgaagaaaagaatatgttggggtttgattcgcagtttattttgaagagaatactagtagtagatcaattacaagcacaatgaggcactgactactctgatggtcaccaggtcatgcagagagatgtcccagcgtatttgataattggctgacaacgttaacggctactacagtacgtggttaggaacactgattatcttaaccaaatcgatctcaccgtatttcaggggcaggaacacatgcagcccatgttcaagtcactgcacgcacctgcaaggattccacggcaacatcttgcactataatcttatctatctgaacacatcatgagcaataggttgtacacattgacagagaagaagcaccacgaaagtctgaagttgaactatactgtttgaccacctgtagcagcaggatgagcgaattcgggactgaaaaatgctgtgatgtactacgtgcacgtctgactgaacaggggacaagattgcatttgatttctcaaccttgatggtctggtcgtaacatcattttgtttgttgaaacttgggggaagaaatcactcaaaaaagatggtacacatacatgctgactgatgaaggcgacgtagaagcactgaaggcttcgagaatcagatccaactttctgaatcctgaacctttgtgatctactagtactacccatgttcatttctaacttacccagctttgtgaatcctgtaactactagtactacccatattcatttcgtacaatacactattactagcacgagtactgtacataaccataagaataaactcattgcagtactctggaaatatcactgttgaagtgccagaagtatcatgagatgtcctgcagacatgccggagaatgactcatgcacagaatgaagctagtgtaccgtacccagcagtaatgaaaaaacaaacagttcacggtctggagtttggatcaacagctagtactccacagtagaaggcatgcagcttcagctgacaatactactagtatcaattgccatacatatacagtagccagtgcatgccgacttcactacttcagcagttcagctatcgtccatgaaaaagaatgagaaaatgagcaatctaaaaccacaactcctggagctagctgaagcataactgtatgccggacgttggcccattctattccactcaaatcaatcaccataaaccgacaggttgatcaagatccaccttactcttcaggaacatatgaacataaaaaaatgcagaaaagaggacatccgtcccaaaaatataagggaattttgctctaaactgccaaaataccttatttccttatattgtgggagtgtgggacggatgtaagtattaacacaatcaggcaagcaggatagc

SEQ ID NO: 49028 - DNA, 1501 bp, Oryza sativa
ttgcaagaaagcatctcttttgcctttcaagaaagggataaaaaggacagacgtccaaaagaaagggggtaaataaaaacgggacgtgaaaaatctaacagcattgccagtgtactgtaaaagatgacttacaagtacagcacgagtaaacgtgtagtacacgagcacggatcaacggtccggatgcatgagagcaagtggccgtccgatgaacaaacatgcgtgtggtttcaactttcaaacacggccccttccagtcatcaatgcatgaaataaataagggcttgtttggatcagtgccctactaatttttttagtgctaaaacatatataaattttggcactaccaattatttggtagaataaatttgtattcatcttatttggtttgctattaaaatatagctaaattgtgatatcatagtgaagaaagttctagatttatatcaaatttgggatgggtattactaaaatgttggcatcaatctaaacaaacaaatggtgggtactatttaggctaccaaatattggtagggcaaattttggcaatccaaaactgccgtaaatctggtggtctttttttttactgcgaatctgcactaggggtttcctgttcgtgctcacttcctccgtcacccggtctctcgcggcagagggcagaggcacagagggcaggttggttgggcggtgcaccgcctttaatcctcccttgatccccttcctctcctctcggctctcgcaatcaacagcagactgactgactgctcattctcactcgcatcaagtcatcaacagtcacatgccctgctagctagtaccaccatctcaccattaatccaccaccatccatgatccatccacagatccactagtacactcgtaggacaggagtatgtaacgtgcctcgtcaacacgacgcgacgaacttcatgtgacggccaccacggagcggataaaacggatgagaatatatatgagataccctgaccggtccaagccccagatctgatcgaacaccatgcgtgatgactgatgagtgacaacaactgttgccctccctccccataatataatccactatcgctccaactcaaaaaacggtcgcgataaacaaagggagaaaggcataaacaaagggagaaggcagctgggtttctcgatagaaaaagaggggcttggtgcggccgcgcgcggcagcagcagcagcaacggtgcgattttcaccgcaccacgccgcgccgcgccgagacggaaacagccggcaaaaactacacgcttcgtgaaccccggggcgcgcccaagccccaacttgtgtctttctttaggcttttttagtacagtagccacttcacatctctctcacgcctataatactacgcggtggtgcgcctcttgtctctctgtgctgctctcactatcgatcgacctctgctgctgcctcgctgtcctctgctacgtgagctcggccggctcgggtgtcgaggacgatcgaggatggggt

SEQ ID NO: 49029 - DNA, 1501 bp, Oryza sativa
tttaagcttgtctgcaatgataaaaaacaaataaaaatgactttgtctcttttcgtttatatcagattagttcgagaggaaaaaaatatataccagatcagaaaacatccattatttatccctgaaagtgtatcattatcttttattaggaacgcgaatattagagaataacctaatatcaaataattagaagggttgaggcttcgaacccaagtcgtctagcccaccaccttgtggagctagccgaaagacccctgggtgtttctcatcttttattaggaacaaagatgtaggaaaaaaaacagagaaatacaactaagttctaaaagaattatttagaaaaaaagagaaattaaaacaattgattgataggatatattaacaaagcaacttttttcgggaaaacaattactatcataaacagagatagccgctatcatatgaaattagacctagatctacgtccaaagacctaaatatgacaacttcaacaaataaacgatgattgttgctcaacaaaaacatgtagtgcgatccccgctcgcgatcgtcaaacccaaaaaactagaaggttttcatcccccggaacctttaccactagtataccccatgcctccatgtaatttgtgaagatgagctttgttcccaacgactgtcgtgcaacaaaacagtcaaggcgatccatcaagaagttggcaaagatagttttcttagggacagacacttaggtttaccaacgcgtgacaagaagttaaaaccgcacttctcgatattagacgatatcaacaacatattatggtggatttctttcagactaaaaaattctcgatatgttattacagtcagcgacaaagccagctcctgtacaggtcgagtgaccacccgggctccaccactagtacccctcactacaggtagccataaaaaaaatcgatcaccaaaaaccattattaggttgtgttccgatatgggaagtttgggagctaaactttccacacggaaaacggagcggttcattagcacgtgattaattaaatatttgctaatttttttttcaaaaatggatcaatatgatttttaagcaatttttgtatagaaactttttaaaaaaaacacaccgtttactagtttgaatagtatgcgcgcggaaaacgagggagaggggttgggaacgtgggattgcaaacacagccttagtcgtcacggtatcacggacactgtcactgaacacagcaccactgttcccgtgagtccgtgacttagcagcacttgtcccgttctcctgaagacagtccaaaaaccctcactaaaccttccgaaaatatctcctccaatcaatccgaaacccagaggcccatactgctgacacgtggacggcactcccagatatttgcgctctcctcttcttcttatacccccgccaacccacgctctatccactcacgcacacactcctcatcccagagcaagaagctcatctcctcctcctctcgcatggcag

SEQ ID NO: 49030 - DNA, 1501 bp, Oryza sativa
ggagctcggtttcagtttcagttcggagttgacacaaagaagacgagctagctagttcatcgtacgtacgtagtaggcggtgacgacgccggcggagtcgttgccggcgagcttgaggttcatgctgaaccacccgaagagatacctctccttcgtctggaacccgacgcctgaaacacaaacccaagaaacagggcagcgtcagcattagccattgccggagtggagctcgaactactctcactcaccagtcttgttgtcgaggtagaggtaccacgtctggccgtcggcggaggtcttgacgtgatcctcggctccggtgatctcgaagttgtcgccgaacgtcggcgctgccgccgccgccgacgccccactgaagcagaaaccgcacacagcaacagcaaaaatcatcgccgccgtcaacccaccaacccacggccgccgccccagcgaccccatcctcgatcgtcctcgacacccgagccggccgagctcacgtagcagaggacagcgaggcagcagcagaggtcgatcgatagtgagagcagcacagagagacaagaggcgcaccaccgcgtagtattataggcgtgagagagatgtgaagtggctactgtactaaaaaagcctaaagaaagacacaagttggggcttgggcgcgccccggggttcacgaagcgtgtagtttttgccggctgtttccgtctcggcgcggcgcggcgtggtgcggtgaaaatcgcaccgttgctgctgctgctgccgcgcgcggccgcaccaagcccctctttttctatcgagaaacccagctgccttctccctttgtttatgcctttctccctttgtttatcgcgaccgttttttgagttggagcgatagtggattatattatggggagggagggcaacagttgttgtcactcatcagtcatcacgcatggtgttcgatcagatctggggcttggaccggtcagggtatctcatatatattctcatccgttttatccgctccgtggtggccgtcacatgaagttcgtcgcgtcgtgttgacgaggcacgttacatactcctgtcctacgagtgtactagtggatctgtggatggatcatggatggtggtggattaatggtgagatggtggtactagctagcagggcatgtgactgttgatgacttgatgcgagtgagaatgagcagtcagtcagtctgctgttgattgcgagagccgagaggagaggaaggggatcaagggaggattaaaggcggtgcaccgcccaaccaacctgccctctgtgcctctgccctctgccgcgagagaccgggtgacggaggaagtgagcacgaacaggaaacccctagtgcagattcgcagtaaaaaaaaagaccaccagatttacggcagttttggattgccaaaatttgccctaccaatatttggtagcctaaatagtacccaccatttgtttgtttagattgatgccaacattttagtaatacccatcccaa

SEQ ID NO: 49031 - DNA, 1501 bp, Oryza sativa
ctgctccagctttgtccacatatcagacaagtgtcatatcgcctttcttcgagtgatttttctacatctttttcaagacagatatttgcatgtctgcaatcttcaaaactatgcagaatgaattgaggccgttgaagttcccatcatatctcgtcagcaaagcatacaacttgctgatagggaccatacgacgaatgaagaaattccaaatgctacactgctttcagttacattttcttaatttatatgatgattgcaattactactactactatctgggtaaaacaataattgtcatgaccttccgctgcagaagtgattgaggcccaattataatctagtaagacagtgcaaagccatctccattcagatttgtgccacacatttttgtccatccaattcctgaaagtgacactggatcagacaggctcttttctgaagaaagatcacgttatatggcctgttctcttttcctggttgtgatcatgtgatccttatatcatttctttgaagatgacccctgcattgtttactggcaaatggcaacatatagtgatgatatatttcttatgaaccacatacataggcacagaggtatgattttgacttcagatattttacagcgaagtagtctgagtgggtttaaattattttacttttcttttttggaaatatcaaacctgagaagtaaaaaaaacagagacgaagttaagttttgagtgaaaagcacagggaaaagaacttttttttcttttataaagagaactacattcaggggttgcaaggtttgttttaagggtaattttaccatccttgagaaaaatactgggtgataagtttgggtgataagttaaagtgagttcaaatttaccctttcccaacttctgctctttcgtttttatgcacacatttcttgaactagtaactatatgttttttaaaatcttctatatgaaaattactttaaaatattatattaatccattttaagtttttttttctaatacttgattatcatgcgcaccattccgtttagaatgcgtgaagaattagctcccaacccatgataacaaacattcttattgggtacttcgagttatcaaactttttagtgtcaaatttaggtatatcgaggcatttttctcaagtaccaaatttttttcttatattaagctcgaatgtgtatcatgaaaaaagcagagaaatgtttgcatcagtgtgagggagaagctcatcccgaacgggaatacatcacgatcaacagaagaaattggaatgcaaagtacaaactatagaagaagactgaattgtttctcagaagccgaaccttgttatgaccctgaaactggcaatcattccgggctgcacatccaaaggcatgaactttgaagtggttaatccattgattctgcttgcacttagtggctccatccgaggaaattcggatactacatccttttttacagaaggacttgtttgattaagggaaattaatttcacat

SEQ ID NO: 49032 - DNA, 187 bp, Oryza sativa
cgccacacgtcaacgggaacgccgccaggaggccaagagccgtcgtcctctctctgcggctggaggcaggagattagggttgggtagggttgtggggattttttgtgctttctaaaaatctcaaacaaagtctatcttagccctcccataggattagaattttagggggtattaagggggctctaat

SEQ ID NO: 49033 - DNA, 435 bp, Oryza sativa
agtgcatcttcttcaaaatccaatgttgagcatgcaaaatctcctcttgttgcttgtgttgctaaatcttctaatgcttccaatgtgtctaatcatcatgaaaaatatacttgttctttttgtggcaaagatggacatattgttggtttttgtttcagattagctcataaacagaaaaaggagagagagattgcttttgcaaaatcaaagtggcaaaaaactggttttccctcgaggaacccggtcaaaccgcagtgggtcccgcggtcagaccggcgaccggtcagaccggctgcagagctctcggtcagaccagcccccggtcagactggcctcggaggaatttttctgaaaattctaaagttgattttacacgtggatatatgcctattggatcttctggtcgtgcgtctcagtactggattcctaaatttt

SEQ ID NO: 49034 - DNA, 497 bp, Oryza sativa
cccaaaaaacaaaaaacttgatcaaaatattcatccacctaaatagcataagtgcattatgcaacttctaagcaatcaattttctcaaatacaagaaacatgagtgctattttagaacattaattactaacgaaaataattgcacctattccattcgaagccaaatagcattgcatctagagtacggactttaactttttaagaaaactgatcgatttaccaatataattctgcatcaaaagggcaaataaatacacatagcaacgagtgttttactgaaataaaagaaccatagcacgccttgtgtaaaactttgaagtctttttaaagttgtgttgcaacataaagagtgatcagtgaaacaagacttgttggtgatcgcatctaggttctgaacatttctgtgctctctgaattagtttgaacagttatgaacttgtccatttatctgatgcttgaacggttccaaaatccatcacgatctttgcttgtctaga

SEQ ID NO: 49035 - DNA, 157 bp, Oryza sativa
cgccgctagtcaagcgaaggggaaaggggcggccatcgagacatctgtttcggagtattctcttgcggcgccccgtttcgcccctggcgattttgagacccgagcagaccttattccctttgtggagggagtaagtaatcttgtcttacctgccagc

SEQ ID NO: 49036 - DNA, 1118 bp, Oryza sativa
ctgcacccccaatggataagagagctatagatacccatggtttactattaatctagtctattgctgagatgtacatgttttgtagatagcaccttactttaccattgcgggtgctcttagccagtttatattgcctagaaaaatgaaatggggcattatcaaaagctctgatcatttaatctcctgaactatctatgcccatgtaatagacactctatatgatagacttgactaatagaagtcttaagatatatttgcaaattcctctagaaaaaagaacatttcaacaaatagggatgccatgtgatccacaatgtcttccgttcagttcccgtagactataagagcagcttaattattcgagtatctatgcatatataaatttgctgacaacatgttgttgtgtttctaagtgttgaatgagatagcatcactgctagcatcccagctaagatgttaaggtatacgcatacattcaatacgctcaatttgagctggcccatctactgttgcgcgactttgccgcgggtactttctagtcaaaccttaaaagcgttccaactggaaaaaaaagaaaattaaaaaacaaagcaagagaaaaggtaaaacgaaaaaaaagtcacatggatggtctatggtatagatgggatgtgatcaagccaacagattcatatgctcaaacggatcacatgaccacatgtgtcagtgtgagttagaaatccttgtgcaggaaaggtgaaacgctagccccaccacgtagtcagaaatcatgggtgtatctgatcggtgatcgaaaaaacgtttgccttatattaacttttaagttatcctgttcccacgtaatgctgttatgtagattttctgtttaagaattggtctcgtcaggttgtcttttttataatttttagaattcctattatacgtcactactacacttcattacggtccgcttactctcctcttaattctggctgcagcttggccgagcttcaacttttaacttttctatcacattaaaacttttctacatacaaattttcaatttttctgtcacatcgttctaatttcgatcaaacttttaaatttagcgtgagctaaacacacccctttataacagc

SEQ ID NO: 49037 - DNA, 362 bp, Oryza sativa
cagcagagtttggtcaatggacactagttatgaagatccggcaagatgcatcagtttcaagctaaaatttttgagaaaaagtttgctgcaattgagtaaaaacttgtctcagttaactgctctcttggtcaattgtaatgctgtgattaatttcctagacctaatagaagagcataggcccttgaccatgtttgaatggaatttcagagaaattgtcaagtcgcaaacttttaagctccttgagtttaaaaagctttattgcgaaaaaaggtgcacgaataggtggatgctgctgggtgaagagaacactaattttttcaaagccattgcatccatcacacggcggcgtgccacaaagcgct

SEQ ID NO: 49038 - DNA, 293 bp, Oryza sativa
gtataaattacccatatgttagtaatatacatttgaatggagtagattacgagggagacgttgtataataatagtctctgttagggctgtcaaaaaaggtcgaagcttgcaagtagctcgagcttggctaattctaggctcgattcgagctccagacgagccaaacccgagcttgagcaaaaacttgcgagctttatcgagccgagcgtgagcttctactgagtttaccgagcttatacatagcgtatagtttatattgtttgtttaccttattgatttaataaactaatgga

SEQ ID NO: 49039 - DNA, 552 bp, Oryza sativa
ttaataagaaaggtttcttcagctttgcaaaaaagtttgtccaatggccctagttataagatcgcgcaaaaagcaacatttcaagcttaaatttttaaaaaaattttgcgcgaattaataaaaactgtttccagttaacggctctttgggacaattgtaaatgctggaattatttgcctaggcctataagaagagcaaagggcctttaccctgtttaaatgaatttcaaaagaaattgtcaaattcccaaacttttaagctccttaattttaaaagctttattgcaaaaaaaggtgccccaatagttggatgtgttgggtaaaaaaaacactaattttttcaaagcctttcgacttaaaggttcagatcaatttctatcgcacaggtgctggatcaaaatgaataggtagtcactttacacaatcagaaaagctgatatgttattccatagtttcaaaaacagaatggggatttttcttttgcctcaaatggactttaatctaatggatctttttcccaatccggtgaacctgaattgcttggtggatcagt

SEQ ID NO: 49040 - DNA, 1258 bp, Oryza sativa
  unsure (1)..(1258): unsure at all n locations
tttgannnattggacggccgccgtgtgatggatatgcaaaaagaaagaaaaaaagtgctcatacaagtatggagcatgatgatgagaaaaaaaaagaaagaaaaaaaaagagatagccatgcacttttcaaaatttcaaaagagaaaataaatggaggaggtacacaaaaggagttattattttcattccttttcacccacaaattaaccatccacatacacatgcacatttttgaccagaaagtatgtctcgtatttctgtggatccattatttgactttgtaatatatgtgatgcaagtagtgctctactcttttccacaccctgagctccacataagccttattagatggtaggaaaagaaaggggcatttgcaaatttgccaccggttttttcaatattgtaaggatgccactcaaatgacagttctagtggtatttttgcaattttctagtggcagttttgcaatgatgattcaaagtagtttcagagaaggcgcaatcatatgccattgtgaggaatcatacactttgagtgatcgagagaatcaattgagcaacaaagcagagttataattttgtgttacatgaaaaaccctaagttgttcttcatgaaaagttagggtgacttgagtcaagattgttccatttctcaattgctcaggattgcatggaagacactataaagatccacaactataggtatgactttgaataatttgtttgcatgattattagtaagaaagtcataaccctgttgtagagtccatagccttcactcggacgagtgaaggttaagtgtggaggtgttgttgacggtccttaaatcataatatttgaccgtcaatacttgcatataatgaaataaaatatggtatccaacttagtggtaggttttattactaatcatttccactagtgttggtgaaatatgtgtatgcgggtattttgaggagaaaacacatctgtcatgcgacaaaatgcacctccgcatattcaggacgcgtttacactgattcgagggccccatatgtcaaccaaaaccacttagaattgagccaaatcaaagtacatgatgttggaggcccaataagctacctacccgccaaaggagaggccgggaagacatttttttggtccggccgaaccgttgttgtggctgttaatcaccagccttccacgtgtacgctcctgatttcatcccaatgacggttggagggtagtttggtcgtttcccatacttgtactatcatatgga

SEQ ID NO: 49041 - DNA, 1501 bp, Oryza sativa
agaaaaactaaatattatcggtggttagatggaaccgggcacaaactgcgtattgagagtgcaacagtgacgatggaactgatggacaacccatttgattcgatagaatccgcgtcaacatcgtcgatcgtcaggcagctgtcgctcttgcaccgccgtcgactaccatatcactggttcgacgcatcgtggccatcgcaactagatcttgccatcagcttaatacataccaacttgattttatgtggatgtatatgaattaacttgttgacgaacagttgataccccgtgaactcacgcttgctgagttggtgtattgaagatattttgttcctaattaagacgtttcatttctgagatggcgagaaaaatgataagagacaacacatgacccagtctctgacgcggcagttagtcatcggctgaacacacaagaaacgaggccaacacccttggccccgacatcattcagccatatttttaccacaaacgcacaaatgctgctacagggttgaggcttctccggccacgaatttttcagcggcaacatcggcaactaaaatctttggcaaaaatatgcctacgttttaattgatggaggaaaaaaaacacaagataaatcaatggttagatttaaattatactatactactaccaccaagtgtactataaaaggatccaaaatttaagttatatattacagtatcgaattactaagtcttggataatactcaaccttaggacctcacttatacttggtattaaaaaacatcacaaacttcactctgtcacaactgtgtttggcctacatgacttttgaatcacggaaacaacatatatgtgggtccaagtccaattatactctccaatagaacaggcgtatgcgtatccatatctaacgagccgtggaagagagaacacatgaacgacgagtgtatcagcggagcagagccctgattccctgaagatccataaaaccacccgcatccaatcaacatggtgacgggctgacgcactgacgccggaggccaaaacaaagaacgaaaccaccaccgctgtacgacccgtgcaaacgcacgctgtccagaccagattccaacggcaagcagagcagacgccgaaaaaccagctcgatcgtctcgaaacaccaatcatttctattcattccgctagtcgccgagtccaaccccggtggcgcccggtcggcgtcccacgtttttcctctcttttcaccgtcgtctcggccataaaaaaacgccgcgcgcctcacaaccccacccaaacgtcgtcggctcgtcgccaacacgaagcgaaaacgagaagaagaaaaaatccctctcctcgtcgtacggtcgtcgcgcgtagtaagctcaagctcagtaggggaatcgaggatgtcgtcgtcgtcgtcgacgtccccgcggttcggctcgatgataagcgcgaagctggcgtcgccgccgccgtcgctgctcctcccgccgtcgcctcgcctacaggg

SEQ ID NO: 49042 - DNA, 1501 bp, Oryza sativa
taaagtttcaaatgaaacatcatgcttttggcttggatatgaatgagcttgtggatgttggtggtggtgacagactccgcattcagttggacttgggaaaggcatgttggttcactttatatgttggtacaacattagtacaatattataaagactagtaacatgtccatgacttgtaacgcgtcatgtccatataattagggatggcctagagagtggttgaggataaagcattgaatctagtggttatgttccacatacatgcatgttgcacatggtggaaggaagggatcgaaggatgatgactccgctcttttaagataggcaaatattaaaagttcaattaaataacatatacattgtagtgcaatattacaaatacatcaatcaagacaaaaaaaatcaaatacaaaatggggcaaaagcaaactcattttatggatcaaattccacaaaatttgaatcctagaatgaaatggagcaaaacattccccctctcctaaccaagattttctatttaagtggcgtcgagataattctagatcatttcgaggcacatcatttaagtgtgggaaagcattactaaaggttcagaactagatttcttttaggtgattcaaaactggattttcatcacttggttcttttagaaaaatctcaaatggacttttcttcaccattattacagataaagctaatctatggttaaaaaaagagaaaaatacattggcggtacacaaacttattaggtggatactccctccgtactcacaaaggaagtagtttaggacaatgtttaagtcaaaccttgggaatataaatcatgaataactcttaagttgttgagtttgaaaatgtaaaaatcatatgaatagatttgtcttgaaaaatactttcataaaagtatacatatatcacttttcaataaatatttttgtagaaacaagaagtcaaagttgtgttttggagaccgtgtcgcattccaaaatgacttcctttacgagtacggagggagtataatttagtataaaaatttgtaaaatgtattttggtgtatgaactcgcaaaccaaaaccaaaaggacatgtcatggctaattttaccaagttaaacgtttattaggacacaacgtatacatataggttggcatgagacatgatataacaatttgatttgtgctttattattctttattctatctttgcattgcttctcttttttatgtctttatctgtacaatagttaggccgcattaaactttttactggacaaatttatgtctacgtagcatttttctcgtgtacatgtttatgtagtatcctagttaacactcaaattggcaagattagccttgtgttcttttggttttggtttgcacgcaccttctaacaagttcgtgtatgtactggattatacccaccgaacaaatttatgtatcttaaatacaatttactaggaggtaatgtattttctagtgtaaaatttgatacctctaagtaat

SEQ ID NO: 49043 - DNA, 1501 bp, Oryza sativa
tctccactctccagtgatctcgtgttgttctaacagagacataagctacatatttttggttttgttttcgtgtgacaaggattttatcctggcatgaaaatttgtctggggtttactgaagaaaagaatatgttggggtttgattcgcagtttattttgaagagaatactagtagtagatcaattacaagcacaatgaggcactgactactctgatggtcaccaggtcatgcagagagatgtcccagcgtatttgataattggctgacaacgttaacggctactacagtacgtggttaggaacactgattatcttaaccaaatcgatctcaccgtatttcaggggcaggaacacatgcagcccatgttcaagtcactgcacgcacctgcaaggattccacggcaacatcttgcactataatcttatctatctgaacacatcatgagcaataggttgtacacattgacagagaagaagcaccacgaaagtctgaagttgaactatactgtttgaccacctgtagcagcaggatgagcgaattcgggactgaaaaatgctgtgatgtactacgtgcacgtctgactgaacaggggacaagattgcatttgatttctcaaccttgatggtctggtcgtaacatcattttgtttgttgaaacttgggggaagaaatcactcaaaaaagatggtacacatacatgctgactgatgaaggcgacgtagaagcactgaaggcttcgagaatcagatccaactttctgaatcctgaacctttgtgatctactagtactacccatgttcatttctaacttacccagctttgtgaatcctgtaactactagtactacccatattcatttcgtacaatacactattactagcacgagtactgtacataaccataagaataaactcattgcagtacactggaaatatcactgttgaagtgccagaagtatcatgagatgtcctgcagacatgccggagaatgactcatgcacagaatgaagctagtgtaccgtacccagcagtaatgaaaaaacaaacagttcacggtctggagtttggatcaacagctagtactccacagtagaaggcatgcagcttcagctgacactactactagtatcaattgccatatacatatacagtagccagtgcatgccgacttcactacttcagcagttcagctatcgtccatgaaaaagaatgagaaaatgagcaatctaaaaccacaactcctggagctagctgaagcataactgtatgccggacgttggcccattctattccactcaaatcaatcaccataaaccgacaggttgatcaagatccaccttactcttcaggaacatatgaacataaaaaaatgcagaaaagaggacatccgtcccaaaaatataagggaattttgctctaaactgccaaaataccttatttccttatattgtgggagtgtgggacggatgtaagtattaacacaatcaggcaagcaggatagc

SEQ ID NO: 49044 - DNA, 1501 bp, Oryza sativa
actgcaactgtgcaccacacgcagaagccaacaaatgctcctttattcgttgcgccctcgtcaggagtgtcggccgaggtcctacagccagacacgacccacgcaatttgcaagaaagcatctcttttgcctttcaagaaagggataaaaaggacagacgtccaaaagaaagggggtaaataaaaacgggacgtgaaaaatctaacagcattgccagtgtactgtaaaagatgacttacaagtacagcacgagtaaacgtgtagtacacgagcacggatcaacggtccggatgcatgagagcacgtggccgtccgatgaacaaacatgcgtgtggtttcaactttcaaacacggccccttccagtcatcaatgcatgaaataaataagggcttgtttggatcagtgccctactaatttttttagtgctaaaacatatgtaaattttggcactaccaattacttggtagaataaatttatattcatcttatttggtttgctattaaaatatagctaaattgtgatatcatagtgaagaaattttggcaatccaaaactgccgtaaatctggtggtctttttttttactgcgaatctgcactaggggtttcctgttcgtgctcacttcctccgtcacccggtctctcgcggcagagggcagaggcacagagggcaggttggttgggcggtgcaccgcctttaatcctcccttgatccccttcctctcctctcggctctcgcaatcaacagcagactgactgactgctcattctcactcgcatcaagtcatcaacagtcacatgccctgctagctagtaccaccatctcaccattaatccaccaccatccatgatccatccacagatccactagtacactcgtaggacaggagtatgtaacgtgcctcgtcaacacgacgcgacgaacttcatgtgacggccaccacggagcggataaaactgatgagaatatatatgagataccctgaccggtccaagccccagatctgatcgaacaccatgcgtgatgactgatgagtgacaacaactagttgccctccctccccataatataatccactatcgctccaactcaaaaaacggtcgcgataaacaaagggagaaaggcataaacaaagggagaaggcagctgggtttctcgatagaaaaagaggggcttggtgcggccgcgcgcggcagcagcagcagcaacggtgcgattttcaccgcaccacgccgcgccgcgccgagacggaaacagccggcaaaaactacacgcttcgtgaaccccggggcgcgcccaagccccaacttgtgtctttctttaggcttttttagtacagtagccacttcacatctctctcacgcctataatactacgcggtggtgcgcctcttgtctctctgtgctgctctcactatcgatcgacctctgctgctgcctcgctgtcctctgctacgtgagctcggccggctcgggtgtcgaggacgatcgaggatggggt

SEQ ID NO: 49045 - DNA, 1501 bp, Oryza sativa
cgacgagatccttggcagtcaagttcttatgggcgaacgctgcttgcagctgtgccatgcctgaatttggtggcgggagatcaaccgtctcggcggcgttcgatatttttccatcgagccgcccagttggtacaggccaaaacgggccattactctgaattaggagtgcacaaaattatatttagttgcatcatatttgtatgtactccatctcatagccgttgctataaactcgagtgctttcagattttagttctgcgttttctgattaggccagctttaacagagaaatggccttataggattttttttttccccgatgttgtatgccgcatgcatgcaggatggaaatggccggtaattgtggtttagggcctgttcactttaatgttattttcaacattactaaattttggtaaagttacttaaaaaaaatggctacatttagtttgctaccaaaatttggtaactatctaagaaatcctaccaaaattttggtaagttgccaaaattttgacagttatgctaaaatttggtaaggttttttttaacatcaaagtgaacatgcccttaagctcgaaatgtgtcccacaacaactgagatattgagtcgcatcaagatagctgagttacccaatgaacagcgtccctggcggcaagggcgaggatgtcagcacacgaaacagtcccaggacaagcctgctccagcttctccttgatgctgtcgatgacgtcgaaccctctcaggcctgcactcgtttcagcttctttctcggcgtcgacggcgccgccggccaccgagtccaacaggatcgacccgtcgcatccctgcttatatcacaagcacacacatgagtacattgacacatatcaacaccactgcataagcactactactcatctacaatctctgaactcagtatctactcaccctgacgaagcagtcgtggaaatggagcctcaggagagcgccggcgagatacggcgccacggatagaacagatgcaacctcctgcctcacggtctcttctgcgccgttgcatgtgtccccgtaatacccaactttgagctgtgcctgcgcagcgctggacgagacgagagctgctgctgctgctgctactaacacgacaaagattgctgccatcatcagggggcttcaattcctgagttatatatatgccccccagaaatttgtgctaatcgatgcaggatcgatcgagcactactatgttgcagcttatataggcagtagatacgttgacaaatcacaaatggatcgaggctggagtatcttcagtaaagtacgggctagctagctgttggaaccaaaccaagtactatcgtacatcgaggtaattgaatatgatgtattctttctttcggggtgccaaattgctagtttcatagaacttgcataattgggggtacacaaatgtcatcacttggaaatgatttttattatacctgtcgagcgtacagtgattatggttgtgcattctta

SEQ ID NO: 49046 - DNA, 1501 bp, Oryza sativa
ttgtttgatggtaaaatcaatagcttcaattcgtcggaagtaatcctcagtaagttgacccttccggctaggagaacttcgtggaattccagatggagcaacaccaatatgggaagctatggcttcaatagtaggacgaagaatatcattggatggaacaccccaaagctcacaggccttcttagttgcctcagccattgaaggatcagcaagagtatataaaaccagtgctccttcttttgctgcttgctttactatctcaataagtctatccatgtcatcaatctaaagcaaatttgtagcaaaagacaaaataatcaatatcaagaaaactacacagctagcttcatttatcagtcaatgcaagtgcaaattagggtcagtgactaatacgcgaggtttctaaactaggaaaccagaataactccttttgtgcaatagtgattcaaccagacatacaatgatcatggcaaattggcaataagcacacctccatgcctgaatatccaaagtactatggtattcatttgttctgtgtcctaagatacgtgcaaacaagtgaacactaaattttcaccgatgaaacaaatagaagtgcatgaaggagtaaccaaccattcagttctcaatttacacaacttttagccatacacaactccatgatccacaaaaatgtcaatgtctgcatcactatttaataaaagtatgccgcatcaatattcatcttaagttccatgtggaaagtctttcctccattagagcacaagcaatttgtgcttctaactggaaagtctttcctccgttagaacacaagcaacctgtgcttctaactgcgagcatattttaatagcagccattatcatctagtagtgatagcatgaaataaattttatttcttccattctcaaacaaatataatgtgaagtaatcccaagtactcacacgctactgaccttactctaaatctgatctataaggctattaaaacaagctgaaaagaagcaggagacttatctccacaccattgattatggtgtagattaatcagacatatatatacagaacatcgctcttattatacaattgtattttcagagtaaacccaagagttgtataacaaataaaattatgctttcaattaaactatagtctagcttgtgaaagaagattcagctggttcttcgaaagctagatgctgataattaacagtgaaatcaagtatctcaaatccctaattagccaatcctgataatgtacagcaaggcaagggacaggtatgcagcaaccagtccgagagaataaagtgtacatgtgcaccgatcatcggtaaaggataacagtttatgttatacagcacaaatctacagctaaaatccaaaatcccctttattcccagaacaattgatatagtttctatgcactatgttggcatatcatgattttccagcaagaacgaaaaaattaaactattgtacgaagcagacatatctggctggacagt

SEQ ID NO: 49047 - DNA, 1501 bp, Oryza sativa
aggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcacctcgtccctatctctgtctggtcggaacgtgccctgagaggaggcttccactgcatctgttagtcatcgcgcagcctctcgtatctgatagccgaagaccagtgagccatcagctgggttgagcgttccaccgtgagcatagtaccagaacttcgatcgttccggccaattagctgttgccggttcgataccccatctttagtcccggttgttctcaacaaccgggagtaaatatcttttcctgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaagtaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcatacgtaattaacatatgccata

SEQ ID NO: 49048 - DNA, 400 bp, Oryza sativa
  unsure (1)..(400): unsure at all n locations
cgggggaccaagttttaaaaaagtgggggtttggcaaaccctcaaacttagaaccaaaattagtgtcaaaaatgaacacgggccggggcgcgtgtattacaagaatgttctcccaattacaaggtttggtccagatttcaccttttttaggggattccctccgttgcccaaattcagcggggggncgggaacaattccatatttgtacatcagataggcgcaaggnaagatagtaccctcggttgttattgaggaacagcaatagcatgcgggcagnttgcaatcggttgaccaagatcaggtgcttgcatgtttctnacacccacnntgtgtttgatccatncagcaacaagcgattcagcagacacccacanttcagctggttgtccaccaatccagc

SEQ ID NO: 49049 - DNA, 1501 bp, Oryza sativa
acaacccaaccgatgtgtcgtacgtagttcttggctgcttccgccggggcactaggtcggccgtcttcgtccacttccgttatgatgtgccaaccctctagcttcttcgcggcacctcgttgcccgcgtgccctcttctatccagcggagggttgacttccactagcctcctcctcctggttcccctccacatccctctccacgttcccctcctggttcccctccgcatccctctccacgttcccttcctcgttcaagtattggtttggatcctcgttcccctcttcttcgttccagtactggctgctttcctccgcgattgtatcgtacagtatctattcctcatcacgatcagccatctgttcatacgagaaatagttgctaagtctataggtcatttttgctttaacaatcttatatgctaacaatcatatatgctaagtcaaatatgctaagtctaactgtcgtatattataaccctacacaatcttatatgctaagtcttattacaaatctaataatcttatattaaaactctaataatcttatattaaaactcaaataatattgtattaaaactctaatagtcaactatgctaagtctaagtgtcgtatattaggaccctagacaataattatatactaagtcttattacacaaatctaataatcttatattaaaactctaataatcttatattaaaactcaaataatattgtattaaaactctaatagtcaactatgctaagtctaagtgtcgtatattaggaccctagacaataattatataccaagtctaattacaaatctgataatcttatattaaaactcaaataatcttgtattagaactatgctaactcaaacaatcttatatgctaagtcttattacaaatctaataatcttatactatgctaagtctaagtgtcgtatattaggaccctagataatcatatatgctaagtcgtttaagtgtcgtacattacaaacctagataatcatatatgctaagtctaagtttcgtatattaaatctaatagttttaattgcattaaaaaaaatctaacaatcatatatttacatcacttgcctgtgcgaattccttcgagggctagctaccactccggcttgagggacgacgacgacaacgtcttttctgcaacatacaaaaagatgtattaggataaacgcaaagtaacatatattgtatttcacattcgcgttctcgttaagttcacgtttcgttcacgatcgttcacattcacattctcgttaagttcacgtttcgttcacctacgtgcgttcacgttaacgtatgttaagttcatgtttgcgttcttgttaacttcacttttcgttcacgcacgttcattcatttacgtacgttcatatacaacgttaagttcatgttcgttcacgttcacgttaggttcacattcgttcacgttcacgtacgtttcgttcgttcacgttcgttcgttcgttcgttcacgttcacata

SEQ ID NO: 49050 - DNA, 541 bp, Oryza sativa
  unsure (1)..(541): unsure at all n locations
cctcttttgtttaaaaaatctttaccacgaggggcaccttttttgggggagtcttttctaaagggcgcccaatttaagggttttctccccgccacaaatatggggttgtaaatttgaaggggcccctttggtttccccaataataaacccagtggaaacggggttgttcaccgggcccaaaaattaatgtttttcgaataanagcctggaatccccatctagatgtgaaagattgcttcaaatacacaaccaccgagaaaaaagagaggggtgtaaaattaggaaaaattcgatctcttgttaagaaaggggatctacccgaataggacttacctcagcatactcggttgatggcgtatcaaatgggttggtggagaacgacatcactgcgggcggaaatctcgccgaagatgaagtcgcctgaaagtcgcttntgcgttgnagnaatggcggagaagaaagaggacaaggtttcgcttgagcggtgnaaatggaagtcacggtgtgagatttctcgaaggtgacggttagtatttaaagc

SEQ ID NO: 49051 - DNA, 305 bp, Oryza sativa
caaaaagaggattggttggttcaacaattcgcccctatgaaatgccagaacagaaaaagggtccaaagtttcttgaaggggtcaatgatatctcatcggatgtcctagctgggaaggcaaaaaaaagcaaaatggtgaaagccacaatacaagccccacaccacaagccaaaggttcttaccaaggaggaagattgagaatctaggagagcttttcaacaagtttgcccgctttgaagccattattgatgtagtgtgtaaagtgagatgattattaggaaaagaacttctcggatttttgcttca

SEQ ID NO: 49052 - DNA, 1501 bp, Oryza sativa
agaatccaattacatgactaatctgtcttttgtgttagatgcactaggtagtccagagtacatgcatgcaaaacaacttctttttaatttcgtcgtgtgtatgatgactttcttcaaaagcttggatcttttgaaagaaagaaaaaaggtgggaaagaaagagagattggatttagggcagaagtttcggagtctttaccagtaatttccttgtttcccactaactagctagctatacgcccttcgtctaaaataatctaataattcgacaagacataatctactacaatgaatttggatatgtctcattgaagtagttgagttttttttttgacggagggaataggtgctaagtaatttaaactatgggaggatctcttcaaaaccgacagccattagattaggtcgcctcgatggatatgtagctagggacttgactaatcaaatcggcaaagtgattgttaattgtcgcgtgacacgattctatcgatggagcaagctctagtagatctcagcttttgaatgacatgatgatatgatccggttagacgagaaacggacaagtgattttatcttttcccctgttggagctgcggagaaaaaggggaagtgatcgatgtgagtctgaccatttgtttgtccttttattttaccttttcactccactggattaacacgatcctgctgccattctttaatccggcctgccgacgcggctgtgggttgccaatgtgaaaggcatgtgggcgcagggtgacaacgacattgcgattcattctttaccgaggtaaaaaaaaaattaaaggtagcaaaacgtattaccacgtgtcgagttaagcaaactatgtctgtgcatgttgataatactccccgtctcataatataaatttttttttactttttgcttgcactgtttgactattcgtcttattaaaaaaaatttggtattattatttattttatttgtgacttactttattatccaaagtattttaagcataacttttcgtttttaatatttgcacatattttttgaataagacgactgattaaacaatataagcaaaaagtcaaaatcccttatattataggacagaggaagtacttattttgtataagtctgttgtcaaacattaaaatctttgattataaataatttttaaaatatttatcttagaaatattaagataatatgtaaattaatcttaaaaatgctacaatagaaatatatttgttgattttacttatatatatatagtggccaaaattatttttaagaccgtgtccttattcaaaacgataagtatttttaatctggagaaaatagtatgtgagcatccagatatagtggctctctagcatcaaaaggtgtacctagcatcacaaggaagctccgaaacatcggtggcaagctagagaggtcaaattcgagctagtgcctcccctccctgagctctgccttgtcctcaacgaggtgatggagctagcatatcgatgagca

SEQ ID NO: 49053 - DNA, 1501 bp, Oryza sativa
ctgaatgcggagtctgtcaccaccaccaacatccacaagctcattcatatccaagccaaaagcatgatgtttcatttgaaactttatacttttctactagcttctttatttcttcaaagtcagtggttcagtattgtggacaaaaagttcaaataccaagtgaagattttttttcttatgaaacacaattgtcttagattgaaaattggtaaatcatatcaaacatttttgtacttgaagtttaagttcacattttctagatgcaaagaaatagacacattgcattccaaacaacattattttgaaaatgctcaaaactggggaggtgtgtgtgcctgacttgaacaagaaggtgaatgagacacaccttatagatgtctctatcctgtcaatttgaaaacccaaaagtattttctctgtttatcaagagacatgatttggttccttgagactacaagagcttatttcatgacaaactaagagaacttctggtattgtagtcttccaatgcacgaattaatcaaaacctttcaccattacttgccttgtaattctgacactaagaaatcagtaattcaagtattatgtgcaacgtggcaaaactattaaattgaaagtacattttgtagtgtgaatacaatcataaacctggatcgaatacaacaccactacatttataatagagtatatgttgaatttgccaaggaaatgaccttggtgcttcatgttttagaagtcaaaaacagaaaacaaaaggaacaaattatacacacatcatttttcatgaagagcccaatagaaatgttgctccaattagcccaatagtgtttttcttgttccatttgttctaggtccatataccttgggggttgtaagttcaagtgccttaatttggttttggtgattaataacaaatctaactatatgagactaacatttttatgagcttttctttgactagcctcatttggatatgaaaataaaaatgatgggaggtatgtattaaactccacatattctaatcttgtatctcttgtggatctaaaatatagtgtgagctctctcatttcttaattaattatgtgcatatgcattctttcatatccatatgtatgcacaaattgagggggaggttattctatattttgtttattgtaatatctctatcttgatttgaaatcatctttcatctcatctccctatattgtttatatcgggttattatccatcaccaaagagagaaaagattgaaagatcttggcttaaacaatttgtgtaattgttgctttggtgatagatgataaacccatgtttatgggattaacttctcctttacataagttgtcaattaggttatttcccaataatgagatgtagtagacatgcattcttttgtgatggaccttaatcatgacaaggatgaactgcatggaaataaagcgatatatatcactttttatctcctactttttgataggttcatatatatgatttccatgtt

SEQ ID NO: 49054 - DNA, 382 bp, Oryza sativa
cccatttctggcttttggggtgtttagtgtaaaatttgaacttctatataaattgtaaaattgtgagggctaaaatgaaaaacaccaggggctgaaataaaaaaaaatgagactaccacctgaagcaacttgggctctgttcggctgccattattttcactgtggttcagccaacaagcactgtatattgtttctccggttgtggcagtgcagcagcggtacaaagtagccgaatagacccttgcactgtgggaaattagctttttgggagtgttggcccatcctaggtagcacttagggtaccctgcgttggccatgcccttaggggtcttatattgctcgtaaagtctatccttaccaacaagctttttgctcccacagg

SEQ ID NO: 49055 - DNA, 871 bp, Oryza sativa
  unsure (1)..(871): unsure at all n locations
ggtcgcacacgtttgggtgaggggagtccatggtgttgcggaggaaggtttgggtaggaaggatcggcgagctcaaaaccggagaaagctcttcttcactgtgttgaatgccttgttgggtttcgaattcgtgtgatgatactccagtttgatactacagtaaaatcacatgaacccgtaaaatgtactaatagtacggtcagaattttgaatggattttatagggttcatatccatatagtctaagagcaattttaatagtatagcccactactaagtctaattcgtttatagccgatgtaatagtcaatttatacaatagttggttactagcctattaatatatgatcccacctgtcatacatatattgtgtcttggagtccgtacggcagcngnnnnnannnngacgcttcnccatccccatccccatctcccccccttcctcctcctcctcctcctcctcctctccctactcgatttgctgcggctttgcgaggctggagaagaagggtttaagcgagggagagagagagaagaggcagagaggaatggggttttgggtccttttcaacgtcgtggtcctcgtgggtcaagtaaagcagagggcaggcagagggaatcgaccgttggaacggggaggggtaaaacggtgaattcaggtcagtgggacgtgtgtccctgacaggtggggcccgcacattcatccgagatgtttcgtgcttcgtgcgatgcggagtacgtgtgcgcccgtattttcgggagaaaggaaagggcacgaaaagaatagctgggccggaaaagtagttagatttttttttatccgagttttgggccggcccagaaacttggtccacggggctaaatgtgata

SEQ ID NO: 49056 - DNA, 267 bp, Oryza sativa
atttgtgtgacagtgtgacacgcttactacaccgatataagcggtatacttacccccaaccgcgtcaccgcctcaacttgtcatcagtctgccgctccctcttcctctctctctctctctctctctatctctctcgcccgcttcctccccatttttctcgcgcggaacccaacccaaacccacgcggcggcgtctctcccctagggtttggtccgcgcggcctccgttcaccggcggcggcggcggcggctgcggcgatggcggggc

SEQ ID NO: 49057 - DNA, 195 bp, Oryza sativa
agagtagataaacgagttaagaggagtaacgttaggtttatgatgatataagtaatgttgagtaatcgagagaagaagagtgtaggtgattacgagtagagaatttgagcgatgtcgagtataggcgataatagagtagagcgatagtatggtgacatacagtatgatgggcaggagaagagagagcacgaggga

SEQ ID NO: 49058 - DNA, 305 bp, Oryza sativa
aaccccaccttattatgggcctgtttggcacagatccagctccagctccacctctcctggagctggagttcagccaaacagtttcagctccacctaaaataggagcggagctgggtggagctctctccgaaatgaactagagaggtggagctgggtttaggaagctccacaactccacttcagactcaactcctggtgctaaatttgggagttggagctttactaaacaggccctatatagagaacccattcaattggccctaggcaaccgccacaattactccctaacttcacaccacacaaca

SEQ ID NO: 49059 - DNA, 1359 bp, Oryza sativa
acacgagcgcatggaaggggttggagctcgtttggacctgtttggacctatatgacaccccaaaacaagttcaaggatccgaaaatgcattttgagagtttaggtacctagatgacacacccgcacaagtttagggaccgctcgtgcacttcactcataaattaaattatagtacctcctctatacatatgttcctcagcataggtacctctcttgaaaaagggagggtaattgctttataaataaaatgccacatgcaaacggggaaaaacgtgattcttcttgtacgatatatttgtcaatgcctcgtagtcaactcaatttcatgttttttaagcttttcatagaaggacttgtcaatgcgttgaatgcacgtatcagagcaggaatacccatgacccgaaattaataaacaaagcgcgacatgcaaatatcaaaaccccatttttctacacgtatctacacaacctagtcgattggcaaatttcttccctccaattaacaaaactaggaaggaagcctggatagatacgtaggcaatttatttatctatctatctattattattatatattaaaagtccattaaacttcctacaaacgttctcatgccgccacattggactcctacaaacgctcctaattaagccgccacgtggtaatctaataaaccggtggacccactatttcagatttttagttattagatttacacttatttggtggacccaataatacatggaattagttctattttttggtaaaaaaaaatccacatcccgcttggtccgtgcgtacgggagatcagagatacacgccctccctcccctctatccctttaattctcacctatttccatgctatatgatctctcttatttccatgctatattagtttctattttcatgctatatgatctctcactaaatcactaaatcaccgtcctatacacatacgtacaaacgtacatacgtactccctagctcccttctgttccacacccggtgttccgcctttctatattgattatgtaaaaaacggaaaacctaaaaaaaattataacatataaatcaagctgctaatttaaattagagataatccaataaataccattgacaagtgtccaaatctaagaaatactatcgataagcgtgaattccaagaaataccatcgtacaaatgattttgtctaaaaataacatcgccgttagggttctgtccatcccgcgccgttaaatacactgttcataacccaacgagacaataaactctaaaaactataagatccctttttaaaggttcgggcttctaaaaagtaaaaaaaaaccaataataattatgtttgaatttaaaatctcaa

SEQ ID NO: 49060 - DNA, 165 bp, Oryza sativa
  unsure (1)..(165): unsure at all n locations
cgcccttatgatcacctctcgcagnnatcgnnggaaagcaactttagagcttatagtctatcaacccagaggagtcaataaaggataagcaaagaagtgaaatgttatatcgaggaaataatcttttgagcttgatctattaagtgatcagtgcttatttcaaga

SEQ ID NO: 49061 - DNA, 1501 bp, Oryza sativa
tacgtttgtgctgctactccatttgcatggagtatgaaacatcggattggaatcgatctcagctggtcaataattagagagagagagagagagaggcagaggcagagaagaggcatgagtaaaaaaaagtgaaggcaggagcagagagggagcagaggaggggcagagggtgcacgagtgggcagcagagaggagagggagggagatctaggcggtgtttgggagagaggggatttatatttttatgagagagactaaagtttaatacctctcttaaaactataagtctttagggaagggatttatacttttgtgagagggcctaaagtttagtcccttcccaaacaccccctggtgaaatcagcagcgtagggccaagtttttatttatgtgctgccacccacgctcacatgcaccttcagtagggctcacacacacatacacatacacacgctctctctctctctctctctctgcaaatgacatctctcattgcccaatccatccaatgaaaacatctcatcttaatctaatcaagcgccgggcatagtgtatagtagtagtactttcgttagttaaatcacagatccaactaaccctgcagctgcgtacatatttccatgtgagggggtgaagggccatctatccctgattgcagaactcatcagcttgctatgcccccatcttgatcttgtaattgctcaatattgttgctttgagtgctgccattctaggtctattcatctaaggtttttttgtggctaagttaaaatgcgtcgtaaaatctaagtaacataaaagcttatattgaccgtcaacaatatattattttaaaattattttgtcaatattgtatggcaatatatttttatcagtagtgatagtgttgcttggcacgagtttcaccatgttgcggaggtatgctgaataaggtctgttcgaaaccatgcaaaaatcaattgtattcattttatggcataaaatgcccaacccataccattgctaatcaataactaaccaagctaggtttaatgtttaacggtttattcaaatttcactcttaagtatacataacagtttaatcgtagatggcgccccggatgatgtatacactcctgtatgtgcagatgcaagcacgccccatcctggtcctccaatgggaaccaccccatgtgccacctcaatggcaatgcaaccttctctttccatgttttgtttacttatcctttgataaatttacctcatccattatttttttctaatataatgtgctgtttgatttggcatagttttgtttgatttaaaaagatgcatatgtaaatataatattttgatctttcaaaatgtctgtggtgccttttctacaatataatcttacatacattttataaatctgtaaaaaatgtcttgagccttatagttaaatgggggaaagtaataactagtggtaccatgtagacattgataggtttactccacttataatgaaatcaacccatcc

SEQ ID NO: 49062 - DNA, 718 bp, Oryza sativa
gagaacacaagcaagtgagtagaagatgcaatctgaaaatattgcaaatataagatgaatctgacaagttggggttccacagatcgaactagcagcgttattacacttttctgaaagtatttttttaggcggcgtgtgctcttaggaaaatatttaacggagacatcttagcagccgggcggcccgcttgcgaaaaaagccaaaacgtatcttcacaggcagacccccgcctgcgaagatccgcaccctatataagggcagccacccccgtgccaaattttctaagtccaggcaggaaccctagaaaatttggcaccgttaggctgccgaaattttccaccgccgaccacctgcaatagctcggcggccgtcctccgccacatcctcctctcctggccgggccactccttcgccgactggccacgacgctgcttttctcgcgtactacgaccgctcctactcttcttcgggccagcaccgtctcctaccagccggacgctgccacctcctcttaccggcccggcgctgactagctcctaccgtccgaccgccgccactaccttcttcgtggctggcgccgcctactccaggccgaccgttgccacctactccttcctggatgacgccgccttctcccgggcgatcgccgccaccttctactcccgcgccagccctggttcttcttgggctggcgccgctacctcctcctcctggcaga

SEQ ID NO: 49063 - DNA, 223 bp, Oryza sativa
  unsure (1)..(223): unsure at all n locations
tatcgcnggtggacgnctcctttgtgacggatactatgatctgctcgtcaaagaccacgaagaaaaaatgatctacagatgtctgtaacacactaattcttgttgatatattagcaacaataaccttttggtatgcacttgtgttacaaattttataacatactcgatatccctgacgttgttgctttggtgaggtgccgccagccgatgggtccgacagtga

SEQ ID NO: 49064 - DNA, 621 bp, Oryza sativa
  unsure (1)..(621): unsure at all n locations
cagtccttgtgaccctgtanancnccnnnnnnnnnnngnggnncgatgctttcttaataaactctacatatacaaaataaagatatatcatgtatcataatatattctactgaattggatccgccgctaccgaccgccagcctcttggctgcacgcggagccgatcgcccgcactgatcacctgtcccggccgcttgcggcaccgccgcatgctgtacggcaccgcaagctgcctcaccagctcatcgcttaccaccgccactgctgtagcaacagcacagcgcgagcgagaaaccctaacgaaagaataggaggggagaggggaatggaggttgaaatatctgaccggtcttaaccgaagatctcatcgaaattaagggtaacttttatttccgctaaaagttttcggtttttgggtataccaaccattcacccccctctggttggcttagttcttgtaattcgatcctacaagtggtatcagagccttgttttcttctttggatttttatcgatctagagtttttgccatggctactcccgctaggttttcaactaagccttatgttttcgatggaacggatttttctcattgatgtagtaggatgcaatcttacatta

SEQ ID NO: 49065 - DNA, 1501 bp, Oryza sativa
aaatcattttcgtcaaagaaaaatgaagaatacccacatgcagctcccctctgatcggctgcaaagattatttttggcaaacaaggaatgaaaatgcccacatgcagctgcattctatttccagatatcaaaccacaaatcaagcaaatataggaagaacaatcatcacaatactctataatcaataagaaacatagagaatccattcacaatttcatctcagatgtacaagaaagattagagagaagagaaggcagcctagcttgtcttggagccgttgccaagccacggtcatcgacaccaatgagccatagggacactagcgctgaagtgtcctgagcttggtggatttgagataggaaggtcggcgccgctatatctagagccagaggccttgccctccccctcatccactggcattgctcccttccttttttttgccgtggagaagctcgtctagatctaggactgtgagggaggtagggcacgtgggggcggaatgcactcgtcagacacttccgagccgataggaggctgtgctcgccggtcagtgatacctctatgaccaactcccaattctacgtctccgcaactctcgaacactgtcagcccttcccattacggcaaccaaggcttacgcggcggatccccttctcctgattttgttgcaactcgctgtcgccatcgccgccgcggtcatagtcgccatcaccgtcgctgagagcaccgcgcggtgtggaggtaggaaggatacagggagtatggagggagagggagggaggagaggtaagggagaggagggagaagagggacttagctagtgtgctggccggggagactctgccttttaataccgtagtttttttccctaaaggcggcaattagcgaaaactaattttttgttagcagtgacttaacaggtcccttgtaaaaacatcctcgatcttgtttggcacaagtttaaggagagacaaatgaaaatattccttggactccaagattatttctttgatctcttagaagggagagaaagaaatcccttgtaaaaacatcctcgatcttgtttgacacaagtttaaggagagacaaatgaaaatattccttggactccaagattatttctttgatctcttagaagggagagaaagaaacccagccatacgagtaatcatatatatgctccctctcttaaggctagatgatcaggcaatctctgacccatcctatagattcctggttctcaaagctgagataaatcttcaaagattccggaacctacccacatacaaccatgaagaaatatctctccaaaccattatagatcatggtcttgtgaattccatatatgcaaccctcgatcagatccttcaatctgatttaggaaacgctgtgaaagatgtctgcaggagacttggacatggaagatacaggattatcttctcctcaataccaccaaaattcacaccacctgttcgtccagcaattcattatatatatatca

SEQ ID NO: 49066 - DNA, 1501 bp, Oryza sativa
gttaactgggggttgataatatctaatggtaatagacttgctgcttgtcatgagtgagtcctcgattgtatggataagatctttgtccaaatcaaaaactaaaaaaagaaatgaaagaaaaagaaaatgcacgtacactggctcattaatttggtagactattctggacgatgttcgttttcttgaacacatctgctgcaatttgagagttgggtgatgaaagggtgagtggtcctggagaatagaccggtgatgctgttcactccacacatgtaaagggaacaaaaacttcgtttttaatttaagtagttatacctgaatcctgatagaccgtaaattgtgccaatgatagatttggtaagaacagttcctcctagtggaatattcatatgcttcatggggtacatgctattctgcaacaattgcatattgaaaaggggattatcttaatctaattattattggatggatatgcagcttttcacaaggaaaataagttgaagtacttcctttgtgtgcttcaaactttttcaagagatggcatcttgcatgaacccacagtcattcttgtcagtatttgaataaaagaatgccatatggatgctcgcactattacctgaaagtactccactctgatgctctgttagttgaagtccagcctaagcatattctggtcattctattcagtagcttgcgttatgcctttcagttctttttttttttttggttagtatttcctcattcataaatggaaataaaaaagtaagttcagattcagatctgtaagtagaggtttctgaatactacatcattgctttagtcaattataccttttatatacaatatctacttaggttagatgtgttgagctattcctaacttccatttatcgtcgacagttaattatactacttgtaggatgtgtatttttttaaggatgcattgagcgacagtggtatacttcatgggcttctaaaccgtgcgagcttcagaaaagaactttttatatatataatttttttaaaatattttaaatctacttttaacattataatagttaattcatttatttttactctcgtaatagtgattattcaatcaactattcagtcattcagttattcggcgaaaaaactgacccacatatcctagtagtaatttatattccattcaataaaagatcacattctcctctgtaaagaaaccggagggagtacatcatttttacatactattaacttattatccatttattacaaacaacacattattctctgtaatggaaaacaaaatctgcatcctgaatttctcataatgttcactgttacctcgtcgtatgcaacaaaaagatggcatttaccagtttcctcttggacagcacaaaacaaaacaaagcaaagttgctcactagtagcaaaaaaaaaaagaaagaaagaaagaaaaagaagaaagtatatataaatccagctcaaggagatgcggttgcggcaatgattgattg

SEQ ID NO: 49067 - DNA, 1501 bp, Oryza sativa
atgattgattgatttgtattagcccccttccactctcgcgttttctccccttctctgcgtgtttttgtggacgacggcgtcgtcgcaagcttcttgtggccatcgtcttccccccctctcctccttcctcgcatcctctcctccctatctctcacaaaaatccattcttgcacagggaattttgcctactcctatttacgatccttctcttcccccctctgggcggccaaagctctcgtttttacgcgtgatttcgtcgtcttgttgctgctgacgagcccgctgattttggctcgatttaatcccattttacgggtgttttgcatctattggagatccaaaggtgcgccctttctgggggtatcttggggggaattggatcgatttcgatctgtctgagtggttctctgggcgttgttggtgcgttcttgatccgagaggtgagagatttggttggattttctccctggagcatttggtgtgctcgagcaggatgctctatttgaagcagccgacgaggagctgaactacgccgagttgtttttcccctctgattttcttggtttgaatttcgcggcggtcgtgtggttcgcttagctgatctgatctgatggaggctatgacgccagacaaattccttcagaagttccggctctacgagaccagatcggtagggatcctcttacaaaattttgtattctcatcgttttgatttggtatgaattgggttgtaggttccatatatatgaagagatctatgtgtcagcaattgtagctcacgcgctttactttggtaatcacactgtaacttatatgtaattacattgtaacgtgcatgtaactacagtgtaacttgtatataagtttcacgtaattttgaatcgttaaatctattacaagatttgctttggtaaggaagaaaaaaaaatcacagcacaaacatatgtgtaaggatttgttcccacaacctccattttaccgaaataacatattacaaagagatttttgaaagttacatataagttacactatagttacagtgtgattacatgcaagttacagtgtaattacactacgattgtactgtaattacatctgtcaaatttttaggagaaaatttgtcgacaaatatatagcaaaatcgtatcacatttagccccgtggaccaagtttctgggccggcccaaaactcggataaaaaaaaatctaactacttttccggcccagctattcttttcgtgccctttcctttctcccgaaaatacgggcgcacacgtactccgcatcgcacgaagcacgaaacatctcggatgaatgtgcgggccccacctgtcagggacacacgtcccactgacctgaattcaccgttttacccctccccgttccaacggtcgattccctctgcctgccctctgctttacttgacccacgaggaccacgacgttgaaaaggacccaaaaccccattcctctctgcctcttctctctctctccctcgctta

SEQ ID NO: 49068 - DNA, 1501 bp, Oryza sativa
ttacacgcatcttataaatttcgtttagtcatcgctgatgacatatttgagtactacttatcccatgcggctatgcatgtacgagatccgtgtatacgaatacacgtattgccagtgcatatatgatcatacatgtgcatgtgccactgcccactgccatacgagactttggatcctccaagtgcatgcatgcaggcaggctccaattcgtgctgcaacttcaacaaaataaattgattcgcctcgcctagctgatgttacaaaatggcggacgtatccaaaacgaataatacttggatgaaacaactgaagctcaaaagagtcaggggaaaattaatgactacaagtttgttattgatctgttcgacttcatcgaaaaatcccagcctcggctcgcgccagaaatatgtttccaacacacagcaacgaacatagccttagtacagcacaaactagccacttctatcaacgacaaactggcctactagaaacagcgcgggaaagttaaaaagctcaagctcgggttagatagcactgctttcttcaaagcgcatgcctacaacaacttcggacgaacctccatcaaatcgatcaaggcggcaggcaccgaagtttctgaccacaacagcaaggcacaagtcatgttcaactattactcgctcatcctaggatctgctgaatccctgcaatggtctcactacttaaaaaaaaaaacgtataagtcggcactatacctttaaacgaagataggtatcgattttagagaaaaaccaacatcaataataataatataggtgccagtttttttaaaaaaaatccggcacctataatatattataggtgccggtttattaaaaaatcggtatctataacatattacatgtgcccgtttttttaaaaaaggcacacatgaacacacattccatcaagaacacacatgaacaaacattccatcaagaacacacatgaacaaacatcaagaacacatatgaacataagaacacaacttgaacatatgcttcttccaccgtcccggccgccgtcgcccggcaacctctgccgcctccacgccatccgtcccctgccgccggatctagcggagggaaggacgtcgtggagacggctgcggcccggcgggggtgggagggtcggcgcctcccccccccccctccgccagatccggcgggaggggacgtgcagtggcgacggcagaagaggcatatgttcatgttgtgtttttatgttcatatgtgttcttgatggaatgtgtgttcttgatggaatcagttatcggctcaactgcagtcgagccgaccttttttttttcaatcgtggaacctcaaaggtgccggttcctaaaccggcacctttgattcaccatatcagtgccgcctccggggtgtcgattgggaaatccggcacctttggaagtttcacaaccggcacttaagggcttttctgtagtagtgtcttttcagcttggaatgctctacgacacagt

SEQ ID NO: 49069 - DNA, 1501 bp, Oryza sativa
ctaacctcagtctgtttagctcataagtacgtagcttgttgttttcagcctcagaatcatgttcagtgtcactactatcttcttcttcttcatcgtcgtcatcatcatcaccaccactatattcaccatcactaccattgacatcaacaagggcagctgggcccttagttgactcaattttcatgcgctcaagtccaaattctgatggatagactgacactgataagactcgcccaccttttgggaggcaagatgtcatcaccatatacaggtcaactgcctattggaaggacgcaaacaaaatatagtattattgtacaatgaaggatgaacaaaactaatcaattgaaagttgcaaggagacaaaataacaatgtaacaactcagatcttcattttaacaaccaggattttgctaagttggatttgccctctaaactttccaaagtccaagcatttttagagtttggatatgtgttcgccaagtgcctcagtgtgcactgctctgtcaacaacatttttttacaagaacttagatgcaactacatttgtttacaagaactagcatcctcaataactatgtttgataaaataagtgaatttatatggtggactattaggtcctcaactaaaagaaaagagagtagtacacatagaaatttcacctgatttaaacagaacataagaaataaacataaacatctttcagccataaaacatactctgtaaatgctgctgccacctagcagacaatttttttccaaacatcaccccaatggcacaaaagtgttcgatagaagctaccaatgcgctcataaaagcaaaagcattaaaaaaatgtaatcacataataaacaagttttttcagtaaaattattggtttcaaggtaattcttaagcatccagtaacaaagccttttttaatatttctgtaaattgtttatgctaataggtttgcttgacaaaaaaataattattttcaatcatcacacaccttaatatgatcccagtccatattaacaacagcaagcctatgggtttccttgtcaatcataggtgtatcatcatgcctgcccatcaaataatgcgcaatgtcactgccgacagagtactgtgaaaaaaaaggaccatgtattagatataatgcaagaataatgttgcaaaacattgtttttttttcttgaagggcgaaaactacataaatattgcaatcattaatcaatgcttacaaaatacaaaaattacaaggctaactcaaaaaatagatttaagcggcaggatggtggataaaaatactaacagtggcatgtcattgtcagctgagtacatgagtaaagtagggtctttgacatgtgggtttatgtccaatcccttcaattggacatttggacaaacaaagtgcacttgagtcccaagcaattcgaagggattgtgtcaaataccacaacacaaacacatgccctttgttttttttggttagtcgactattaaaaatgcgtagc

SEQ ID NO: 49070 - DNA, 200 bp, Oryza sativa
aaaagatagtttggtccttcactcacatggagaagctttcaggggtccgtaagctgcagagtctcacacacctcgaactcaaggggggaacgtgcaacccgcagaatctggaaaaactgaaaagaaaagtcagtgaacacagcaatggtattactttcacgctcaaactacctgagaatcaaagtcagtgaacacaacaa

SEQ ID NO: 49071 - DNA, 1501 bp, Oryza sativa
tctcactaacaggctatggaagtacccatatacttgtctaatacgaacaacattataaagaaaatgttatcatgttcctgttttaaaccttaactaagggagatttactgctcctttaacttgaagttttgaaaatagtgtcaaagacagacatccttttcttgttccaccgatatatacccagggcttagatgacaactttgtaaagaacatcgaacttagggttaattaacattacaacattaattatattttgattcttatacaaaattgattactgaccacaagcaaaatactcttttcctcagtaataaacgagagtgttcaaagcgcgaaacaatccagaaattgtcctcaagggaggccataaaataggaaatttaaggtaaatctaactatatgcaatattgacgaaattgtacatattttcggagattttgacgcaagaacagagtatgagagtaatcatatgaaaaccgtacaaattcaaaaatttgagcgaagcaagcctagccttgtttccacaaaaggattgctctactcctttcgctaaacctcacagatcaaagcctataaacgtcctatctgctcttgccatctcatagaacatcaccatctaataacctgagaacgcacgaaacggggggggggggggggggcgattttaagacccgggtaagccactcacatcgacgatggcgcccgccgcttcagtgagcaccggcgagatgtccagcagatcgcgcctgcacgatggcagaagagagtaaagaatcgcctaaaaaatatctcgccaaaatcccccacataatcccaagctagggttaacgagcgaagaaaacaaagacggggaacagagagggggctagggcgcgattacagatggagattcctggggaactcctgcggcagcgagtcggatgggaggtagtcctccaggttcggccggtccagctcgatgtcccccgccaccgacgaggtcgccatccccccctccgtcgatcccctccgccgccgccgaggaaatcttcgcgatgaggagcgagagcgagagagatgggcgcaatgtggcgtacgtccagcgaatcgatgcgtgggtggatcggtggaccaacagacagcgaaggggaagagagaggctcgtcaccgggtgggccccgcacaccgacaggtgggcccactgcagcgcctacatgggccggctcgggtgaattagttggccaaaactgtcggcccatgtaaggtccataaaaccgaggtttacccttgcgcgtcgccgccactcgcaagcaagcagccgccgccatggcgccgccgggcaactccgacgagctcgcgagctccaagaaggtgaagaaatctaactccaaggaggagaggaagcacaagaagggcaagcatgagcgccccgccgcctccgacgaagcgccgactccccgcagcgacgcgaaggggagcaagggcaagaagcggaagcacaaggacggggagggggagaagg

SEQ ID NO: 49072 - DNA, 1047 bp, Oryza sativa
ctttcaacttttccatcatcacatcgttccaatttcaatcaaacttcaattttggtgtaaactaaacacaccctccatgttcgtttttttttaaacaagggagtacttaccaaaaaaaaacattgtagaatctatgaatatgatctaagggaaaggggatgggcaaaacagatattacccttcagtgttgctaatgatgataaagaccatgttaacctaaccagtcaaataaaaaattctgtgttccaaagtacccaaaataaaaactgggagctagtactagctggcttgaatggcgaatggcatggacagcaacatgtgaccgaacagcacagcgagacatgctaatctgatcctgcttcaccaacagcttcgctccacgctcgcacgcatcaaccgaaaaacgttagcatctcctaatcagatttacgagtaccatttttcttctgaaaggtcctaatcagatttgtgcacaagtgtcatggaatactacttggcgagcactcgaggcattctgattggcatcctttgcattctgttcgaggtgatctttcaaagaacgccgtgcaagtgcaagcaatcccgtgatagcgagaaatctgtcaaaaaaaagtgctgtcaaaagcaagcaagcggcgagctgtgtgttaggattttgctgcaaagtcaatggtgcagtgaaccttctgaattctgaacatctggctcggttcatacttcataggactttttatgatttaagttcagactttagaaagtaactctgcaaccaccggacataaagattatactactaccgtgtagtgtgtagtaccgctacattgtactcgtcattgtgtagtataatactagtacactatggtgttgtgaatggagaataggaaagtaattaatggtgtcaaatgataaatggtggtgataatagtatgatttctacagatagagtgattctgctgagtccaatatgctgcaagccagaccctgtttagatgggactaaaacttttaagtccctatcacatcggatgtttggatattaattataaat

SEQ ID NO: 49073 - DNA, 1501 bp, Oryza sativa
tttcaaccttaccaagttttggaaaagttaccaaaaaagtggctacatttagttgttgccaaattttagtaactacatatgaaatcttgtcaaaatttagtaaccttgccaaaattttgacaaccttaccaaaaatttgacaatgccaaaaattgataaggttaaaaattgtagcaaagtgaacaggctcgagataaaccattagcacataattaattaagtaataattattttaaactttttaaaaataaattaaaaataaatattaaaaaacacatcattttagcagttgaacgtaagcgcagaaaacgactaatcgagggacttttcctctttatcctctcctaccgaacgggcctatttcaactagatccggcctggtccaggaggcgatgtcgcactcgcaggtgtgcagctctctagtgggcttgcagattaggcccattagtgttgattgggcctcgaagtgctttgtcgtggacatcatccgccgccgtcttcttcctcgaccatgccgttgccggaaccggctagcgcggccggccggcggcggcggggaggccgcagtgggacgacgggtgaaggatcctccagctgcggaaggaggtggtcctcgaggccgaaggggagaggctacggagatggagggaagccgaagagaagggaggctgctgctgctgctgcatttgggagacgagaactcgactcgagccatggcggcagattggtgtttcacggcggaatgctaactagatccagcatctccatagcaaaggtagaatggtagattgaggtgagttttttttcccctcttctgcagttttgatgtattattactgccctcatctgatctgggtaacatatttctgagctcagtagaactgttaaaaaaaggcagaaatgcacaaactcttctcacaaaacaacatacaaatgcttatattttggagcggaggcaatacatggtatattttttaaagtgaaaaaaacaatcagacacatggtattgagtgatagcaaagctgggtgaccacagaaaatacctcctgctttaaatactttatacctgggctgtcaatcctcggagttcctcccaatgtaatgtctgaggaagaagtattgcagctaaattttaagggtttcttgtacgaaacagggacaatcagagattaagaaactctatgtggaaaaggccatgcgcattttgttatgtgattcaacaaataagatgaggaggcaaagtcatggttctgttctaattaacaaatctactatgggggccgttgctccctattgtccacgctccttttcttcatttctctcctgcaggatatcttgtcttttgattcttcattttaggtcttataaatatcacgtggttcaggcctccaatgtcaaattatcattacgtggaactctcttagatgcttgagaaaagttagctcttacctgtccatagaagctccaaggaagcgagaatagtagatactttggttggcca

SEQ ID NO: 49074 - DNA, 213 bp, Oryza sativa
  unsure (1)..(213): unsure at all n locations
tttgacgccgttgactttttagcacatgtttgaccgttcgtcttattcaaaaaatttaagtaattattaattctttttctatcatttgattcatagttaaatatatttttatgtaggcatatcatttaacatatttcccaaaagtttttgcataacccnaactgtccaccatgtgctaaaaagtcaacggtgtcaaacattttaaaacggagt

SEQ ID NO: 49075 - DNA, 219 bp, Oryza sativa
gcagcccaactcctacccaatcttgtgcaaagtctagatttggtcctaggggaccacaacccactcaaaaccgtggctttctttgcctcatcctccccttcacgcgcaccgcccgagcatccgacttagccacgcgccgtgtcgccgcgcgtcggcctcagggccgcttgcgcgtgcctgaccgccttggcgcaccgtcgcccgtccgacgccctcagc

SEQ ID NO: 49076 - DNA, 386 bp, Oryza sativa
ttcacaataatttagggattaattcggcctttttcaaaaaaaaaaatgtaaatgcgagcacctacgtcaagttattgaaccaggtgcaggtacattttattgtattttgaggtgcgcacatacattttattttacttcgcttgaatttattttgaggtgcacatacattttattttaacctttttaatacaaattttatttgacaatgaacgatcaacagatagcttattttgaacataacctttagtaagccacaccgcatgataagatgacgcatcaactcacactggtgaaagaagaatgccatttttggcttttcagagtgtttgcgttgtactatgtaattctcaaaaaagaaaaagtgaaataagttgtaattctgaaca

SEQ ID NO: 49077 - DNA, 1501 bp, Oryza sativa
cttttgatttcgtaatgttaaaatgcatagttgcagtaaacttttaacgctctgttgactttgttctatataaatttaagtagtaaaatttcttctaactaaaataaaagaattgcaccactagagggtggcagaagaaataaaatccgaatattcttacatccaattcctatcgtaactcgttgggcatattacgggcatattttgttgatagctaagagcatgtataggacaaggagggggtccttagactgtgcgcacgtaaaacggagcgactcattttcttatgattaattaaatatttactttttttaaaaatagatcaatatgatttttttaaacgactttgtataatttttttttaaaaaacacatcgtttagcagtttaaaaagcatgcacgcggaaaacgagggaggtatgttggcaaagttgaggaaagaacttagcaaaaggttgtgtttggcagagagagttggaaactctccctccaaacacgtaaaacgatgtggttcattagcacgtgattaatttagtattagttttttttctaaaaatggattaatatgattttttaaaagcaattttcgtatatagtttttttttcataaaacacaccgtttagcagtttgggaagcgtgcgcatgaaaaacgaaggatgtgtagttgggaactcaagctgacgaactcagcctaagctgtcaaagtgtggtgtgggtaagatttggcatggcaaactctagccaccaagcaaacagcctctaccttgcgcatatgggacaatatgggagtattccatctcttattctgaaggaaggaatgtactcagcaatcagtatccaattctctggtataaaccactcattccgtggtggaaactgacctaaccgcggcagaatatttcctccaacatagcagggaaaagacccccccccccaccccccctcatttcacataaaccattcgtatatactccctccatcctacatgttttatgccgttgacttttttaaatatatatgaccgttcgtcttattcaaaaaatataagcaattattaattcttttcataccatttgattaatttttaaatatacttttatgtacacatatagttttatatatttcacaaaagtttttaaataagacgaacggtcaaatatatttaaaaaaatcaactgcgttaaacattcaggagggagtggcagagaatatctttggcaaacaaacagcaaccctagctgagcaactactactcgtaggggcgaatccaattctccaaatagcccatgtgcacaacccggggcgttggcagcaaccgctttgcatacttaattctgggcatgttattgcctttgccaattgccactccgggaaaaggcacggcgtgtgttgtgtggacgccgcaaagctatggcgctcctgctcgatgtagtacactagtactccatgcattctattttaaacgcaaccataatcgtctctcttatttgatattttattt

SEQ ID NO: 49078 - DNA, 449 bp, Oryza sativa
gcgctcggtataagctccgcaaggatcgctccaccgcacatctttggttgctgcttttcttttgcttttgggtgttgggttgtgaacttgtgagcttgtgatgaggaaggagagagcgacgaggcggtgttaaataggggggaggggggccatccatcccgcggctccgaaatcgcgggaaaaaaaatcctaaagaaatcgcggcgaaagaggaggaggaggggggcgaagggataaggtcaggtgggtggggcccacgcggggggaggggggaggagaaggtgcaatgcatctgctgctgcgtttgcccacttgcgtagggggagtaccagacacgggccgtgctgtgtgtgtgtgtgtgtgtggtgtggcagctgtccgcggcgacggcgacggcgacggcgcgcgtgcattggttggcccggcaaggaaagggaaggggaaggaga

SEQ ID NO: 49079 - DNA, 237 bp, Oryza sativa
taataatataatgagaaaacatatatgtttttatatgagagaaaatataatgatgctagccgcgcaatctacgcgggccaccatgctagttcatgattaagacaaagtggcactgttattttgtgatgtttttcatgtcagtaagcatatgttccttgatccgaagaagtatttaggttcaactgatataaatattccaaaaatcataattgaaatgtttttacattgttgttaaga

SEQ ID NO: 49080 - DNA, 1501 bp, Oryza sativa
atggtatgaaaagaattaataattgcttatattttttgaataagacgaacggtcatatatatttaaaaaagtcaacggcataaaacatgtaggatggagggagtatatacgaatggtttatgtgaaatgagggggggtgggggggggggtcttttccctgctatgttggaggaaatattctgccgcggttaggtcagtttccaccacggaatgagtggtttataccagagaattggatactgattgctgagtacattccttccttcagaataagagatggaatactcccatattgtcccatatgcgcaaggtagaggctgtttgcttggtggctagagtttgccatgccaaatcttacccacaccacactttgacagcttaggctgagttcgtcagcttgagttcccaactacacatccttcgtttttcatgcgcacgcttcccaaactgctaaacggtgtgttttatgaaaaaaaaactatatacgaaaattgcttttaaaaaatcatattaatccatttttagaaaaaaaactaatactaaattaatcacgtgctaatgaaccacatcgttttacgtgtttggagggagagtttccaactctctctgccaaacacaaccttttgctaagttctttcctcaactttgccaacatacctccctcgttttccgcgtgcatgctttttaaactgctaaacgatgtgttttttaaaaaaaaattatacaaagtcgtttaaaaaaatcatattgatctatttttaaaaaaagtaaatatttaattaatcataagaaaatgagtcgctccgttttacgtgcgcacagtctaaggaccccctccttgtcctatacatgctcttagctatcaacaaaatatgcccgtaatatgcccaacgagttacgataggaattggatgtaagaatattcggattttatttcttctgccaccctctagtggtgcaattcttttattttagttagaagaaattttactacttaaatttatatagaacaaagtcaacagagcgttaaaagtttactgcaactatgcattttaacattacgaaatcaaaagctgatgttttgccacggcgaagtcttaactctaaccgttaaatctcttatcttcacagtgaccgtagcagagatcacacattcacatgcaaaaacacgtctctttctctatacttcactttcacctcgataaaaaagataaataatccacatggcaggtgagaaattaaactattatcccgattatgtggcgcccataaagccagcagcgcaagcccatgtcatgccaacacagtagagcattgcacgcgctgtattcaattcgatcgccatgtgtagcatgtgcgaatattttttatcattagaaaaatatataatcttttcgaggttttgacaaggagagctatagctttcagctggcccaataataataataatcaaataaacaaggaaaacaccacatgtttcactgtactagttgagctctga

SEQ ID NO: 49081 - DNA, 1501 bp, Oryza sativa
gcctctggatgataagaaccccacacgttccaactacgcgctgcttcaatttgtagtactgtagtactgtttagagcaggtacaatagcaggctacaaaccagctgcaaatatattttaagaagataaataaggagagagagaagcagcgggctacagatttatagccacctgtagcacggattttaagacgtattgtgtatataacatgtgggaccatatattaatagtgtagtatgtaactatagtataaataagctattaaattggctatagataaattggagctagtagttggctactattgaacttgctcttataacccgcaagttgccgtcgcctcccgccatctcgcatgattaaaagtttaaaaccgaaccaccaaaagcgcgacggcaaattgcatcgccaagttgccactggaacagggacacgcaattaatgtctctcacccttttcctctatctcaaaaggtacatttcgttttctttacctaatttctccctctcaaaataaatttatctttcattcatctcacacgtatcaatacaaaatcggaaaactaaaatacatctattttatcaaactctatatagtctcttatttatctatttttaatataattattttatgctttcacaaacttcgatgtaacgattactctaaaaataaatttattctaggacaaatgagcgaaaaatgaacatataatgagagagaaagtacctttgctcaagtttcaaatgttctcgtagcaaagagtactactggtaaatactctaccatgataataaacctttgctacaatatgagataaaatcctttgtgttacaaatagataatgaatctggtaaaactgaaaatcacgctgtgcaagcgactctgtgaaaaaactgtttctggtgcttttgctgctgtgcctgggacctcctcagcttgtgcaataccgctttcctgaaacttggcacgccgcagaccgcagccaccttggttttgcacatcaagttgaatgaccgagtgtgacacaagatcctgtataaacagagaacgccattcgttaattcgcttgcaaaaaaactttccccagtgtgacatggacacttacgtcctgtttagttcgaaacgaaaatttctagcgtgtcacgtcaaatatacggacacacatttaaagtattaaatgtagactaataacaaaacaaattacagattctatctagaaactgcgaaataaatttattaagcctaattaatccctcatcagtaaatatttattgtagcaccatattgttaaatcatgacgtaattagacttaaaagattcgtcttgatatttacacgcaatctatacttttttttatatttaatatacatgtgttcaaacattcgatgtgattgggtgaaaaaaatttgcgtgtacactaaatagggcctaattcgcttgcaaaaaaaacctttccccagtgtgacacggacactgaatatatatatatatatatatatata

SEQ ID NO: 49082 - DNA, 1501 bp, Oryza sativa
atcatttaagcttgtctgcaatgataaaaaacaaataaaaatgactttgtctcttttcgtttatatcagattagttcgagaggaaaaaaatatataccagatcagaaaacatccattatttatccctgaaagtgtatcattatcttttattaggaacgcgaatattagagaataacctaatatcaaataattagaagggttgaggcttcgaatccaagtcgtctagcccaccaccttgtggagctagccgaaagacccctgggtgtttctcatcttttattaggaacaaggatgtaggaaaaaaacagagaaatacaactaagttctaaaagaattatttagaaaaaaagagaaattaaaacaattgattgataggatatattaacaaagcaacttttttagggaaaacaattactatcataaacagagatagccgctatcatatgaaattagacctagatctacgtccaaagacctaaatatgacaacttcaacaaataaacgatgattgttgctcaacaaaaacatgtagtgcgatccccgctcgcgatcgtcaaacccaaaaaactagaaggttttcatcccccggaacctttaccactagtataccccatgcctccatgtaatttgtgaagatgagctttgttcccaacgactgtcgtgcaacaaaacagtcaaggcgatccatcaagaagttggcaaagatagttttcttagggacagacacttaggtttaccaacgcgtgacaagaagttaaaaccgcacttctcgatattagacgatatcaacaacatattatggtggatttctttcagactaaaaaattctcgatatgttattacagtcagcgacaaagccagctcctgtacaggtcgagtgaccacccgggctccaccactagtacccctcactacaggtagccataaaaaaaatcgatcaccaaaaaccattattaggttgtgttccgatatgggaagttgggaactaaactccccgcacggaaaacggagcgattcattaccgcatgattaattaaatatttactattttttttcaaaaatagatcaatatgatttttaagcaattttcgtataaaaactttttgcaaaaaacacaccgtttactagtttgaaaagcgtacgcacaaaaaacgagggagaggggttgggaacataggattgcaaacacagccttagtcgtcacggtatcacggacactgtcactgaacacagcaccactgttcccgtgagtccgtgacttagcagcacttgtcccgttctcctgaagacagtccaaaaaccctcactaaaccttcccaaaatatctcctccaatcaatccgaaacccagaggcccatactgctgacacgtggacggcactcccagatatttgcgctctcctcttcttcttatacccccgccaacccacgctctatccactcacacacactctcctcatcccagagcaagaagctcagctcctcctcctctcgcatggcag

SEQ ID NO: 49083 - DNA, 497 bp, Oryza sativa
aactttctgaagacaccttaaggtctaccagggaggtccgcgtcgctgccgggagaccggtcccgattcctgagcacttcgacaaggaagtgcagtattgatacatttgctctagataaagttacctgatatttggcacaatgttctgtcctccagctttgatgctcttgaaacccctttacatacatggatgatattgctttaaaaacttaattacttccctagtcacaacaaaaactgagcgtccggctcatcaccaccactgccgtccccaccagcccgagcacaggtggtagtgtggtagcagccgggagtgacggcggcatgatgtggaaacgtcagactaggtcgcggttccgcggaatggtcaagcggaatcaaataaaactcttgttcctaatgctgctaatgcagtctgtactatgctatatatgcatcactgtgctacgctgaccattcacgtagggtctgtttggttgccctcaccaaggttggcc

SEQ ID NO: 49084 - DNA, 352 bp, Oryza sativa
acgtcggtgtcggcgtaggtgatcatgtcggtcatgtaccgccgggtcatctcgcgagacacgatggactccttgatggggctgaacctgatggcgttgaggtcgtaggggggagtggacgacgacgacgagatggagttgcagatggcgccgccggtgcgcggcgcgacggagacggtggggttgcgggcggcggcggggaggcgcgcgccagcgaaggaggtcttgaggaggctggacgcggtggtggccatggctgccatgcgagaggaggaggagctgagcttcttgctctgggatgaggagagtgtgtgtgagtggatagagcgtgggttggcgggggtataagaag

SEQ ID NO: 49085 - DNA, 1501 bp, Oryza sativa
aaatatctgcaactgctccagctttgtccacatatcagacaagtgtcatatcgcctttcttcgagtgatttttctacatctttttcaagacagatatttgcatgtctgcaatcttcaaaactatgcagaatgaattgaggccgttgaagttcccatcatatctcgtcagcaaagcatacaacttgctgatagggaccatacgacgaatgaagaaattccaaatgctacactgctttcagttacattttcttaatttatatgatgattgcaattactactactactatctgggtaaaacaataattgtcatgaccttccgctgcagaagtgattgaggcccaattataatctagtaagacagtgcaaagccatctccattcagatttgtgccacacatttttgtccatccaattcctgaaagtgacactggatcagacaggctcttttctgaagaaagatcacgttatatggcctgttctcttttcctggttgtgatcatgtgatccttatatcatttctttgaagatgacccctgcattgtttactggcaaatggcaacatatagtgatgatatatttcttatgaaccacatacataggcacggaggtatgattttgacttcagatattttacagcgaagtagtctgagtgggtttaaattattttacttttcttttttggaaatatcaaacctgagaagtaaaaaaaaacagagacgaagttaagttttgagtgaaaagcacagggaaaagaactttttttttcttttataaagagaactacattcaggggttgcaaggtttgttttaagggtaattttaccatccttgagaaaaatactaggtgataagttaaagtgagttcaaatttaccctttcccaacttctgctctttcgtttttatgcacacatttcctgaactagtaactatatgttttttaaaatcttctatatgaaaattgctttaaaatattatattaatccattttaagttttttttctaatacttgattatcatgcgcaccattccgtttagaatgcgtgaagaattagctcccaacccatgataacaaacattcttattgggtacttcgagttatcaaactttttagtgtcaaatttaggtatatcgaggcatttttctcaagtaccaaatttttttcttatattaagctcgaatgtgtatcatgaaaaaagcagagaaatgtttgcatcagtgtgagggagaagctcatcccgaacgggaatacatcacgatcaacagaagaaattggaatgcaaagtacaaactatagaagaagactgaattgtttctcagaagccgaaccttgttatgaccctgaaactggcaatcattccgggctgcacatccaaaggcatgaactttgaagtggttaatccattgattctgcttgcacttagtggctccatccgaggaaattcggatactacatccttttttacagaaggacttgtttgattaagggaaattaatttcacat

SEQ ID NO: 49086 - DNA, 384 bp, Oryza sativa
aagccctgtgttgcgatggaataattatagaggaaaaaggcacatatggtgtcggagcccaaaactaataacttgaatccgactgagattaatgaatcaatccctggatcagtaaatattgatacatacaatataaccggttcttcattgcatatgttaaaaagtcttacaatactaagggttttacaataataggtactcacctaactaattaatacacaacagaagtttctatacattctgactagtgaggtataacctttagggattctctaagttatcgggatgttcgtagtaatagtcataagggtcctcctcttgacccagatctgaaaaaggggttataagagcaagggtgagtatttacaatactcagcaagttat

SEQ ID NO: 49087 - DNA, 253 bp, Oryza sativa
tttccaaatagacaaaatcgattttcttatgcggttgtctggcccgcatgcgagaaaatgtctgcgaaaatccctattttctatgtggttagcgcatatgcatgcaaaaaggtaattttcgcatacgaaaccttaagccaactacatgcggaatattttttggcaaaaaaaaaaaaaaaactctagccatcccaccacgtgccggacgcccgctccggccgcccaccgccgtcacctcgagtccttgtcgtca

SEQ ID NO: 49088 - DNA, 329 bp, Oryza sativa
tataagattattagagatttaatataagattgttagagatttaatataagattcttagacttagcatatatatatgattattacaattttaatataatattagtagcgatttaatatgagattagtagagatttaatataagattagcagtgatttaatataagattgttatacttagcatatatatatgattattacaattttaatatgaaattagtagcgatttaatataagattattagagatttaatataagattagtagagttttaatattacggttagcaaatacatcctatatacctaacaagtattttttgtatgcacaga

SEQ ID NO: 49089 - DNA, 1501 bp, Oryza sativa
cttttgattccttcctctgctgaatcatttcccattttatcaccggacattcaatcttgtccatgcacatcctaaatctctgaactttcacgtcgtctgaactaacgtagccaatgtattactccctctgtcccaaaatacagtgatcacagagatatgaagctatctttctccattgcaagaatgaagtggactgcaggtaaacatgaagctagtgatttgttactgatagtaagtggtactaatcccctagcagcatttgtcactgcttatgttactgttactaaaggtacctaggatggttttccatagctgcatttgttttgattccgatttgatgagcatgtaaacgagtcaccagtgacatccatgacacagattctttgcttttagccagtttgctgtcccagtctttgtgcagaaaggaaaggtaagtcgccagaaggacacaaaacctgttgttcctcgagttgttggggccagccaaatccatggagatgcacacagggagcagtagttaggagtgtggcttttgagttcttctgatctcattggcctcagattgtcaaggggcacatgattgagaaagacaatggaggagtcatctgcatcactgcatgcatgatgtgtttgagagacagaagcatcccttgtgtgtcctgtcctgtgctgtcattatccccataatttgagtgttcctcctattagaccaagtttagtaatatagccaactactaactccaaatcatctataatcaatttaatagccaattcatacaatagttacctataaacatatactacactattgacgcatagtcctacctgtcacacacactgtgttttggagtccgtgttgtagctgacaacaaatatgtagctcattgctattctcttttatcttcttaaaatatgtttatattaggcttatagtctgctattgtacatgctcttaggagatggctacagtgctgctcattgacagttgccacttggtcttgtttggtttccagggacttattctaagtctctgtcacatcgaatgtctgtatactaatttgaagtattaaacatacactaattacaaaacctatttcataaccttggactaattcgcgagacgaattttttgagtctaattacgctatgattttgacaatgtgatgctacagtaaacttttaataattatggattaattaggcttaaaaaatttgtctcgcggattagctctcatttatgaaattagttttttattagtctatgtttaatactacaaattagcgtccaaacatccgatgtgacatgggctaaaaagttttagccccatctaaacaccccctagctacattgtctctgtccatgatccatccaatgtaacatcccggcctagggcttaataggattaatagaatactcatatcaacaagttgcaacttcttttccggaatccaatctccaaagaactccagggttaagcgtgcttggtctggagcaatttgg

SEQ ID NO: 49090 - DNA, 1501 bp, Oryza sativa; identical to SEQ ID NO: 49044

SEQ ID NO: 49091 - DNA, 1501 bp, Oryza sativa
ttgttgtcatctcagcatttgggaactctttattcctcaaagctctaatgcttatgcaacaagtagataaaacggaacacaactacatccagtttgttcagctaagtaaaccctaatgttaacgttttatacaggagagatggactgcaatatggggagaggaagacataccttgtatctcactgtctacgcttagcgcctcagtcatgcataagctaaggtgaggtgacacaagttcttcctacattattgctttaaacaattttcttctttggctgcctgcaactcacttctgttgacattgctctcatattagaccgcagccagcgtgggatcgtacgtgcaccgcagcagcagcttctggcctcctctgggaattggatatgcggtccgagctcggtgcctttgagctgggaaagcaggctgaagctgtggagtgttcattggatgtcttgcttgatgctctcacggcacgacggcttcgcctgggacgatctataacccgaaaacagaggcataataggaactgcatatagttgcatgcctggaagcctgggttcatttttttgcagaataggaaagctgattagatagttaaagcgtattccttcactcttttgaggtcactagcaactgctgaaatatggaaaacattccttttggcgggaaattaatatggagaaatcttttcagctgtgatgttagcaaaaaactgaaacagcatattcaaaggttgtaaaacatttcttttggcaggaaattaatctggagaatgcctaagttttcagctgtgataccaacagactgaaacagcaaaggttgtgcggatttgtagtgctgaaaagaacatcgaatacaaattatcctataatgctctgcagcgataaaagttcctataatgctctgcagcgataaaagttcatcgttctgtttttatgacctccataatcaataccgcctatcatttcgttgtgtgaaaaatttattccctttctggctacggagccaaatttcggcgcttgatagcagggtttgaaatttcggttcgaaatttcggaaatttcgcccccaccgaaatgctcatatcttgtccgaaactttcggtttttttgtaattttttgtgaatttgatcaaattttattcagatacattcaaaatcagtcaaaatttcaaaaaatttcgtacgaaaaaaaaaatctgaaatttccaaaatttcagttctatcgcccacctgcggtagaaatcctactttcaaaattacaaaccctgcttgataggaaatcactatatacgctgaagaaaaaaggcttcaacgattgctgggctcgacaaccccgaacagaacagttcaatgtgtaaattttcgagatgaaataaagagcaagtttcacgaaacataagcgaaagatagtaatgtttcaggatcaactaatatagaaacagtcaaaattgtcaacctcattcagcatctgcttcctaaatgaaaagagaaacaagatg

SEQ ID NO: 49092 - DNA, 1501 bp, Oryza sativa
gatcttttgtagatagaatataattgttcaccatcttcattctccagatcaagatcacttttggaatatactgttttttcactgtagtagggagtcataatactgccaagtacatagagtgacactgacacacaattatgtgggcttcaatcttttttattgaaattcttattatagtacacttgaacataacagggttatgagatattaccatggtgaattaattttttttatcttatcaaagaattctttcaatttccgtagagaatagtatctgatccgaacagaaggggcgggaaacaactgtagctccctgattccatacacaagttaggctgtgttcttccccaacctttcccaactcaactctctcgttttccgcgcacacgcttcccaaactactaaacggtgcgtattttgaaaaaaaaaattctacaggaaagttgctttaaaaaatcatattaatccatttttcaagtttattttagctaatacttaataaatcatgcactgatcgtcgctccgttttgcgtgttgggagtgaaggttcccaaccctcgctcccgaactcagccttagagccttatgaaagagggaagactgttattaatagcaacttttcttcagacaaaaaaaaactgctatttgagggaatgccgcatgggccctataacttacttttctatttccaaccaaagctagaaaagcagcgcatctatcccgagttttcctttgtctatcctgagttttcgtgtctagcttgctttctcactccccataacggcgttcaaagaaaatctcattctgatcctataacttataactaagtagtgtactaaagagaagactaggatgagtaagcccttacctcaagtctatgtgtggcaactagctatattactatttattagtcagactttttcttgatgggcctattgccgcctatttaggataataataaagtcttctacaattattggcacattggcatatagttactcctattagtgagaattgtattcggaggagagaaccttgcgctaaaagggctttgatttatggtatagattaggaattggaataaataaggctaactacaagagagaagagggtctacagccattctatgtcaacactgaagaataagacatctatccttactcttgcatcaacataagacaatcttcaagggaggagagtatattgaatatgaggctgccctttggcaaactcataataaggctgatgaaagcgaagcagaattgaaaacaaatatggtactccctctgtttcaaattacttgttctatatttgtactaagtcaaacattttaatctttgaccatcaatttctataaactcatactccctccattccaaaatataaggcacaaccaccattaacccaaagaccaaaaaataattattatcatcttatagtttagatcatcctaataaatataatgcatgcatccgataggattagataacatagagagtgg

SEQ ID NO: 49093 - DNA, 1501 bp, Oryza sativa
aggacacctcgggtagtagagaccgtggtcgagagtccccgcaacgtagcggatgatcctcttcacagcctgctggtgctccgtcgtcggtcgctgcatgaaccgattgacgtagccgacggagaaggccaagtccggccgtgtgtgggtgaggtagcgaaggctccccacaagacgccggtactgtgtagcatccacctcctccgccgtgctgtcgcggctcagcttcagtctctcctccatcggagtgagagctgggttgcaatcggtgagcccaggcagctcaacgacgcgcttggcgtaggcggtctgtcgaagcgtgatcccggagtcgtcctggtgcacttcgatccccaggtagaaggagagaggccccagatcactcatctggaaggtggccttcatctcctcacttgaacgccgcgacctccgcatccttggtgccggtgatcaccaagtcgtcgacgtagacacccaccagcaaggcatttcctccattgccccgccagtagatggccgcctcgtgcgggctttgctcgaagccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgttcagaaacgccgacttgacgtccatgtgatggacgccccagccttcctgagcagccagcgcaagaaggagtcgcacggactccatccgtgccacgggagcgaaggcatcatcgtagtcgatcccctcctgctgcacgaaaccgcgtgccaccaagcgagccttgtgcttgacgatggctccggcttcatccctcttcagcttgaacacccacttaagggtgatcgctcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctctaggtcgcgaggcaccagtcctggcaccggttggtcgccgagaagatcctccatcgtacggtaccgtagctgctcgccgtcgtggtacgcgtcgatgcgctccctgtcgtgggagagcggagtagcgaactccactgggctgcgctcaacacgagctggcgtcggagtagacgtgcttggaggagtggctgttggtgctggagcatgtggagtcactggctggggtggtgtcgacgaagagctcgtcgtagtcgaagtcgtggcccgagggtgtgttggtgtcggagtcggtggagattcgagggctggggtagacacgctcggtgaagaagagctgcctactcccccagctccctcgaagtggatgtactcgacggtgaagtcgtcgtacgtcggagtcgaaccatcgtccaccgcc

SEQ ID NO: 49094 - DNA, 1501 bp, Oryza sativa
tgcttagtaaaagattatatttgctcgtttggaattctctgtgctagtgtctagataagtgtattcctgtcccaaccctcttcacatattgagtggcatttttaatttagaaggagcttaaaaatgtccacatttactgacaatctaatgaccaggggatcttttctttgttatttcatcaatgcattgctagtactgaaaatatttgcattatcgatgttccttttctgtttgcattctatccttctattttaatcattgcataaatgaatatactgttgcatattggaagttgtcttcgtggctgctgttttgaacctgttggcgcattgaacaactagggtagtgtttcacagaaacaaatccaaaccagaagtaaaaatgtatgaactagtaatagaaataagatttgaattaattttcttgtggcccatggaagattatttcattaatttgtcgtctaatatctctactctccctgctatatttagcaaggatatatgtatctgtgcacttcatgtttaaatactgtatatttccattctgatatggtttttgccaggaaagggaaaggtttcatttctatatccgaataagagtacaacccccatgtctgtcaaagatcttaaatttgatggtttgaacttgagttgtgatcatccggaggaggtatttattctgttctttaagctgtgtattaataagttgcactgttgcacaccctgttagaatttcaatggttactctcattgagaagaggatggcactcgagatggggcaattttctggttttcttcattcacaaaacacaaaagccatacctacccgagggaggttggatacatatatatagccatagctggctgctagcctattgctgcaccctcctagtctaaaattcgaaatttgaatgggatgctgtcctagagggcatccaaactgaataaagcataaaagaggcataaaggagatgctaactgctgctgtcctactaaccgcagctgtcctagcaactgaaaaatatgctaaagggtagatgctgtcctgaaaaaggtgaaactacccaaaagcaaaaagaagaatcacaaccaaggaccacaaagacttttccaacattctccccctaagtcttgtgcgtcgtcttgtggggaagttgggccatcccgatcctggagtagagctcgaggaacttgatcctcccaagaggcttggtgagcaagtccgcaagctggtccttggtgttgatgtagctcgccttgatgctcccttcctccaagtagctttggatgaagtggtacctcacccggatgtgcttgctccgttcgtgaaaaacggggttctttgccagggccagagcggacttgctatccaccctgagctccaccgttccagtgtctctgccgaggagaacactaagcagtcgagcaagctagagcgcctgggtcgaagcggcggaggccgccatgtactcggcctcgcaactggacagggccaccacctg

SEQ ID NO: 49095 - DNA, 1501 bp, Oryza sativa
aaacctaataattgtaccatgatttaataatatggtgctatagtaaacattcactaatgatggattagttagacttaataaatttatctcgcagtttccatgcggaatctataatttggtttgttattagacaacgttttagtacttcgaatgtgtgttcgtatattcgatgtgacaccccaaaataaaaaattttgccatctaaaccagcccttacgcacgttatataaaaattggctaatatcaaccgactctttttttttacaaaccaagatctaatgttttcacgaaaaccatttggttttgaggatggcagcctccctcgcagatgcgaccggtggccttcttccccttctcccctctccttctctagatgcagcggggtggccgtcgttgtcgttgatcttggcaccgaagccggtggcatgcgtcgtctgagcaagcggtgagacagcttcgagattgccctcaacatcagagttgccatcttgcttctctcctgtgcttggtggcagcgacgactgtggtggaggtggtgtcgtcgacggcatatttagacttggaggagctcgttggcctccctgccttctccctctccatgcagttgaggtgatgttggcaacggcgaatttggacttgccactcttcattggaggagcctcctcgccgcctccatatccgtgtggtggatgtagtgttgggcgacgatggatttgaattttgccccctcaccggcctctttgcttcctctctctccgtgcacactcactgggctctccgtccccttggcaggcctccgcactaactccggatagctttggctcgtcggcgaagagaggagatagaggtggaggaagtgggttagtgggtcccactattttttatcttttttgtttgactgatatatggctccgcatattatgttttattttttttcaagtcatatctttttatttttttttcgggatcaaattatcatataagcgtcacgtcaatatcacgtgagacaaaaacctagttaaaggagcaacgtaggcatcacatcaatcaaaactacggacaataccgtcaagggatcttattttcgctggttttataagttatatgatatactgtgtgtggttttacggttcaacgacggttttataactccgcgacaaaaaaatgagagaccccaactatactttttactctaaaaatcggcaaatcgccatgcttttgggccaaaatggcacattctactcctttagcaccctgctatgagagcccaggcccacaaaaaccggcctgcctagctgcctctccggtctcctaccctaccctacctccccagtttcccgccaaatctcccccagtttcccgccaaatctcctcctctattaccctcttcccgccacttctccggcgtcttcccccctttccccgccgcccgcgcacccacgcgtctctctccctctctctccgccgccgccgccgccgcagccagccagccatccagcca

SEQ ID NO: 49096 - DNA, 372 bp, Oryza sativa
cacctagggcgagaacggtcttctctggcccacgttcatgtgtcaagggccaagcgcatgtccattgctgtgtaaccactcccggtctacaccagccatgcgcacaatgcttgcgcaattgcgacacacacgctcgtgaacccgcgagagtcggctctgataccattttgtaacgtccggcctcccccaggccaggccctaggccgggatgttacaccctcaccccctcaagagagatcgacgcccccgtcgatcaaccctaggccaggaacgtcctctcttggccacgttcatgtgtccagtgccagcgcatgtgccatgctgtgtaaccactcccggtctacaccagccatgcgcaccatgcctgcgcaa

SEQ ID NO: 49097 - DNA, 1501 bp, Oryza sativa
acagaagtttctttgaatagtttaattctgatcggatatgggaatgaatggatagagaaatcaattttaacctatttggaaatttgattaaaattgtagtatttaaagtaaatttttaccaacccatagtagaacaacgtacacgtattccaagttgtattttgaagaccggttcaaccttcaaaacacagattcaacaggttgtctgaactgatcgagttggattgtcagagatcaaactggactgaactttcgttcacttcacctatcacaggattaaagatttacttatcacagaagaggagatatgcagagatccagagacagatgcaaagaaaaatctcccatttgatctcactgactcttctccctgattatcagacaacccatcatgctgaagattatcatgccatttcgccatttttcctgtggccttgcccaagaacatgcaagccagacaaaataaacctcacatggacggaaaagagccatctgtctccaagcttgcgactgatcacacaccatgcatctatcatccatccaattttggtgtgtgctatccagaaaattaaacatatgtgataagcatgatatgatctagacctagctacccaacgtctcagacacaccacatgtgaccctttccctttcacctcatctatagctatagctcccctgtattaaatacaaagatgataaggaagagaccaattaaatggcaaatgggtcgtttgattctctgccattagtccaaacagcattcatgcatgcatgacatgaacatgccatttcgatgtgtatttaattaagtttgtaacttcgatttctgggacattccagatcaaactgaaactgtttgaaaacgagtacagaaaaagtatcggagaggagtcgaattcttggtctttatgattgattagttctgaacagaggatagagatttgtgagcttttaatcttgacgtacgccacatgacgatgcaattgtttcacaaaggtggatcaagttaatccagtcaattcagtcgccgaattttttaggaagactcgaagtcaccgacgaaatatatgctcgaagaatgaatattacgcatgttgactcgcaaatcgtcgctaactgtcccccactctgcttgtgatttttaatcatgatcaatatatcgatcgacctcaaagcaaaagagagtatccaaggaactgtcactgtgcactagctgctaatactacatgtatatgacgcttttaatttttagatataatatttgactatatgtttaaatttgacgtaaatataaaaagatataatttttttgacgcaaaaaaggatataaatcatatttaaagtacatttaaaaatattttttcgtaaacccgtaaaaagattgcacgtcaaaagtactttttaataataaaataagtattattctaacaagatgaatggttgaatgatatgtctaaaataaatattccgttataggacgttttaactttggttaaaatca

SEQ ID NO: 49098 - DNA, 1501 bp, Oryza sativa
aaaaccgtcgttgaaccgtaaaaccacacacagtatatcatataacttataaaaccagcgaaaataagatcccttgacggtattgtccgtagttttgattgatgtgatgcctacgttgctcctttaactaggtttttgtctcacgtgatattgacgtgacgcttatatgataatttgatcccgaaaaaaaaataaaaagatatgacttgaaaaaaaataaaacataatatgcggagccatatatcagtcaaacaaaaaagataaaaaatagtgggacccactaacccacttcctccacctctatctcctctcttcgccgacgagccaaagctatccggagttagtgcggaggcctgccaaggggacggagagcccagtgagtgtgcacggagagagaggaagcaaagaggccggtgagggggcaaaattcaaatccatcgtcgcccaacactacatccaccacacggatatggaggcggcgaggaggctcctccaatgaagagtggcaagtccaaattcgccgttgccaacatcacctcaactgcatggagagggagaaggcagggaggccaacgagctcctccaagtctaaatatgccgtcgacgacaccacctccaccacagtcgtcgctgccaccaagcacaggagagaagcaagatggcaactctgatgttgagggcaatctcgaagctgtctcaccgcttgctcagacgacgcatgccaccggcttcggtgccaagatcaacgacaacgacggccaccccgctgcatctagagaaggagaggggagaaggggaagaaggccaccggtcgcatctgcgagggaggctgccatcctcaaaaccaaatggttttcgtgaaaacattagatcttggtttgtaaaaaaaaagagtcggttgatattagccaatttttatataacgtgcgtaagggctggtttagatggcaaaattttttattttggggtgtcacatcgaatatacgaacacacattcgaagtactaaaacgttgtctaataacaaaccaaattatagattccgcatggaaactgcgagataaatttattaagtctaactaatccatcattagtgaatgtttactatagcaccatattattaaatcatggtacaattattaggtttaaaaaattatcttgtaatttacacatgtaattgattttttattaaaccacgtgatgggtgtaaagttttttttgttctggtaaaaaaaccaacaagcccccacatcccaccgattctgaattttcccaggaatctgagcggccgcaaggcgtcacgcgaaacccgtccaacccaactccactccatcctctgcagccgcagttgtgacggagactccaaggccatcaccatccacccgctctcctcctcctcctcctccgcttgatccctccatctcctcgatcgatctccacactccactgcgcactgcaccagcaacgcccccccctgatccctctccacggctgcaccggaga

SEQ ID NO: 49099 - DNA, 279 bp, Oryza sativa
  unsure (1)..(279): unsure at all n locations
ggagatgangggatgancagcggctacataacncaccacatgtgtatatctatttaattggttgtgcgttgggagtcatttattatacggtgatcaagttttttttaattaatactgtgatcaagttttttcatgacaaatagatggaacctagttctttcccgatagggatggatatcaaatcgccattagtaggtgcaatctcgcaagcacaattgtctaccattgattgccccattggaacaattccaatagtgcgcaacaacaatttggccaaca

SEQ ID NO: 49100 - DNA, 180 bp, Oryza sativa
taggatccattagtagattatataagatatcatcatgatactttaatatgaaatattgggaaagccatcaactgagggattcccgtatttattccctttaccgtccaatataaagataagtgtattttttggtatttgttttcgatctttgattaggattcatttttgttgttacgcaga

SEQ ID NO: 49101 - DNA, 1501 bp, Oryza sativa
agtctctaccggacatgccagctcaaagggtcaagcatgcgacgcggactaggttaattaggaaaatgtacatcgaaggtccctcaacttgtcatcaagttacaaaatcgtctcccaaccgcaaaaccagatatatgatatccctcaacttacaaaaaccattcatttgaggtcattcggtgggttttacctcggttttgtccgacatggcggctgtgtcagcgtaagacccacgcgtccagggccagacctagaggggggcgagcggtgcagccgctctgggcccccaaaatctcatggcccccagcccccctcccacctctcctgtacccaggcgtgaggcctggcccaagaacagaaggcaaagcatccatgcggaaggcgaagcggcaaacgcgtgaatcgcgatcagaaacagaagagaaagaaagaaacgcgtgaatgcgtgattgccgccgcactcgtcacagtgtcgcacctctcagggaatgttcattgatagagacgagtatgatctcttaaacaataaaagattatttagagacgtgtctttccaatagttgagacgacaaaggctctaatcattaactcaaaaaatattccttttgttaatattctttccatttctttatcctcatgcaaccatatttccatattatagtgattttttttgcggggtccatattatagtgattaatagtcgttgttaagcataacaacgatgttttgtctctactctttctctttctaccatgttaacaagtattcctaattagtaatgctaagagaccattattgacaaccattgtacatgccctcagccctcagccgtcacccgtcgcgccaggccgccagttgccgcaccagcagcccgctctgctgctgctcccgtcgtgccgccgcggcgccacctgctgtgcctaacgcccgtcggccgtcgcggcgtcgcggtggcgccagtggctgggcatgtacggcgtaaggcgatgtattaacaggccagagcgagtcgtcggctagattcgtggtacggcgcttgacgtaatccccagggaggcagggagccctgcgaacagaacaactaacaagcaggtagtcaactagtcactcatcactcattctgtgtattatcaagttagctaacttgttgccttgtttgattgaatgatggcttctgtttgatccatcgaaatatcgaatcgtcctcatctctccttcgtcgaatgtatatgcagcgtgaattatttctgaagtgtgaacacgccgcagcccctgcttttaaacgcttgcgatcaaccaattggtaagattttaaatttagatttgtaattttatagtgtaatttttatgagttaagccactataataatattgtttttttcaattattaggccatgtcatcgaggaatttttggatgaaattgatattggtacccttatcaatgacttcgttagaagaaattttttaggtaacataaacaatgtcctattgattattatt

SEQ ID NO: 49102 - DNA, 498 bp, Oryza sativa
cctgccggccctctactgcgcgtaaccgaaccggataagtcgcgcgtaacttatcggactccacgccgtttgcacgcaccggatttttcggaacgtttccaaaacaaaaacgaatccgaatttgcagcaaacaaaactgcaaaaggaggctgcatctgcgcaagggtgaggagccaatttttcggaccattcgacgcgtacgtcgtgcacgcgcgccgcctgccctgccctgccctgccaggccaggcgagcgagcgcgcacgtgtgtttcccctcttctctccaccacacatgtttcaagtggctaggagggcatcctcccttttaaggaggtccccctctcctagaataagcaaggtggtactaaactccacatgcatgccatcccatgaggtgggctttttgtgattttccaaagaattaatcttcgagtgggctaaggcccattcattaattccaacagtcagagccactgggatgcaggagagcggtcgacca

SEQ ID NO: 49103 - DNA, 261 bp, Oryza sativa
atgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 49104 - DNA, 833 bp, Oryza sativa
aaccggtccttaattgtcatgagcacgaccatcaaaaccatgtgctcacaacccaccattatcaagttttaattggcaaattaattaattaactaatcacgattaaccatcatgagctatcattaagtcatcattaaataatagtgaatcataagttatcccaattatatgagctagtgtctctaagcatggctaagcatcctattcactttagctaaaaccatataatgttctagctaatccaattattaaccaagtgacaaggaatagataatcaacatcaaagggctataacaaaggcaattggttattcccacccaatgacattcaaaaataaatgcagtagttgaatagaaacaatagctttaaacgggatcaacatgctcaaagggttgtttgggatctgtgtgacttgccttgctggccttggaactcttcaaattcttctcctgcaaaatcggactttccgggaacgtcggaatctaagtataaaagagcaaaatcaccaaaacagcacataaacaatcatgaatagtacatgtggatatttttaacatgtagatctcaattttagaaaaatttagagacttgaaccaactaaatccgagctaagatgaattagttatgaatttttaaagattaaatcggattaaatcatttatatagattttaattgaattatgacgcaatatagaattatttttgaaaaggaaaaaggaattattgcgtcagcaggctcgggctcacggtggaccgggtgcacggcgacagtctacggaacggacggccgagatcaaatcgatctaccgccggtccatagctgacgtcgacga

SEQ ID NO: 49105 - DNA, 1501 bp, Oryza sativa
  unsure (1)..(1501): unsure at all n locations
agtgcaggcaccggttaccaggtaatgccatgtcttgagagatgatccaatgggaaggaactcatcaaggtcgaaggtgtaaaggaatacgttgaatgctaaatgatgacaacatgaagagaatagtgggaagtaaactgaatgtaaagaaagtgaatccgagttgtctgttcgtgggagctattcccagttatgaaccaagtgatatgttcgaagatagtctacagaggtcagattaaaatcacatctaacaacgaagcttcagatttggcaggataacgatcagacaataacaagtccagcagtaaagccatttaggaagacgtcaaagcatgtcaagtgggataagttggttctgttgagaaacataattcaaaggcaaagttatcgacccttgcatcgaatagcacaagtagctagcacccagagtccaggaaagctaatatgaggcagttggtggcaagttagaagtaaatgacaagcatggtattctcatgatgacaagcatggtattctagtaatgacaagctgatatcgacgcataacgtgaagtgggtaacttgcatgagattgacacccaaggtatgaactatgagaagttctggaactgaagccccatcttcaagtgccgcaacctagtcgaagtcagctagaggtgtaaccagggacaagtcaagtgaagagaagattccatctgcaacaggagatcaagccaaacagttccgagtggggaagttttgctggacaagtttgttatacaagacgcaacagaagaagtcaggcaagaagagaagaccgcccaacctatcttcttgctagcctcctcgaatctcggggacgagattcctgtaaggggggtggatttgtcacgtcctgataaattcatcccgaaataaaaatcattctctaaaaggaataatagaattaattaaaatgcgaaaagaaattggcaaacactaaaatacgtacaagaaaaattcgaatgtggcccggagaatttttgttaaattctccttggtctaaaaagagctctcaaattttacttgaattttcagaacaccggaaataattattaagcaacaacaacaattaacaaagtttattaaaaagaaaaactaaaaataatcctccttcctcctttgggccaagtctgacccaaagtctctcctccctccctctcttttccttccgtccctccttcccggccggcccactgngnnctntcctcctcccgcctgggcctgccccggcccaagccgagcggctgcctccctccagcgcccctcacgcgcgccgcacgcgcgctgaccgcgcgcctaaccggtgggtcccacccacccggtcgtctccttcctcccgcacggcctcctctctcacccgtgaaccctagcgccgattcctcctccaagtccaccccattcaagccggctctttccaaattaattgcggggttttaatccccattggttcctctttgatttcccccgttttcccccttgat

SEQ ID NO: 49106 - DNA, 1501 bp, Oryza sativa
cagagaaatgtgcgaagggttaaacctggagatcaggttcgcatcggtggcgcacccacaatcaaacggggcggccgaacgcgcaaatggtaaaattctcgaggctcttaaaaagagacttgagggagcgacgaaggggaaatggccagacgaaatgttgtctgttctctgggcccttcggaccacccccacaaggccagccaagttcagccctttcatgcttctctatggtgacgaagcaatgacgccagccgaactaggggctaattcgccaagggtgatgttctctggaggcaaagatgggcgtgaagtgtcgctcgaactcctggaaggggtaagagtcgaagcgctagaacatatgcgcaaatatgcagcaagcactttggcgacctacaacagaaaggttttaccgacagagattttgcctagtcatcttgtgctaaggaagaaggcgaaacctgtggcggtctgaaaactagaatccaaatgggaaggaccaaatctgatcaagcatagttctcgagcgggctcctttcggctggcgaccttggagggtgaagagttcgaccactcctggaacgctgcctctcttaagcgtttctatgtgtaaaatgggtggcgcttgattcgccaattgtaaaaatgtacatattatgtaagccgttcggcacaaaaacaacaaaaaaggggggaaaatcgaaaaagaaaaaaaatactggacgtagggctattatccacctcggaggcccgaacctgtataaaaatgccagtttcctttcgccttatttattatttctgtggatgatgttctcgtggaaaaaccccaaggcaaacgcttgatcagtgaaaatgccagggggacgaaacgaatcggtcgaagcatagctcaccgaacgttgaaaccgtgacagctcgattttgacaaaaaataaccaagctccgttgaattcagcttacgcacagacttaaacgcttctagttgtgtttgccacgagccgaaaacggaagaggagagctgagaaatgaacgttcttttctgctaaaccacgcaaagaggccgacacgtttccacctaacggaagcacgaaagtgactatgcgaacattagcacaaagaaatgttaaaacatacataaacctcaatgggcgaaaacacatattctcatattaataaacacaacattcacaataaaattacatcttcgcccgcgcactcgtgtccgtctacgctacaagccagcgaacaaggttcgtcgtcactactaatattgtacacaacccttaagagggatggaggccaagcacaaacttaactataacggtgacgggcgatcgcctcttggcgactcgaccttttaaaatttcgccaaaagttagtgctatctttgcgatgtgcgacatggtagcggtcataatcttccaaggttcgacccggatgtgcacgcatccaccctgaaacctttataaccaccacgaacttctcgtttttatttcgccaattc

SEQ ID NO: 49107 - DNA, 381 bp, Oryza sativa
tgtaacatataaaatattttataaaaaaaatagcaatgcaaaaattttaaaacttctatgttgtgaaacgaggctatacataatattttgtaattacttatttttaatgtgataaatcaattgtcatatgtctctaagggcattttgggcattttttttaaaaaaaaacattgataaactcagtgatttataaaatgaaaatgtcaatggtgaattgttgaaccaatgcaatctcggtggcatagagtagattttctcctaaagttccgatatcccaaatgtgtgacatttgtgaattcattttccctggtgcaaatttagctacattgatgatctatttctcaaaccatcagtttctaaatgtgcggtttaatttgcagg

SEQ ID NO: 49108 - DNA, 366 bp, Oryza sativa
ttgatgcccaacggttatgcttttgcctcgactcgccttggctcagctcggcgcatgcacgtgtggcagtccaaccaccatctgaaccaatcaacagatgttctcaattagcaatctatttaagttgaggtctttctcgttggtttccaagatggtattaatctcttaacattaattatggatctttggggttgctagaattaatttgggcctagcccatttaattctaacatgatctgcacctatgattgcgggagaatttactatttaccatcctcccaaaatacacatgctcaaatgtcactttcaaattttcattctcatttgccatccgggctcacttgtctgcctcctccgtcacccagc

SEQ ID NO: 49109 - DNA, 327 bp, Oryza sativa
ctattgcgtcaatccaaatcaccctctaaactacaaaaccagacatttaacaccctcaaatcttcaaacaagacgaataaaccccctctgtcaggtagaaggttcacatgcaagtaaggtaaatgaccaaaactacataaagaagaatatgtcattaatgtataaagtcttacaggagagggaagagctactagaaccatacccgaattctccaaaagacttgaagaactaaagagactattctaattctaactctactagcactagaacaaagtacgtaaactaagagaactttttcacttgaatccttcttggtgtgtgttgaaa

SEQ ID NO: 49110 - DNA, 1501 bp, Oryza sativa
tcactcacgctgtcacgcaccacgtagctaattaacgtgtcctaacctgttcccccgtgatgttacaaatcacaccttccaaatggatgggctgtttaattatgcgatcctcaagctccaacaacattgcagaaagcaacatttcgatcgctgtcaggatcagtggcagagtcaaaagtcctagaatttattttacttgagtgaccgacagcgataatttaattatctgaaatttactcaagcctcagtaattagtggtcaagttaatgggcaatggtattgtcaattgcatggtcaagtttttgggacggatgtagtaaaaattagtggtcaaagtcaaaaatggcaatcgttgttttcgacagcatcagcctaacatatctaatgcaactttgtgaatctgtgatattgcacagattgaaatatgttctgatagtaatcacagaaacaacaggatggcattatgtgtaatgttcgatccgttttgcaacttttatgtccgtgaagatgacagatatctctgtatatctcctctggcacatgcgttcttccaagccaaacaagtcggacgatacgcaggacaaggagttgaggagccccgaggcagcgatggactatgtttgatgactttgctttgccatcattgcacgtgattagcgaactccaagcaaatggagatgatgcttccaagccaagtgataagagtaaaaaagttttctactgctctgcttcccaaggagtcaacctgactagttcttcctccgggttgataatacttgtcattttagacaaggatacggtcttcaaaaaacaactttgaccattattttttattataatatgtataaaaatgttaacaaataaatgcttttattaaagtactttttaagactaatctatacgtgtagtcactatatttgaaagataaatatttcaaatttgattcacaatcaaagattctaaagtttgacctcacccttgtctaaaacgacaagtattatcagcccggagggagtaactggcaactgctttgctctatacaggtttcagatttgctctaaacagttttgccggagtggttactgatcattgtatagtgggcttgcttgcttgcagtttatgcttcccagttctaaaacatacctgcacctggagcacacttctgttctgtaaaagaaaccaaatgttacaaaaagccatttcctcaaacatgcacttcgtcaatgtcatcatggtcaagtgaggatctagacctacccaaatcattaattaatagacatcaactatctatattatcgattaaatgcaattattgtagcaaaaaaaagatttctgctttttatttttgtcaaaataaaaactgttagtcactttgttcctaaaattatcagcctacctagttctacaagatagcctgctacacaagaaagaaaaactagttctgcctgcaacctgcctggagcgagaagtgccaaagaacaaatcaatctatgtggatttc

SEQ ID NO: 49111 - DNA, 531 bp, Oryza sativa
tgtccttgattctttgctttaattgggagagcaaatgcattcaagattgggatgggaatggtaaagagttttgattgtttcgttttatgggttttttgtagtgtgaaatcgatttgatgagagatgtgtaacatcctgtaaatattgacacaggtagccgatatctgtaacatcatatagtggcagtggattttctgaaatccacatagattgatttgttctttggcacttctcgctccaggcaggttgcaggcagaactagtttttctttcttgtgtagcaggctatcttgtagaactaggtaggctgataattttaggaacaaagtgactaacagtttttattttgacaaaaataaaaagcagaaatcttttttttgctacaataattgcatttaatcgataatatagatagttgatgtctattaattaatgatttgggtaggtctagatcctcacttgaccatgatgacattgacgaagtgcatgtttgaggaaatggctttttgtaacatttggtttcttttacaga

SEQ ID NO: 49112 - DNA, 445 bp, Oryza sativa
gggtacagtggtccacctctggccagagtaaaactattcgaatagccgtgcccgcggttatgggcggcctaacaatgtctttcgtgattagtttcacacctctcaccataataaatgatgctgtaattggtaataatttgtttagctcctagtttggaatggtatattcctggtttggagatagaactgtgcagccgggaatggttgttcagaatggttgggcctatgcaacgggtatgttgtatagcgttggattaatattgtttaattaataccttactgttttattaaattctgaaatatttattaaatgctatttatgcaaatgagactatgttatgccatcctttgttatcccttgcacttgcatatttgctgcgtggcttgctgagtatgtcatatactcacctttcaatcattcatcagaggaggagttctacagtga

SEQ ID NO: 49113 - DNA, 334 bp, Oryza sativa
gacatcaactcatggtaataggccttgatgagtgatattgttgtatgcacttacaagggctataagtggggaaggggaacgactcgggtcagttttcaaatgtgggtgcgagaccatatggtagggccaattatttttcgcactagtgtaagtttggaaagcagtcatcttgacaaatatgaaattaagcattgtacttagctaatgtatgttagtaaataagctacgggcagcattatttttgttcatccatacaactgcacttatattgggatgaaggtagttcataggacacaataatcagatggaataaatctgtccataagataaaaga

SEQ ID NO: 49114 - DNA, 1501 bp, Oryza sativa
aaacccaagaacagctatgaggagaagattcggacaatactgatcaccgtgcagatgcttcacttcctcaaaaagaagcctgaggagcctgaaaagaacctgtggagtcatcttcgtaaaattttcgagtactccttcattcactatctgtccattcttcgcctgatgacaaaaactcagatttgttgaaacattttcattttgcagcaaatttgaggttagaccctcagaggatgacttaagaaatcaccgtttactaattaagcattttgctgagaaagactcgaccttggctaaatcagaggtacgcaccatctgattattgatatggataataacaccagtatagtgtaatttaactctggtgattgtaacaactcttcaatgtgcttgattgctgtttacggtgacatcttatcatgtttttttttacagattttgcaaggcttcactcaagaaacttctaggaaaaagtttagtgaggtacgttgggactgtgccttctctagaaaattttgaaaaactgatctatgatattaattattacccttattataattacgtctaggttggttcagataaagtggaaatcaaagttccattcattgctgatgatgaggacatagaggagatggctgacgtggataacaatattgaatctgatgaagaagaggaggaagatttatttgattcaatctgtagcatatgtgacaatggaggagatctgttatggtaagtttgatatttatacagatgatatatcatccaaaatcctttcccattgcttcagaatgtacgcgacttctagtctaattagtcagttgaacatacacggggagagttcattattggcacagatacttgcttttagaaataggaattatttgcgatgtcaagctcaggaaggtccatattacctggcgaaagttttgctcccattttctaaagactttgtcagctatcaggtttaactgcttagcaatgtctgaattttctagctgtccaacaacaacatgtcctcgcctattgaagcctgtgtctcatgtacaatgagatcatgcctgacttcttggtctttgggattagattttgagaaattggattctataaagtagctactcaggtgatggtatcactaattcctggttaaatagtttgattaaaatctgaatcactcctgtccatgcaggcccttaggtatttaaattattcaagggaaattaaaagtccctctacatagggtttttttttttttgaaaaaaagaggaaaaagtctaccccccccctaaactttggatgaaggtccgtctaataccctgaacattgaaactagacattcaacccccctaaactttacaatgccgtttatataaatcctcaaggtggtttgcagagtgttttttatctaatttgtatataagttggatgagtttgatcgcatgacatacacactggacatatcgtatcttaccatataattggtacccactaagtagcactt

SEQ ID NO: 49115 - DNA, 1501 bp, Oryza sativa
cagaaaaaaagaacttgatcagaaggccaggtaaaaccatcaaaagtccaaaaatatatggcacatctcaatactaacagtaaacaaacaggaagcaaatatgatcatactacattcaacaagaaagatctgatgctactgttgtttacaacacaaaaatataatggtccacacataaagctggaaatctaccatggacctaacctttgttcatatatattctgtttcaacctgctgaactacaacagtaatagcgcgtattgcctgttcctcagttctaattactttggattaatgaattaactatggactctcgtgtatagtatgaatagacctacccagctatcttataaaaaacaataatatcatgtaaagatccaccaacagaagttagcaggggcgatcacaagctggggcatagaggtcaagttaaaccccaaaatacaaactgctattagcaccctactgcacattaaaaaaatgtacaacaagctggatagatcatactattacacgcatagagataaagatttggattatatcaaccaggggcggaactaacgtggggaattgctaccgatcttttcttggaatcaaattgctataagtactaaggttaaggttaagggaaagagaaaagcttccagatctagaagacaagctgaaggctaaggcgaagagataaggcgtcggtggagaagagaatgagaatgtcagtacgggtgctcaccggcgaggatgcggtggaagcagaaagacgccggcgccgctgctagccggaggcggcgggcgaactctctacgatgaggaaatcgaggccgatggaacagccagatcgactagggaacaaggaatcggaggccaattaagctatggccgggaacggtgaaatcgaccagggagcaaggatcgagcaagatccagcaacagaggctagcgaatcaacaaatttactcaatctgctactatcacccaatcggatcaaacgagcaggatcaaaatcgagaaaacgtattagggtcagcaccgaacgcagtcgattcctaccagatccggtcaaattgatagcaacacgaacacaaatcgagagagagagatcgcggggagagggatcgagttcaccatacctgcgagagagaagactcgaatcgaacccgggggaagcgacgagatttcgatggggaaaatctatcttccttcgtgctgctcgcccatgggttccaagcttatttattcatgacgatgattaattaatcccgtttcgtcatatcgttggcgggccgtaatgggaagcccaagtgtaatcggattaggaagcccgctagtatcaaagcccaagcccaacacgacagcaaatatctctctcatctcatctcttctccaaacccaatcaaaaccccatccgattcctctccatttcaccaccaccaccaccaccacctccgcctcctctcctccccttctcttcgccggcagccatggccaccgccgcagcagcagc

SEQ ID NO: 49116 - DNA, 263 bp, Oryza sativa
tgtgtaaccagcttctcagcacaagatgtacagccagtgctgtaagataaataaaagtatcatggctttgccgttgcacttgctactacatgctttgcctgcttagcattatggttgagtttactctttcttcatagaaatcgaaatgtgctgcctgcctgtcaagctcaccagccgttcaatggaccactgaacaaacatgtttacaaaaatcattatcttaagctgaaacaggtaatagtactgtactaatcttctgcaga

SEQ ID NO: 49117 - DNA, 1501 bp, Oryza sativa
ggatgcatgacgtcctgcaatggttacagtcaaatctcaaaatattaaattattaatggataaaaatatcactatttaaaatatggaaattatattagtagttttgtcaataaaaactcttgcatatagttatttttttatatttttataataaatatatagtttgagaaagtaatgataaaacatatgcaatggaaggtatgtcgatgtccaaaacattacccttttgaaaattgaggtagtactatctcatcttcgataatttataatctaagaagcggtcaatctgctaatttgatgatcaccagttcaccaccatggcaccatgctgcacttaacaacaaaaagaaatccacgtagaacaatgtcttgggactacaactgtcactgacatacagtccgagcagacacctgaaatgcaaaatacaacagtagaaacagtcaagctgattaaatataaacaggggcaagaaattaaacaggtaaaaagcgatacaaaacccaaataactatactctactaaataagctacccaaccatctgacatggtttaatacttcagaaggcaggtccccaattcattaaaaaaaccactagtaatttaattatagcaaattttgctacgctacttcgtggttctatatgtaagacaccacacgaagtaaattttaagaaaaaaaatactctaaaaatatgattatttactagatgtacaattatcgtttagttgttaccataaagaataccaaggagcaatttggggcacaccaatgttataagagcaggtcctatcttgtatcctagaaacactaaattaatgtatgcaatgtccattggtaaataactcagagtatattctcctaaaaattactctatgttgtgttttgtagttaaacccacgaagtctagatgtaccgcaacagaatttgcatttaattaatcaaatgaaacgagaacattgtgtttctttttttggttttttgcctgtaatagtatacgggtatacggtacgcccggaactagtcagacaaacgattcgcgaccgtcactccgcacgctccgaacccccgcgaccagaaaccgtacccgccttctcccgcaccgggccccaccatagtccacgtcacctgctcagcgctctcccattggtgggtgcgaatagtccacagcagcatgcggggtcgcagcccgccagtcaaacctcgagggagctttgaccagtcaacggtcaaacgttcaaaggtctatataatgatcaccggaggcgtcgtcgttggaagaagcagtagccacacccacacgcacacccgatcgatcctggcatcctactctgctcgatcgaatcgctagctttcttcttcttcttcttctcctccgtctccgatgaccgccgcgccggggagcctcccgctggtgaactcgaggcccgtctccctctccttggcggcgagcaggtcgtccttctccagcctgctcagtggcggcgccggctcgtcgttga

SEQ ID NO: 49118 - DNA, 476 bp, Oryza sativa
aatcggtcatggctgtgtgttgggatagatgggggtttattcactttattggctcaaattacaaacgtttcggtgcccaatttggtggtatttcaaccttcaggcgccagacatacaatggataatcttagtacgaatgaggcgtgcacagtagctaatgcttgcatggatgataaattttgctctttctgctggctattctccattggcagctaatttagcaacaaacattagcatgtaaaattacgcattacattccagttatccgtccaaaaaattgataccaatatggcgcgctttgcttaattatgggtctctttctgtttggcgcagagcttggcggacaataatacatatgcttgtccttgcaaacctatagtacagcgatcctttctgtggaacattgcatcagtctagaaatagattggaaaggggtttagcttgcgtatactatctgagactctggctcgacagaa

SEQ ID NO: 49119 - DNA, 1501 bp, Oryza sativa
cgctcgcgtgcgagaggaacctacatgatctgctggttgtcgctgccgtaaacgccgccgcttgccgaggcctcacacgcccgccgctcgctgccgccatacgcgcctacgaaagcagcagctggacaccgtcgcctccgccgacgcacgcgcccgtagcgcccgccggtcgcagctgacgtacgcagcagaaggtcgccgtcaccgccgacaagcccgtcgcgccagccggtcgccgccatcgcacgcgctggctcggttgattagggttaatcttgaatcaacggtgcgacggcttggttgattgggtgacgggtgggatttgagcaattactaagctacccttgttaataaaaatttgtgttcctaaattaccctttgaagattaacggtggataacaattcgttaaggaggtacctggggtacctttcaagccccgtaaaagatctcttatccagatcatcagcaactgagttttatctgtagaacttgcatacgaagattggagaattagatgagttcgatcggcctacgtatgtaaacacgcaggctgataaaaatctgcaccaaaaatctgaacctgtatatatgctcgcattgtgtccaacctttcgcatcagaagcatcaaatggtaagccgtccggtacaaactgaaaaatcttcagacgcagtacttcagagaccatgaaaaatctgccacgcacgaggattaacctggtatttactgaaaaaaaatatccttggtatgatgtgccctgcatttactgaagattttgccgccgcctcttgctggtctcttcaagacatgaggcctgttttgacaatgtgacatgacaagctacgttgcgaccttgcagcctaacacgttccttgatcagatttccgacggccaacacgtagtaaaatcgtagttttacgatctcagctaggccggcgtctgaacctcgtggcttgcagagccgcttctctctgacggatctgaatttctcggccatgaactgcacgagcgtctacaggttagcagcacacgctgcacgttactgtaccagaaacctggcatctctcttcgatccagtttctgacgaaagatacagcacccagcagctgcttccgattgacaacggctgaattgcagtttcgagcccctcctgagattaattgcagagatgttcaagaaagtttgcatctcctcttcgctgccaaccctgaccgaccactgctgttaggtcaggtgcctgtcacgtacactcctttggtcagaacaccatagcggagctcgcactatataagctgctcgccatgagccataatggccaacaagaaaccacacataatagagcgtattgctcggaggcagccacagccatcgccgtcgccgtcgccgtcgtcccctgcatttatcgccgggccaccgagatctcgcataagtacagcggcgccggtgagagggaggcagaggctgtaggtagctagagaggaaaaatccacgctagctatgc

SEQ ID NO: 49120 - DNA, 1501 bp, Oryza sativa
agttgatcgcttatgaggaaatccagaaaagcgacatgtgtgttcagcaatcagcacacaataatataaagttataaacatatgttgatatatgtcatttgaccacatactaaccctgttgtgatgatatctctctgtctagacagtgtatatattgtcttcagcctccagccagacatattcagtctcacagacgaagtgatggagatagaggacctagaggagagagaactcattggcgatgatgggtcatgatgaatcatgacaactttaggtgattagggagaggactgattaagtgatttgactagtgcacgcatcgtgaagaattttggccgttcgaaaataacgggatttatgacaggcaaatgggggtaatatatatgcccatatctgttgtctaaagtattattgcctcttatgatattagatttttttttcttggttacacagaacgattgaagacatgtacacactatgatcatgttcggataatgagttatgatcatgttttcgcgcagtcattgatcgatgtgagctgcatgagatccccctgcaaaacaggaagttcacttggagtaatgagcgtcgaaaggcaacccttgtcaagcttgaccgttgcttttgcaatgaggaatgggatcttgctttcccccaccatgttctccatgcctttcctacagggccatccgaccattgccctcttgtactgtccaacccgcaaggcccacatcgtccgaggaccttcaagtttgaaaacttttggacacgggtcccggggttcaaggacaaagtcaaggacatctggagccaaccttcttcgcacactgagcctatgcaccacctgaatcaaaagctgcaacgtacggcggtcggccttagagattggacaaaaggcatctgctcagaggctaaattgcaattccatatggcactcaatgtcatccaaagactcgacgtggcacaagagcacagagaactctcccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcagggttaatgcgcgaaggagaaggaatacaatccaaagattgaaaaaggacagtggttgggcggtgacgcacggtgaaaaggaattgacgatccatgatcacttcgcaagcttcatggggaggccggggccgaggccaaacgagctaaactgggagacgttggacatcacaccgattgatctagccacgctgggggaacccttcactgaggaggaggtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaac

SEQ ID NO: 49121 - DNA, 1501 bp, Oryza sativa
ttccttcattgacatggtaatttcttcatggtgatacactgatacgacaaaataaacatgtgaaacccgtttgcttgttcatggccacatttgcgggttaccttagttttggtgttcaaattgaaaacccatcatactcggaagagtcaaaatacgtcaatcataaaagggtaaatctatctatctattatattattaaaacagccttgaaaggaggctccacgttcattgtgggggctagaaattccaacattaattagagaaaaagaaaataagagtccaagtagaaatacaactcaaaaattgctgaaattcagaattaaaaataagaaatattgaaagaagtctccatataagaaatcaatacgagattaatcaaaattcgaaataaaaataaaataaaatccgaaattagaaaataaaaggagagtccaagtaggaatataatttaaaaataactgaaactcgtaattaaaaataaggaatattgagataagggtccatataagaacccaatacgagattagttaatatacagaataaaaatataaataaaatccgaaattagcaaaaagaaaagaagagttcaagtaggaatacaatttaaaaacaactgaaattcggaattaaaaataagcaatattgaaagaaaaatccatataagaacccaatacgagattaattaaaattcaaaataaaataataaaataatatccaaaatgaaaaaaattaaaagagttaagtagtaatacaattttgaaaaaactgaaattcaaaaaataaaaattaaaaatattaaaagaacactatacggtattaattacaatgaaaaaaaataaattcataaattataaaaataaaaaaattcaattaggaatacaatttataaataataaaaaatgatgataaaaataaatactattaaaaaaagaccatctaaaacacatgacgagataaattaagtaaaaggcctataaaaaagtagagtgctggcggttgatacgacatataaaagctgttagtaaaacatcaaatagaattctaatgatgattaaaaggagggatgacaagcaggcagtgaagcaaacgagtaaggcggttgccgggacttctagaaagtaagaaaaacaaaccccattgataatcatattcgatttttaaaatctcaatgacaataaaaaggagaagcagcgtgcggggtgtataggagtacagttgcagagccgccgacggttggcaggacttctagaaaataaaaaaatgaattccaacgatagttatgttcgatttttagaatcccaatgataataaagaataggcagcggataggccgtagaggagtatagtagcatcgtttgacgggacttctaaaaaatataaaaaaaagaaacccaacgagacaataaactctaaaaactacaagatccaatttttaaaggttcagaacttctaaaaagtaaaaaaaaattaatgataatcatgtttgattttaaaatctcaa

SEQ ID NO: 49122 - DNA, 1501 bp, Oryza sativa
ccgcgtaaggaatttttttcgataaatatgatgggtcgactgattggttaacttacctgtccttggatgagtggtctgctgatacagtgcggttcaataacataataaataagttataggtttatgaaatacaacccatgtatcaaaataaaaggttattagcattggcacccatataggcctcaacatctaaatatataagtactatttttgtatttaaatatataaaattgttgactttagtctatcttttattgtttgaaggggagactttactttgtctttgatgcgcaagtttaagcactatttttctattagaatatagtgatagtatccaacaaaattataatattgcaaacgtacttaaaacgaaaaatctataaaacctactcatattatttttatgttttcaaactaaagagagctattgatgaggggaatttcagaagtttaaccaaataagttaacataatcatatatttaatatggagggagtatgccactatatgtatacaacatcatatattgtgtcttcagtaacctataccaacagattaatgacatgtcaacagctgcatgctctagctataattaatcgatgtaatgaccacgcatgcaaaatattgctcctgtaaattaaaagggtgtaaacgagttataaaattagccggtagagaaggagccatcacatcaatgaccccaaacaatgatcaccagcctggatctcctagttattagaaacgcaccagcacaccgccatcaactaactccacctccgaacttaatactcgctccgtatattttaatgtatgacgctgttgacatttttaataaacgtttgacatttctgcttatttaaaaaatttatgaaattatcatttatttatttgtgacttgatttatcatcaaatgttctttaaacatgacataagtatttttgtatttgcataaaaaattaaataaaataaatggttagacgttggttaaaaagtcaacgacgtcataaattaaaatacggacggactacgtttttgattcaccgggtaggtaaacattattgcatttctgccatgcatggaagttcaggacggtgtgtttcgtgagccgggtgtttcctctgcccaaagtagagggccctgcaatgcaaagcaagagtcaacgcggcgcactgctcgctggggatgcggcttcctgtcccgatacctgttcccttccctgttcctggcgacgtgtcaccttcttattcgctgggttttttctggtgggtcagtacgcatgcgctcctctttcacttaaacggcgtcatcgtcccatgttatactatcacaattaaattggaaacaacgcaatttaagcgctaacaaaaatatgacgccaagcaaataaaattagtggcgggaaaaaggattagagcggtacataagtacaaatacacagttgttttattttcatctacacagattgcgtctccacactaacaagaactctcccaaatcttggc

SEQ ID NO: 49123 - DNA, 585 bp, Oryza sativa
tcgaacaatgggcgttcgacaggccgatttaaagcccggtccactcaggccaggagttcgatttgtgaccacatcgccagccaccgccgagagtcgccacatcgtcgccgtgagcgccggagggagcgaggggaggggatagcaggcctgagaggaggccgaggaggcgccgtccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacagttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcagga

SEQ ID NO: 49124 - DNA, 1501 bp, Oryza sativa
gtagcatcgctgaaatgcatatgcgagctagagcttctgcacttgctgagatagctagaaatgacaagttccttggacacacgccttttgaccgtacgcatgcaataatgcgtaagctaactacaagtagtaaatctttcttatgatgctctctcgtctttctctggtgaaaagcacaaagaacgtgtctggcactgaagatgtatgcatgattgtgcgaaaccagaagagcaacaccaatacactatactcctatatactactagctgacagtggtatttaaaagcacggcgcatatatatacaccaaaagagcgttttaacgttgataccttcaactactgattgtaaatttgtaacactatagtggtaagatctaaagttaatagtaggtgatatttattggtatttaaaatatttcattctaaatttagcaagcgtaccagtgttacttaatgttgaccatttgtttattgtgatgacatgttaaagagagtttctagatttaataagacgctagcttgaagtttttgaaaatttaagtcaccttttctaaccattgaatcaatggtaattctacggctctcgccatccccctacttattgattaccactctccaatgcttctacaatgaaatatctcacatacaaaaaatctacaaaattacatgaaataagtttgtagctcataaaaattataaacttgcatgcaaaaaaatcgagcttagataaaaataaaattaaaaccacatatataacaacaaaaatgaagtaacaatgaactaaaattgcatgttacattttaggctttgcaatgtgcaattctaggtgagtgaaaatttataattccacgcttgaatccgagcaaaattcccatgaaaaaaaaatgatgtgtaccactttaccatcacacatttcaattataattataccttatataagtgctattattaatgttatcaaaatgtaatatacatataaagtactccctctgtcctaaattatagggcacccttatttaactaataatcatactaagatatctatgctaagtattatgcatgttatatcactagatttatattttaaactaacttagaatgggatatgacattttctagtacaataaatctaaacaagggcatgttcaaatttattgtactaagaaacgtcacattctatcatagattgtttttttatgggatagagggagtatatacatgtttgcacaactagcatattaattccccatgcgtttgcaaccgaattttaattaaaagaatatcattaacccgatatactatttttaattgctagattttttttactgacatgtgaatcctttagtcatactgttattttaccttctcacaaaaagtaaagagttgatggggatggtttacatgaaggccctctagcctcacctatttattttcctcttaacaaaataggaagttggtcggagtggtggcagaaccaccgccactactcatggaccacac

SEQ ID NO: 49125 - DNA, 1501 bp, Oryza sativa
tgaactcgtagcttcctaaagttttacttttgaaaaatggcgcgaagcatctgccgtcacgccttatcctttccaactgattatcaatttaactaataactactagtaaactactatcgcatatttgactaatccaataaataatcaaatcggattggcggcttgtccccgttggttgcttggtgaggagaacgaggcgcatgggagaagagaacaaaaacgttgacttgaaaatgcgagtctcgcgagtcgcgagtaagaaagcgaaatttacacgagctagatgcatgggtccacgtcatcgatccggacatgtattttccacctgtgccgtgtctcgccgccaaagctgaacgaacgatatatgaaaaatatgcatcgtgttctacttccgatcgcactttccaggtcagtcatgatcaaggacagcatctcctgggtgggaactaatctctgtagcatataaaacggaacaactcattagcacataattagttgagggcctgtttagatccttcaaaatggtaaaagttttaccattttgaaacactttttgccattttggataacactagtagcaaaagttggtaatttggtatttaccatttgctagcccagggtagcaaattgtgccaaaaagtgctccaagaccacgcgcgcatgctctctatctccaccaaaaagtgctaaaaagaaaaactttaggatgcatctaaacaccaactccataccaaatcttttaccaccaaaacttttgctatttgccattacaaatagatctaaacaggccagtattagctattcttttgaaaaataaattaatataatttttaaaataactttcgtatattttttttttgaaaaaaatgtatcttttattagtttgggaagtatacgcaaaaaaaaaaaagagttgagctggaaaagccaacgaaagaatacaaccttaataagactccactctactttaaaagataatttttacatacgatccttcaaatttctacggggagctttaaaaaaaggaaaaagtacgaattacacctctaaactattgtggtcgtccgaattacccccataaccacaaaaacggacattcttcaccccccaactatataaaccggacgaattacccccctcgatccaatccgcggtggttttggtctacgtggcgtacgcgttacagtccaatcagtattctatttataaaaaaatatgggacccacctgtcttcctctctctctcacacactttctctctcttctctctctcactctctctcacttttcctctctctcacacaggtcggcggcggcgggtgactagcctcgtcctggagcgctactgcgtgctgccgcacgcgccgcaagcgcggatgtggggtcggtggagcagagcagggagacgagccgagggaactcgccgcgcgcgtctgcgtcggcttcgacctgaacatgcctttaatattactccagctctgtttcacctgcttgcttggaag

SEQ ID NO: 49126 - DNA, 1215 bp, Oryza sativa
ctgtttttaaatgctagttttatgcaaaagaccctctagcccccttgggttatatcttgcatcatacctcctcttccgggatgacttgctgagtacagtgggtagtactcagtcttgctctcttttcccccacaccagagctgaagatcttcctagtgggagctgttttgtcaaagttggtttcgtcgctgccgtcaaggtttgcctgtggagtggagtcgcccgctgctgaagtcaagcttcccggtttagctcgcttttatcttttccgcggcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggatttttttttaaaaaaaaaaatgagctcagcctagggctttagaaaaattttagttggagtttattcgatagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttattgatttgagtcttcttttgctttgtttaatttggatttgagcatgaattggttcctatcccttgtctactttagatgtcagtcctatccctcgtttgcaagcgccgcctcgagcttcagagtcgccgcccttagctttatcgccttcttagtctgtttgcttgctagttttcgtgtttaggtttgatgcttgtgggctagtcggcggtcgatatcatgtgtcagtggtatgactgcctcaattaggagttgcgtgcctctttttcagtgttttaatcaagattaagataattgcacttaaattcataagaaagattagtttctgagccccctgtttttcttccttttctcatatttctacctatccccttcaga

SEQ ID NO: 49127 - DNA, 440 bp, Oryza sativa
aatgtatgaaaaaggtgaccttaaggcaatgattgcacttgtaaagtgagccatatacattgtggaaagtagcattagcttaggatgcagcttatgcttaagttctcccataagcaaaaagaaaatattttctctctcattcacttcatgaacaagagatgaaccaattatttttccattctatgtgggccatcttgtggctaaattctaaccatagcattatgggtatggctataacaatggctcactattcataaggcccaccttaaggttacactacaccacaaacattgaggatgcccttgtagatagtggtggacctagaaaactttccaagcacaggaaaactcaaatatacctaatatttgctataatatttttaactttaattctttcaaataaaataaaattttaacagtgtatttgacagtgagcccgga

SEQ ID NO: 49128 - DNA, 325 bp, Oryza sativa
  unsure (1)..(325): unsure at all n locations
tcaccatcaataaaaatcaatgcgtaaactagtcctttacattttggaactaggctctattgctaaatcctttcaatctaaactactgaataatcacacaaataagtatcttctattttactttgaaaaaagatgagaaatcataaactaaatttgtaatcatgtttcttgctaatgtttttttagaagtaacattgtaagtacagccatacaacaacaggaatgagaggagggggtgtggggatggttcggatagggggtngctgngcctctgccctcctcctccatcgctgctcgccgcggccaggcttgggagcagcggata

SEQ ID NO: 49129 - DNA, 1135 bp, Oryza sativa
gtacgcagttgtcacttcgacaacaatacccttggaatactctcgagtgaaatgctacaatggtatatccgtgcgcttgcggataaactctgtaaccataatataccaagagtatttctgcactattgctaggaattatatttctagtaatgtcgttaacaaataccgacaagcatttctggcgccgttgccggggaagatacataatagagattacctgaactaatattttgtatttaccctctgtataatcattttcctttacaggctaaccttggttgttttcacttttgttgtgaaaatagggtggtgcatgactggttacaactttccggaaaacttcaaagaaaatccagaagctttcttccggagcatcaggccgcgagtcgttgctcctataaacattagcttattaatgggatgaatcacactacatcattacttctggttatattcaatggtagctcatgatggttaattgtcacgcccggaatttctatccaaaactccaaacgcttacatgtgtgcaaaccctcgtccaggaatcagccgaggcacacaataacaaattgataatagagtgcaagtatttatctaattattaagcgaatataaagtcattacagaggtagatagttcctctcaaacaataaagatctaagcagcggaaaaagataaacagcgcaggcgactccatcccacaagcagcttcaccagggctacgcctaatcctccacaccttcagcatcactatagaacaccttcagcatcatttattatggtcagaggtgtgagactaatcacgtaagacattgttagacctgcccataaccgtgggcatggctattcgaatagttttactctggccagaatagagattgtgacaataccctctgcataacacaattaaaagcagtgcacccttcctggataataatcaccccattataaacaaggcatggactccccagcgacccccgtcagcttatctccgccacttcatagtctggtgctccacaatgaactacactatacaaaaggtaaacccgttgcccacgctggctcgggttcacggtggaccgggtgcacggaaacggtctatggaacgaacggccgagatctaatctaatcaaaa

SEQ ID NO: 49130 - DNA, 1501 bp, Oryza sativa
gtttgtcacaccctaaaaatcctaaatttataaattgttgtttaaatggaattattagaaatgattttaaaagccttgaagaaaagatctaattttaaataataaattccaatataaaagtgggctaaataaaagtttattaagtacttctcttgattctatagttcctagatttttctgggatttatttgagccaagaaagtatttttaataaatggaattgcatttcatgaataatttaaaaggaaaaaggtatgaaaatcctcttttggctttgggccgaaagtcggcccaagtctctttcttctgcttcggcctgctcgcgctcggcccaagtcggcccgccaagttaagccaccctctctccctcctctctctcgctgacaggtggggcccacctgtcagggtcgtcttcctcctcccgccgcagccgcgccctagccgtgcgcaagccgccgccatcccttccaaattccgtcacccctttcccaatccgatcaaattgatagaggggaaatgatcccttcgatctcctctatcttttctcctatagaaacttcatctaatttcgtttggaaatcgtcggattcgagctcgattcggatttgtttttttctcctctaaccctaaaatttccatcgtcgccgccggctgccgtgggcctagccactgccccctagcccctataaaaggaccccaagacctcctctgtccgccgccaccttcgccttagcccgctgtcccttgtagcgccgcctccgcgtcagcccgtgcgccgccgtcgccaccgccagtccagtcgtgcgccgccgctgttccagtcgccgccgtcgctcgggaaggccgccgccgctgttccagtcaccgccggagctttgccgttgtcgtcgacccgaacgtctcccctgcttcgacctcgccgccatcgccgttggttgccgtccgtcgtcgtccgagcctttggtgagttcgccgcattgccctctacccgtaggtgtggtccgtttgtgccgccgcgccgacgttcgcccgcgagcacgaggtgccgagccgccgctggtgatgtcatcgtcgatgtcagcgccacgtcagccgtagaccgcggtagatcggttagatctcggccatccattttgattagattagatctcggccgttcgttccatagaccgtttccgtgcacccggtccaccgtgaacccgagccagcgtgggcaacgggtttaccttttgtatagtgtagttcattgtggagcaccagactatgaagtggcggagataagctgacgggggtcgctggggagtccatgccttgtttataatggggtgattattatccaggaagggtgcactgcttttaattgtgttatgcagagggtattgtcacaatctctattctggccagagtaaaactattcgaatagccatgcccacggttatgggcaggtctaacaatgtcttacgtgattagtctcacacctctgaccataataaatgatgct

SEQ ID NO: 49131 - DNA, 1501 bp, Oryza sativa
ttcttaaataaaagtttgataaaaattgttttcaagaataaaagaaatgtctctcggaaaaaaaaacatttttctctcgagtaaaaagtaaaaataatgacaaaaataaaattatggcaaatttatgggatccatgctcattaagttttcaatccaattcctttttagcatgaatgtgaacaactaatcttgaggctatgataaaatcttttcaactttttgtggtccctccggtatttgttgtccactgaccttctgcaggaaataaaaagacaactaaggggaagtgtataataatctcaacattcataccacgctccttggactatgagaagacagatgctcagggaaccaggcagagcaaatgcaaagttgtgttgcattcttgcatccgaatcaaagcttggtaagtcctatctagtaagaattcgaaacaccctgtgtatcattgcgtcacatatgtccaccctgctaggttacccatcacctctattgctgccataaaaaatgataaaaaaatataaaatataaatataaataaaaacaaaataaaagtgaaataaaataaaagtaattttaggcacttcatgcgcctagaattacttgaataaaatttggctcaccggtattttaccccggtggaagcccattttgctttccatcattttgttgaataaagacaaggtacaaaacaagtgtgggggagtcttttcggaactcctgacgtgcaacagcatcgactcaacatgacaatatgttgaacacccgcccacggccgcgcacaaaacttagcagtcagaaccaagtcttggttgggttggtcgaaccaagtgttcatttgacccatgcctggctcagttctgtcatcgttcgccgtgtggtcaggtttgcgcgtctccttccttatcctcccttgtttgtgagttaaactttggcagaaaatttgaatacaatttagtttaagtccaaatgaaaattgaaagcattaactctcaacaaataaaaagaaactgaatacaattttcctatgattaatcatgtatactttttattctttgccaacacttgtcacttgtgaacaaacatccattatagggaaccttgctaatataagtaattgatatatgtgatatggttatgacaaaagaaattcttgtccaactgtcatgatacttgggattttgtctttgcgaaaattaaaaaattcttttagagcaatactcctcactgactatattattacctacaaaggccatatatgattctcattgcaaaatcctgatatatgtttaggctgcttgcattacattgagctttgtcaaattattgtgacccgtgtgagatgcttttcatactttcatgatcaagatcacgtacactccatatacacacactatgctaaacttctacactggaaggtagcatccctcatccatcatttattttacccattatccacaaaataaatactccatgtcatttatgcctttttctccaaaat

SEQ ID NO: 49132 - DNA, 1501 bp, Oryza sativa
agatggaagcactaatctcgagaacacaagccgccataacaagttttacctcttgttgaacatcaaaaccgatgcagctcaacccgaaagcaataactcgttgaaataaaacgaaagcaaaaagagtggcgatgcgccgaaattgtattgaacgtgtgtgttcatcattacatagggctcggggtcttttatacccgagaaatacaagatatgtccatattggacacgactcttatctctaacaaactctaagataccacaagtctttgcggcagacttttgcccacatttatctctaaggaatttacataaaatatcctaattaatagatacaattgccttcccaggactctatctatgcgtggcaatcatcttgaaacacatcaactcgaacccaatgtcgcacatgggtcgtattatcggaatcggctgtatcacttaaccagactgactcagacttagccaatcccagtcgtagccgatccggactccagccgattcttactctgtttccgaaaaaaaccttatcttcgagtccgcttcgatttcatcttcatctccgatgttgatattaccaaatttggttgttaacaataggctcatttgcaaaagcagcatttagcaaacatttaagagaagtaaaatagtagagcaattaatcatcaattttaatcaacactgaacatcacacccatgctgcacaggcccaaccaaacctaaacaaccatacccggctgtacagatctatctccaaaccaggaatataccattccaaaccaggagctaatcaaattttaccagttatagcatcatctattatggtgagaagtgtgagactatcatgaaagacattgttagacccgcccataaccgtgggcacggctattcgaatagttttactctggccagaggtgtaccactgtacccacaagacacgattccacacatgttaccatgccctgaagtaccaccacgtcactgcaaagggggaaatcgtgacagtacccttcgcacaacacaactcaaagcattgcaccgttcctggatcataatcacccccttataaacaaggcatggactccccagcgacccccgtgggcttatctccgccacttctcagtctggtgctccgcaatgaaccatgctatacaaaagataaagccgttgcccatgctggcttgtggttggcacggttaatgtttcacaactgaaacttgtgaaccggtccttaattgtcatgtgcatgaccatcaaaaccatgtgctcacaacccaccattatcaagttttagttagcatattaattaattaaccaatcacgattgaccatcgtgagctaatcattaaatatccatcattaagtaatagtaaaacattagttatcccaatcgtgtactaatgtttctaagaatggctaagcaattatgtctaacatctagctgaaccaatatataaagctcaactagtcaaattataataacccaaggtaatcaagaaatagg

SEQ ID NO: 49133 - DNA, 169 bp, Oryza sativa
cattattggagtaaatgatttacttcgataaaaacaacttttcggttttcggtatatattctatttttcccgtacccaaccaaccactctcgcctcacttccttttttttctcttttttttggatctaaatcgatccaccatcccaccccacagatcggcgacacacca

SEQ ID NO: 49134 - DNA, 1501 bp, Oryza sativa
ctggccgatattgttgatatgcctcatcatgctgacaccgatgtgcttgccccccgagccgatgctgatgttgttcttcaatctaccccccgagctgacttttttgaataattaactcatcaactgttaccttgatcaaactttgtaatgtatccgccaaaactccagattgattaaacaatgcgcgatgaattgcttcatcaactgtatcttgaagtgtttcaaccatcggcttgcgagattgctacttcttggtattgacttcctcttcagacatgttgggtgcaaaacttgtgtcccaccgggcgtgccaaaaattgactcgaaaaacacacactggcttgggagatctgcttagctccagtgtaggtccaaaggttgacgatatgtgggtgtgcccgtcagtttgatcctgcaactgacaaaatatgcaaatagtatatcaatgagccgatcggctgacaagccgatggagcagttccagccgatagccgatattagtcgatgccgatagggttttgagctatcgacaatatgtccaatgaagataatgatataaaggcagtcggctgatgatgacgcaatataacaacaatataatcctttacaaaccaatcggctaacaatatgatatgatagaacaagtactgttccgatggttaaaccatacatcgactggaggtccgatgtcataaaatccacaaggttagataaatcaataaacctttgttgtcatccgctaaatccaacttatatgtatatgcaatccttataagccgatgccacgtccagataacttatcggctagcacaccaataaaacattagcatgaacctatcgacttagtaagatttatattatcaacaacaatctagtaggtcgaaactaaccgatgcagcacgagattgtatatgataatctcatactcgataagccgatagatctgtctaatgtgattgtagagtattgtgattgtagagatatatcggctaagacaaaagatcagacctaaccgagacagtcccaactaaaccgatgtgtctctaaacagaatgcaattagggatagaattgagatatcaggtaggcaaatatatcaaccaaaccagagcgatccaagagatcgaagcgatgcagtcttgaacaacaccaatgtagtcggtagattcaccagggccagcggaacgtaggacttaccccttcgccagagatggaaagccgatgcagccccgcgtcaggtgccaagttccgccggatggaagtaaaaacctcagtaaagaaggtggcgatacgcggagagtagttgtattgatcgagagattgatagattataatgaccccgggtgtacatatttatacacatgggtagatactagtctttgtaggacaagaaagaaactttcctaaagataacaggaaaacacgaagtccttatcggacactaaacacactttcctaaagacaaaaggaaactaacaaactattcctccttgagctcggac

SEQ ID NO: 49135 - DNA, 215 bp, Oryza sativa
aaatgtcaaggcgatcacgatgaggggaggtaagtctactcgtgatccgccgtatcctaaccctgcaggaactagtgggatatcaaaagaagcgccatctaatgactcggctgacaaggaagttcaaccagaaaagtcagtgccgcaggagtattgtgacacacggttgctgcgttccctcacggagtaggaaaccgtcggtggacgagcaattc

SEQ ID NO: 49136 - DNA, 1501 bp, Oryza sativa
agatttgtgcagccttgaggtgaggtttttggcgatttcgagctgggcttttgtggaggccatgggatcggaaccagaagaatctggtaccaagatgtcacgggctagagagttggaatgaggattgcgatgcagttgatatttgaacaaagtggatgggcgtggccctggacctcgtcggcgcaacgtaatttgcgacatatgttggaattggacatacaactcctcgtcattcaaaattcccaaaatgttttagattgcgctcggggtgcatggttttcatagtagcacctcggccatcataaggatcggtcttcgggcttctgtttcaaagcactaccgtacttccacatgtctaatgggtaaggcttagtttggggctcaacctggacatgaacaaaaggacacggatacagatgtcgtggtagtcgagatatcgtggcacaggacgggcatccgggtggtcactcctgagggatgtcctgatgccatggggctcaactataacctacctgtccggggagccctgtccgtaggcgggtgttcagtcggtactcttgttcatggctaggatgagttaggaactatgtcacctcctccgtccgtataccatggtggtatggtgcatgcggcgacacgtgaggaagacgtgtcttatgggtaaagatgtacacctctgatcagagtataatctaatcggatagctgcaccctcaattatggataagccgagcaatgtacccaagttagtggtttaattcttaaaacttgctaagcaactaaaatttggaatggatggcttgggttggcttgggacgagccgaggcccagcttaaggctacctgtccggtccaactcatcgtgggccttaggccaagataggtttgtgtgggttcactgccttgtttaataatactgtgaagacttaggttcgagtttacaaagtagttttgagcaactattagtggttattaaatgccaattctatatcgccaacatatgcataaagtccagataataaaacatccaacatagtgataggtgttaagtctcacatattccacaagtgttggtgtatatttgtatgtatatgataaaccccgaaggtgggaggaaaagcaactaaaagtgaaggaggatgcatatccatacaaggaggagctttgaacttcatcaaaacattgaagaattagcccaaaattccgagaatcggataaggcaagcccagaaagagaaatgggccgaaggacaggccaagggagcccagccagggttcggccttcccctggtttcggccgaaccacaattacagtcgtccaagctggggtttggcgtggacgtcccggatgcatccctgatgacggttggagggcactttggacatttcctattcgctaaccgtcattaactgtcctatttaaggacctccctcacttcacacacacttccaagcttgagctgaattataagaggctctattgtactatattttatactagaat

SEQ ID NO: 49137 - DNA, 1501 bp, Oryza sativa
catcggtgtcagcatgatgaggcatatcaacaatatcggccagaaggaattcaaagatatcattatagggaagatttggccaatagaattgcaaaggtaatagaggagcagtttggaatcaatcctaaggaacatacttctgtgtatcggctgccatatgccgagtggtttgatagggttccattgccacaccgatagttccaaattactccaaattttcagggcaagatgatatatctacaggaacaaatcagccaattcttagtgcaatgtggggaagcaacggctgaggaagctctgagagttagattttttccactgtgtttgactggatcagccttcacatggttttcatcactaccatcgaattctattggaggatgggccaatcttgagaagcaatttcatgactatttctttgctggcatcgatgagatgaagcttttagatttgatatcagttcagcagcaagaaggagaatcggctatggaatatattcaaagatttcggaatatctgcagccgatgttatagtttgagcctgagcgatgagcagctagcagatctcgcatttcaaggattgtcagcacatatcagagagagattcttttgctacgagtttgatagcccggctcatctaatgcagacagtatcggctcatgaaagtcgactgcacgaagcaaaggaagatcagttttggagtcaccaagacaagaaatgagataagattgaagcatgagctttcatactccaaaatttggggcatgtgttaacgccaaaatttggtaagcccaaagtcatcatcggcctaaagttagtatcggcttcagagtcttagaatcggccgatgggagtcatcaaatcggcagcagttgtgttcttgatggagtcggatcaattgaaggaaatttatccagaagagtccgagttcaaggaggatgcggcatggcaagtgtatctattaattaggaatagttcgttagtttccttttatctttatgaaagtgtgtttagtgttcgataaggactttgtgttttccttttatctttaggaaattttctttattgtcctacaaggactagtatctacccatgggtataaatatgtacacccggggtcattgtaatctatcaatctctcaatcaatacaactactctcggcgcatcaccaccctctttactaaggtttttacttgtcatctgacgttacttggcacctgacgtggggttgcatcagctttccatctccggcgaaggggtaagtcctacgttccgctggccctggtgaatctgttgactacattggtgttgttcaagggtgcatcgcttcgatctcttggatcgctctggtttggttgatatatttgcctacctgatacctcaattctatccctaattgcattgtgtttagagacgcatcggtttagttgggactggctcggttaggtctgatcttctgtcttagccgatatatctctacaatcacaatgatgttctaagg

SEQ ID NO: 49138 - DNA, 1501 bp, Oryza sativa
gagatgaagcttttagatttgatatcagttcagcagcaagaaggagaatcggctatggaatatattcaaagatttcggaatatctgcagccgatgttatagtttgagcctgagcgatgagcagctagcagatctcgcatttcaaggattgtcagcacatatcagagagagattcttttgctacgagtttgatagcccggctcatctaatgcagacagtatcggctcatgaaagtcgactgcacgaagcaaaggaagatcagttttggagtcaccaagacaagaaatgagataagattgaagcatgagctttcatactccaaaatttggggcatgtgttaacgccaaaatttggtaagcccaaagtcatcatcggcctaaagttagtatcggcttcagagtcttagaatcggccgatgggagtcatcaaatcggcagcagttgtgttcttgatggagtcggatcaattgaaggaaatttatccagaagagtccgagttcaaggaggatgcggcatggcaagtgtatctattaattaggaatagttcgttagtttccttttatctttatgaaagtgtgtttagtgttcgataaggactttgtgttttccttttatctttaggaaattttctttattgtcctacaaggactagtatctacccatgggtataaatatgtacacccggggtcattgtaatctatcaatctctcaatcaatacaactactctcggcgcatcaccaccctctttactaaggtttttacttgtcatctgacgttacttggcacctgacgtggggttgcatcagctttccatctccggcgaaggggtaagtcctacgttccgctggccctggtgaatctgttgactacattggtgttgttcaagggtgcatcgcttcgatctcttggatcgctctggtttggttgatatatttgcctacctgatacctcaattctatccctaattgcattgtgtttagagacgcatcggtttagttgggactggctcggttaggtctgatcttctgtcttagccgatatatctctacaatcacaatgatgttctaaggccctctttgtttaggcttaggcttattggcctagacttttaagtcagtttattggcttatatgatttataagtcagtggatttaatgtcctaagtttagtggtggagtcatacatctatctcatataagccaaaaaagcttctccaacctagcttttggcttaatagtgttagagtggcttatggcttcaaaaaagccaaataaaaaagctgcttgtttgttttggcttagacttttcgacttataagttggcttataagcctaaacaaagagggcctaaatagatttgctatatccatcatattagatagatctatcggcttaccgagtattagattatcatatacaatctcgtgctgcattggtaggttcgacctactagattgttgttgataatataaatcttgctaagtcgataggttcatgctaatg

SEQ ID NO: 49139 - DNA, 391 bp, Oryza sativa
agctaagtagatagaaaagaggaagaaaatctattcctatacttctaatatacatagtatacatacattctagttaccgatatactagctaataccctctatccgatgtcctcctggtacttcgagaagccacccctgactgccgagttccttacgacagcccgtcatgaccatacaaccggggctaaatatggaggaataccctccctaggaaattaacttaggattatataccggcgtggaggaatacccgtactgagctgtcaccatcagcggcccacctctcatccgcaatatataactccaaataatgatatcccgtaatctagacaccacgcctaaactaccagatactactctaatatcatcgtcatgacatagtgtcgaaaca

SEQ ID NO: 49140 - DNA, 1501 bp, Oryza sativa
gctctagtttcttggccagtatgggtggttctaccggcatcttccaataacggttcttaggcatagttgtttccttctccatgaaattctgcataaatttcaccaggctgtccattttgggtggctccacttcgacctcttggatattctgtgggttcggcccatactttattctgaccatggagtattgttccgtcctcggttgaaactcaaacttctcttccttgccgttgacgtggaacgggcgccccaggatgagcggcgtctcttttcccgtgtccatgtccagcaccacgaagtcaaccgggataaagaaatcccgtgtcttgactgacacatcctccgctatccctgccgggtaacggactgacgaatcagccagttgaaggcgcatcggtgttggtgccaacactgtgaagttgagtctatcgaagacgtctttcggcatgatgctgacactggctcccaggtcgtataaggcctggtcgaattgttgtgccccgatctagcaagtgatcgtaggacacccctgatttttcttcttctccgggagcttgtggagtatcacgttgctgcattgcttgaccacctctgttgttgggagcggtctcttgttgttgactatgtccttgagataacgggtgtatgttggtacttgcatagcatccaacaacgacacgttgatatggatcttctggattacttcaacaaaacgagcgaattgctcgtccactgacggtttcctacaccgttggggaaacggcagcaaccgtgtgtcgcagtattcctgcggcacggtcttctctggctgaacctctttgtcagccgagtcactagatggcgcttgttttgatatcccgttagttcctacagggttaggatatagcggatcacgagtggacttacatcctctcgtcgtgatcgccttgactttacctcctcacgagtcgggtcgccccagaatcctcccagtttcatttgcagggtttaaggatgccaactgagctagctgggtttctatcattttattgaagctcagctggttttgaaaagcagaagcgaagccatctaacttgacattaatgttttctaggatcttatcattggccgcaagctttttgcttaatgcatcggtggttttagcttgcgcaaaaacgagatccttcaaggagggctgttagaaaaattaccgttgttgttacctccttgataatataggcgtggttggttccacccctaacctccttgtgaacgatacccattgttgttgcccatgtacatcgcctcctcacgggtttccgggtagtcattcccagaatgacctgtgttgccgcagacctcacatgtgacgtgagagtccaaggccttgacggtgccttgtggccgtttctcgtggtcgtccaagcatttcatgaggaggtccagcttggcagcaagtaactccgactccttgacggtgtgcatgcctcgctgacgcatctgaagtcgttcctcgttccaa

SEQ ID NO: 49141 - DNA, 158 bp, Oryza sativa
tacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatga

SEQ ID NO: 49142 - DNA, 1501 bp, Oryza sativa
aaattgatattagagtgacaattattcatgcagttatcttccatttttattgcaaatacttgggagggctcaataactcttggtctttgttgaatgcagattgaattatattatatactaatggaattccgccggcggtgtgaggcccactcagagtaggatttggagggtgcagaactgtttttgcattgccaatgaaaggaggaagaccgcctcaaagagccttgtccccatccaccaacatggtcatgataatcgttgacatcgaccaagatctctccagggtaagtagaacagcactaaaattaggattagcatttctagacaccatgttatttcagaaattgattagttggaatcttgtattcattttgctagcctgagtgcctaacttagtggaaatatattggaaaagtttctccatggcagattgaggctgttatttcctgtagatttaggtttcgctgtaaatactgaacaattattgcaattttctatttgtattgagtacttgggtggttctttctatcaaccaaatcaatttttattcatcagtgtagactctttgaactgcaattgttgtgctgctgatatgtgttatgtaggctgcagcagaaggtcaattttcccttttgtgaggtgccataattttgaaaatatgttaattttgtcaattgcttgatattaagtggagtatctcctttgtatgcaccaaccaattttggagctccagacaatgaaacgatagcttcataatatccatgaaaaagtgctattggatgaatccagtaaagatgtgttttctctggcattttgaatattgaagtgtgctgatgactttgtaattactaataatgatgcaatgcataaattctatggccggttctgttacttctttttatttggacgtaatttgcttgaaagatttttgatgtggctaaaggagaaatttttttaaggcatttggtttctcaggagtttaggagttggaaccatgcaaacatgcctcatgctaatgtcttcctgagctttcagaaatcgaagttatttctagcttaagatgatgttggagctgatcctggtgctgttagagaggccaatctattcaggtccagcagtttacatcaagatgatgttctttctagcgatgcatgtagtgaccattgatgtttcgattgcttgaggcgaccctctttgtaattgtgaaaaatgtggtgttatgaaacaaaaatatagatttacatccaggagataaaattattttattctgtattttagagtaacacggtatagctactggtgctatccatctctggacctgattttttttctgcatgatttaaaatttgttatttaaactgaacttttttttcttgactttaaaatttatctcattttatactttcaagatatataaaatattttgatttttttaattttgcattatcaaatattgtcgtagcgttagcacgtgcatattactagtcttgtcagttgcagg

SEQ ID NO: 49143 - DNA, 1501 bp, Oryza sativa
tgtattcattttgctagcctgagtgcctaacttagtggaaatatattggaaaagtttctccatggcagattgaggctgttatttcctgtagatttaggtttcgctgtaaatactgaacaattattgcaattttctatttgtattgagtacttgggtggttctttctatcaaccaaatcaatttttattcatcagtgtagactctttgaactgcaattgttgtgctgctgatatgtgttatgtaggctgcagcagaaggtcaattttcccttttgtgaggtgccataattttgaaaatatgttaattttgtcaattgcttgatattaagtggagtatctcctttgtatgcaccaaccaattttggagctccagacaatgaaacgatagcttcataatatccatgaaaaagtgctattggatgaatccagtaaagatgtgttttctctggcattttgaatattgaagtgtgctgatgactttgtaattactaataatgatgcaatgcataaattctatggccggttctgttacttctttttatttggacgtaatttgcttgaaagatttttgatgtggctaaaggagaaatttttttaaggcatttggtttctcaggagtttaggagttggaaccatgcaaacatgcctcatgctaatgtcttcctgagctttcagaaatcgaagttatttctagcttaagatgatgttggagctgatcctggtgctgttagagaggccaatctattcaggtccagcagtttacatcaagatgatgttctttctagcgatgcatgtagtgaccattgatgtttcgattgcttgaggcgaccctctttgtaattgtgaaaaatgtggtgttatgaaacaaaaatatagatttacatccaggagataaaattattttattctgtattttagagtaacacggtatagctactggtgctatccatctctggacctgattttttttctgcatgatttaaaatttgttatttaaactgaacttttttttcttgactttaaaatttatctcattttatactttcaagatatataaaatattttgatttttttaattttgcattatcaaatattgtcgtagcgttagcacgtgcatattactagtcttgtcagttgcaggatcaaactgagtggcacgtacgtatatcgtcaacctttggacctgcactagatctaagcagatctcccaggccagtgtgtgttttccgtgtctaaaacgttcccttggattcgatacccttagaatacttcgtaaaggaagtgctacatcggtatatccgtgcgcttgcggattttatctgtgaccgtaagaattaccaacaagaatttctggcaccattgccggggaattgttgcttatcattttcgaacccagttcatcctcgtatctcttttcattttttttattctacctttacccttgctatccagagaagtattccttttaaattcttctcgaccatggagcaatctcttttcga

SEQ ID NO: 49144 - DNA, 308 bp, Oryza sativa
atttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcag

SEQ ID NO: 49145 - DNA, 1501 bp, Oryza sativa
atgccctccccaaattggcaccctgcagcacgcctacagcccaaaccctagaagtggcagtattctcgctgctgacactaaccctaattccatatgtgatgttgtcgcgtaccctgctagatccttgcttcaagttgcagctgctagaactgccttgggcaaacaagtcctgaacgcccctcttgtctcatcgaagtcgccgtcggctggtagagaacatggtaagagggagacgttgtttcttggtgctgttcgattggcacaggatcatgacacggtgagttctaatcttgacctgcgtgttgggaaaaatgaattgaagataactactgttttggggtgccgatcaagaagggactttatgtacgataacgaccgcgcggatgatgaaaagactgttgaagcaagtcacaagaaaagaagaatcgatttggaggtaaaccccctgattctaacttcttcaaccagtaatcatcaacagcaagatggtggtgatgaccaacatcatgaaaagatactaaaactttatcgtagctcctcggttgaagaactagatcttgagcttagactcggggaagccccaaaagaacagtagatttcatatccactgttgtatctcaacttgattacaaatgtttaatttgtatttattcaccactcgtgtttcattgaaatgttggtttgcactatctgaatttatccttgttttatcctatatgttaattctgcttatttccttggaatgatttgaagaaatcatttttctcttgaaagggaactgtaatgaaaaaaagaactaaagtgacttgttatatgctgtgtaagaaggtactgaattccaatttaaaaccttgcattgatgcacgaaaattatcacataatgtagttccaaactttctctggttaaccttatatattacactaattgaatgaactgaattgccagttattcaaaacatcttgcggctgatctcaaacaatgtcaaattagattacgctaaacaaatatagttgtattcttgttttatatcctatgctaattctcttaccccccatagatgatctgtggaaatagtgtatatttcttcaaagataccacatgaaaaaaaatcaaaaatttgtcatactctgtcacaatgtgttgaattgtagttataaaattttatgtagtagaccggttaaataaatatttattatcattgacagaaatatctttcaactgatatcagctgatagcataaactttagattgcatgtgttttatcgtggccaatattatctggttcttattgtgcatgttggcaaagtattctcagccattatctatttatttttattgctggtgtcagtttaaattaattagtgctctttcaccgtatcctctattcaacgtgcaagtatatgaatatcgaacaattaataatcacttcattaaaactcatatgacctcagcttctataacaacggaaatctatcaaaagatcaatattcaattacagta

SEQ ID NO: 49146 - DNA, 365 bp, Oryza sativa
aaataatcttatttctctctatgtattattaattaaagctaagtaaatagatcgaacagaaaattggccattttgatgaaaattccatctaaaaatgtcatcctcgtctgttaagttaatatgtacaatggaagcacacaaattatgccacctaattagattttgaccaactaatgctcttctaaaagtaacattaagcggaatagaacccataacattagcaattgaggcatttttccttctaactatagaaaataacgaagggtacttttccttcaaagaataattccctagccacttatcctcccagaatcttactcccagaatcttacttgttcaccattattaataatccaggaagtcat

SEQ ID NO: 49147 - DNA, 535 bp, Oryza sativa
agcatcggcttaaacttgaaaaagcccaaaggaggattgccgatcggcgtgaaagaagagatcttgaggcaaccatccaggccaacagggtttctatgaatgaagagaaggccaagctcgatgaattggaggctggtccagattcaactcaaactatcattgatcagcttaatgctcaaaaaatagaactcctggctgagttagagcagtgcaatgcacaaatcgcccttgaacagcaaaagcttgcagacttgccaaaagccattgaggatcagaagtcaaagttgaaggcatctagcaagcacttggccgatctaaccaaatctcgaaaggtgatcctaagcactgatgcagtcgatgtccaaatcatagacgaagtagatcggattaagcaaagggcaatatcagccatcaaaaaatacatgtctggatgagctaaatcttgtaattccaactttaaatttgcaaacataacttttgggatgcaatatataactttctgcttgtggtgaaaacttgctctttgatgtgacca

SEQ ID NO: 49148 - DNA, 1501 bp, Oryza sativa
tgttctgggcttattaatccagtccctattcatttatccagtactcaattactgaaaaacataaataaaataacatcgaggaattagaatgttaggagagccaatgtttgatgtattgttgattgttaataagttactatgcatcgtattaggtgctatcaatataatggatagagaagcaacaatccaattcatataaattactgtaaataacagtaccagatattatgtggagcattatttgattataaatatttcgagatcacaagaatatactattgctacattataggtaatttatcttttccactgatcaaactaaattgaccaaagtataaattctaatgtttgctgaagtattaagtaggtctacatcttacaagcctagagtccaagagagcatcaaaaagttcagatcatgctgtgttcccaatcaattttggcacaaacatgattataaattggaagatacgcattcgaattagttgaccacacataattaaatattgtactcaccaagttctacaaattatactgatgtttcccttagctgctagctgttgtaaatatcctctacgatgaccaaattacagttgcacaaatatgcaaagttacatgccagtcacctatacattataaaataattagatgcaagcaggaaaaacaaaccatctgtgcattaaatttttttccccaatatacttgggttgctataacagataattaagaattaaatactttgtctgtaagcagaacacaaatcaaacatcagctgtgcaagtgtgcagaaacagtattgcaattaggattgctactgttgccaggattcgatggctgaggaatttgggcaataccaggaagaaaatcaccgatgaatctgcggcgtgtcgatgctgctgctgtggggcaaacgatgggtgtgtggctggcggatgacgcgggggccatgcatctctggcggcgccagcggcgctcagcctggaaggcacaggcggcgatgggtggacggtgggtgctaggcggcacaggcggcgttcaccccggacggcgcaggcggcgatggcgtgggtagtaggtgcgcagccctggcgtcgccggcggcgctgagcccagacggcacaggcggcggccatggggctcatacgcgagaggccgccgtcttcacggtggagctaatggaaagattggaacagattttacaagagaaggagaggggtttgttctcttagataatatcgtaactacttccgagttccaagggagataaaaaaaatccgcatgaatgaggtaaaaagttggaaagattgatctttttggagggaacgagcaaaaaaaaattcctaccaaattgtttagcgctgattaatgtgattgtagagacggtctattatcctgtccgtaattagcgtatctacgtaagaggcaaagtgggagatgggctttaatagggacgacgtgcttagccgtctcttacggaacgtctctacaggccgtttttgca

SEQ ID NO: 49149 - DNA, 225 bp, Oryza sativa
attcctgcagccccacgttaatcaaagcctgaaatgctactgcatgattctctcttgcttctacaaggtgtttttggcttggctgcctctgaacccaacccattcgttctcaagtttctctgcatttgttttctactgtacaatgtttgatgctttgcctagctgcagatcagccttctcgagtataggctttacgaatcgattcttccgtaccacaaggagcca

SEQ ID NO: 49150 - DNA, 1312 bp, Oryza sativa
tccccgtcggaatcgagctcgggccgtcgccctctttctccgccgtcgccgccgagctccggttcgccgccgccgtcgccccggacctcctcccgcttcggcatcgcctccttcggcttcgccgcgtcctcgccgacctcgtccactcctccgtttcacccgccgatcaccggaacaccgccgtcctcgtcgacccgagccgcgccgccgccttcctccgctccggtcgccgtttccgtcgtcgccgtcgacccggggtgagccgtggaccgccgtttcacttcccccttcctcccctctgtggggcgccgctccgccgcgctggtggtcgccgccgcagaccatcggggcgcgggcgagtcgcctccagtcggctgtgccggagaggcagcttcggagcgcgccccgcggttgccatgtggggcccggcagtcagccgccgcgccctcgtgtgcggctgacgcgtgggacccacggcgccggccggcgtaagccgcgtgcacccggtccaccgtggaccgtgaggctgccgcgtgggccccactcccgtggacccggtccgcgcgcccctcccctcggctgatgcaataaatccgattttaaattaaaatttaaatgaagaaattcgcaaatattcatttaaagagcatataaccttcaaatggccataacttgaccatttgaactcggaattggaccgttcaagtctctaatttctccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctctatttaaattcccgcgttatcactgttttatttagccatgcctatttacctttgttatgaccttattattattgctattgttattatttccttgttcaccctagattaaacaaaaccccaactagtggacactctactcatggtaccactagtatgattataggtagatgcttcgctttttaattaggtaacattaggtggttttacaactctagactttgggaatattcatatcacctggacaccatggaatgatttggttattgtggaattggattcacaccgccccctctattcaaaatccccaaaaatggttttaggctgggctcggggtgcatggttttgatagtagcac

SEQ ID NO: 49151 - DNA, 191 bp, Oryza sativa
attcctgcagcccgccctgatataccagtgcccctaataatttcaccaaacccaccagtaacttttttttcctacagtgaccacttgtcatgtactagaaccactttagcaattgggaagcaataatggtttgtttaaattaggacgtgattaaagtggctaatgattaatgggcttaaacataatgcaga

SEQ ID NO: 49152 - DNA, 826 bp, Oryza sativa
caccacatatatttgtatatacattagcagcagatcaagctgcctccaccactgtacgtatgtatatgtatacacactggtggagacagctcgaccattaccatttacgaactgccattaacatatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaaggaaagatggtagtaataaaaagctgggacgagtggatcgatcca

SEQ ID NO: 49153 - DNA, 1501 bp, Oryza sativa
gcagtaaccactagggaccccctgtgccgattgatactccagaggccatcttggttatggcagtgttcagagtttggtacagatagcctagcagatactttccaaggggaaattgtttcttgtctacatgttgccagtttgcagtaggaccacaacttggaccatgaaaaaagaacttctcaagccacatcatgaggaaagctgcatgctcccttgcaaagatcggcctagtacccatgttcttggcaacatagcctgaccaaccgcctatgcttctgattttgaactcttgggtggattggatattcaagatggtcaggttagccgatgaggtcacatctaggccagtaatcattataacatccaaaagagttggagtcatcggtccttgagagaaaaggaaggtattcatggctgtggaccagaagtaagtggcagctaccatcatggactcatcttttgccatgtctgctgcagttaaagccaaggcttgggatatgccgatttcttcccagttggttaactttctagctgacatcctgttataccaagcgggccagctcttttcggccgatggctaagatttgaaggtgttcttccataggcttagatccggttagcaaatctaaaggggattcagttggtttcaccattgatgaactctgtggggtctgggttaccaattgggccaaggaaaaactggaactcatcggttatactagggactgcgacttgatgagagagatgctacagaaggaggaaaatcgaagattgagcagaagaaaaaccaatcttgcacggaaaagaaagaggattagccgatgggtacttacctcgacattctcagaggttgatgcgctcagaggactggcggtggttgacattgtcggcgatgaggagtggaatcacattagttacaattccagaggcccaagacaggtgacgcagcaccttatttatgtgattgcggccaaacgacatggaatttggcaatgaggctgtaaagagggctccgagagctttccatcaagcacttacgggccgaaaacagtggtcgtatgcagattcggtggccgtttgaagtcagcaatgtagcaggtggccgaatcggattccagcacttggaggacttgatcttgatatctccttgttcatccatgatgtgagcaatggttgtatccatagcactactgcaaaaacggcctgtagagacgttccgtaagagacggctaagcacgtcgtccctattaaagcccatctcccactttgcctcttacgtagatacgctaattacggacaggataatagaccgtctctacaatcacattaatcagcgctaaacaatttggtaggaatttttttttgctcgttccctccaaaaagatcaatctttccaactttttacctcattcatgcggattttttttatctcccttggaactcggaagtagttacgatattatctaagagaacaaacccctctccttctcttgtaaaatct

SEQ ID NO: 49154 - DNA, 1501 bp, Oryza sativa
catatgtaaaatttgatcgattcgttgcttctttctttattacaaactgtcatcaatatataaaaaaattgatcgatcatcgtgaaacgctattggtggtttgggcttaagaaaacagtatgctgcacacggcacggatgaatgatgctgggaataccttcctatacgtccggacacgaatgtctagctatagctagtagctgcatatatattcctctcgagaagtagaagatataaggatgtgtttggataatggaaaatagggggtgggattgggattggaaaatgaataaagggttaggattaaatggaagagggagaatgaatggttagtatttaaagatgggtgggaaatcatttccctttcccatttgccaaacactcactaagagcaagtataatagtgagctataagcctactataagcttagatggaggagagaggtagcgaaaaattaagaatgttggctctcatgcaagagctagcttatcactagctctaagacaaatgcattaaatatataagtgagagatagagagatgagaagaaaattatagtcaatcttatagctaatctattatatatgttggctttaagatgagctaataatagaaagtgtgctctattattatcttgctctaaagggaaaaaaaaaggaaggaaagatggtagtaataaaaagctgggacgagtggatcgatccatgcatgtgttgttgcgtacctgcgatgcaggtagaagatgctcctactgccccccttttgaaggtgttagatcttcaatccatcaatcaatcccgtttcttctccatctctcatcgccacgcaccatcgatcgatcaccaaatggttagtactcagtacagtactcctcatacctttccttttccttttcttttttttttctttctttcttgttagtagtagttgctgctctagctaggttgttgttttgcagtcctcggaggcagcagcagcagaggccaggggacgcagaatctgctatagctagctgctgctgctgctgctacttccaaaagagtacccccatggagggacgccggttgcagcagtcaaaaggcttgcaggtgtcgacctcccattggctcaccgtggctgctgcaaaatgctcgccgaatattgcactgctgccgcaccagccactacgtacgcagtataacgatcaagccaatcaaggagcacttgcctgtttgatagagctcccgctccaactctatccaaccaaacagtttcagctcaaacaggctaaaataatctgaaaaaaattagaatgaggcgaggtttcggctgttccacagcttcactttagctccgagttagatctagttgttggagatctgccaaacaggcttgcaacaggtagcttagctatacacttgtctccttttttctgctggtctctgatctatgctagctccagcatctcccgtgaccgggaggaattcatcgtgacgacagagagaagagacgcgtgcagttc

SEQ ID NO: 49155 - DNA, 1501 bp, Oryza sativa
accgtgaagacggcggcctctcgcgtatgagccccatggccgccgcctgtgccgtctgggctcagcgccgccggcgacgccagggctgcgcacctactacccacgccatcgccgcctgcgccgtccggggtgaacgccgcctgtgccgcctagcacccaccgtccacccatcgccgcctgtgccttccaggctgagcgccgctggcgccgccagagatgcatggcccccgcgtcatccgccagccacacacccatcgtttgccccacagcagcagcatcgacacgccgcagattcatcggtgattttcttcctggtattgcccaaattcctcagccatcgaatcctggcaacagtagcaatcctaattgcaatactgtttctgcacacttgcacagctgatgtttgatttgtgttctgcttacagacaaagtatttaattcttaattatctgttatagcaacccaagtatattggggaaaaaaatttaatgcacagatggtttgtttttcctgcttgcatctaattattttataatgtataggtgactggcatgtaactttgcatatttgtgcaactgtaatttggtcatcgtagaggatatttacaacagctagcagctaagggaaacatcagtataatttgtagaacttggtgagtacaatatttaattatgtgtggtcaactaattcgaatgcgtatcttccaatttataatcatgtttgtgccaaaattgattgggaacacagcatgatctgaactttttgatgctctcttggactctaggcttgtaagatgtagacctacttaatacttcagcaaacattagaatttatactttggtcaatttagtttgatcagtggaaaagataaattacctataatgtagcaatagtatattcttgtgatctcgaaatatttataatcaaataatgctccacataatatctggtactgttatttacagtaatttatatgaattggattgttgcttctctatccattatattgatagcacctaatacgatgcatagtaacttattaacaatcaacaatacatcaaacattggctctcctaacattctaattcctcgatgttattttatttatgtttttcagtaattgagtactggataaatgaatagggactggattaataagcccagaacaactgctgcatataaaacaggagtatctcaattcctagaatttgcattctctaatgtacctcaatatgcaagggttatattgttacttatgcacctgtaacattctaatctgttttttaaatatagtgcaaatggcagcaaggtcccaaagactgcaaggcttggatttttcagagaatggagtacagaatcaagaaatggtcccaaatgatcactatgttgaagaacagaacataacaaatgcagaatggcgttcaaactgctatgagtatcgtaagatatattgtttattcgcttttaaaacttgtatgcttgtggactaaatctttaaaca

SEQ ID NO: 49156 - DNA, 1501 bp, Oryza sativa
cttcccaatcggttcaaagttccggacttctccaaattttcgggacaagatggtgtgttaacttatgagcacattagccgattcttagctcagtgtggtgaagaatcggctatagacgctctgaaggttaggttattccggttatctttgtctggatcggcttttacttggttttcctctttgccgtacgggtcgatcaatagctggaccgatttggagaagcaattccacagctatttctacagtggggttcatgagatgaaattatccgacttgacagcgattaagcagcggcatgatgaacctgtgcacgagtatattcagagatttagggaaatgaggaacaaatgctttagcttgagtttaactgttgcccagttagccgatctggcttttcagggtatgattgctccgattagggagaaattctcgtctgaggactttgatagcttgtcacatctgatatagaaagtaaccttgcatgagcataggtccgcggaagttaggaaaaactcaaagaaggttaatcatgtttatccgtacatgtatgggtcggatgatgatgaggacttttctaaaatagctgcagccgagtgggtgaggagtaaaaaggtcataccatgccaatgggtaaaaagttctggaaaagagaagtatgactttgatattactaaacctgacaagatctttgatttgctactccgagagaagcaaattcaacttcttgctggtcatacaatcccatcggctgaggaattaggcagaaagaggtattgcaaatgacataattctgggtcccattctactaacgattgcaaggtttttagatagcagattcaggtggccattgagggaggcaagattaggtttgatgattccaaaaagccgatgaaggtcgatggtaatccttttcctattaatgtggtgcatacagctggccaaacagccgatagggcccgtgcaatgggttttcaggtgaattcggctaagattatcaacaaatatcagaagaagtatgacaagcagcaggagaaggatcatgagaaatacgatgatggttttgatcctcattggtgttgtgagttctttagattctgctggaatgaaggtatgaggttgccatctatttaaaactgccctgggtgcagtgatagcgtcgagaactcaagccgatcatataataggggcaatcggttaaggcagacaagagtttctgttcatcaaagattgggtccagtaaatcaagatcatggccaagaagacaatgtaatcaggaagaatcaatggtgtccttttggtattttcacgaagaatcagaagagaagggttcagagattgaggaacagggagcgccttcaggaggttgaacaagaaattaatcatcggctgaagaaagcaaagccaaggcaggagtggcgtgttaagaattaggttactgtagccgattatatcgcagccgatgaggcaaagaggttggcaaaagggaagagtgttgtgacgg

SEQ ID NO: 49157 - DNA, 264 bp, Oryza sativa
tcattgaaattgaaacgatgtgacgaaaaaaagttgaaagtttgtgtgtgtagaaaagttcgatgtgacatatttgggttcaaactttgaatctaaaccaggcctaggagtatgatcttctctcttagtactctttggacactcgtttgctcggttgataaaattgaatgaaacaactaaaaataattaagtacaaatgtggttttttttgtttgttgaaacgcgcagctacagtaaaactgcttgttagtcactcgcaccagg

SEQ ID NO: 49158 - DNA, 1306 bp, Oryza sativa
cctctcatcgaaagattgggccacaaaccctagcgggttcgcatcaggtggtatcagagcgtggttcatcggtgagagaatttacccttcccttcgtcattaatttttttttcctatagtccagaaaagaccaacaaaaaaaaatagtagattagtttttccatgatcctatagaccattgtgccttttcactagtactgcttagttaaggcttgttgagttttcgattgcatcggttgtgttaatttgctggtcttagtgttaggcgattagagtttcaagttcttgccaccaccgcacatcgccaccttcatcaattttgccgtcatcaccaccgtcaccaccgtcgcagtcacccaccaaatcactttctatttgtgtttgatctgttgccgatagcttttgttagttgccttgtatcctgccgccactagaaaggaaatagaaccctgattcgagtgaccttccttaaaacagtcatatctttttcatacggactcgaaattaggcttataatatatccacggacatctaaaaaaaagttacatccgattctcttgccgggttcggcaaatttaaaatcgccaaattcctcttgcaaaattctgtttttgtggcgagaagcttcgggacctattcgcatagaactttaaaaaaaattctacaagcttcatactttgtccgtttgagataagattttctgtggttggttctagtgtgctcctggttgtgaaaaaaatatcaaaaaaaaaaagttgtgcctctctcctcagcactagagagagcaagcaaaaaaaaaaaaaaaaaaaaaggagtatccagcgagcacaccacaccattccccctttgtcaccaccttctaccaccggttcttgttttcgttgctgtttgggtttgtgttttgtggcgtcctttgtggttaggctcgcgtctctacttcgactagcctaggaccagcactgtacactatacccttgagcgattattcaatttgctttggctaatgtggtttctagttttctcttgagcattgctttcagcccaccaacagctccaccacaaacccgactacagcttgacaggtcttgttgctacagcaccgatacacctcgttccacggttgctaacttgtggtgttgctgtcccgctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggtaggtc

SEQ ID NO: 49159 - DNA, 217 bp, Oryza sativa
  unsure (1)..(217): unsure at all n locations
ggggggctgtgttttcttgttcatgaagaggaattgaggtccctcaaaggagtattaatgccatcaagaaaattcaaccttcggaagataagacgcaactacaatcgttgatcggcaagattaattttgttcgaaggtttatatctaacttgtctggaaggttagaaccttttacacctttgtaaacgtnnnnnnnnnnnnnnnnnnnnacttgggg

SEQ ID NO: 49160 - DNA, 751 bp, Oryza sativa
ggttccgattacaggcagacgggcggtttagccaacacgcgcgctgcgagccggtagcaagaagctatctctatcatcaaaacccgcctgttcttggcggcgactagaggtataaaaagaggggaagaacgaccatagggtcgtgctccaaccctaggacgcgcccctaatgggcccaacatggatacacagcccattgggccaaaagaggtgacgcagcaccatggacaaaaaatagtcgggagtaaaatgacaattgcggccgctccagaacagatatggacatgtggctggatccatttgaaagtagacttgataagctttccatgaagtacttacacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccgaggtataaagacgaggaatatgaactcaagaaagaactcacctgataatttagttgacgtgcacgagcgcgggtaataggaccatcatgctgtatatggggggacgtggatgtatcgatggtgttgatgtcctcatcacaaccccacctacggccggaacctccgggacaggtaggcaggactgagcccctagcagcaggacaccagccctgtgccatgacatctcgactactgggccgcagctcgtgtagccttcatttgccctaga

SEQ ID NO: 49161 - DNA, 729 bp, Oryza sativa
cacatatttatccctggttactattataagccgtgttgatattttatagccaatcctttttgagtttgatcaagtttataaaaaaatatagcaacattttcaaaacaaaacaaatatattatcataatatattaaatattagttttagtgaaactaatttggttttctttataaacttaatcaaacttaatgaaacttgattagaaaaaaacaaaatataatatcaaacaaagaagtactccctccgtcctataatataaggaattttgagtttttgctcgtagtgtttgaccactcgttttattaaaaaaatttatgtaaatataaaaaacgaaaagttgtgcttaaagtactttggataataatgtaaatcaaaaaaataaataatagttctaaaattttttgaataagatgagtggttaaacagtgcaagtaaaatcttaaaatcctttatattatgggacagaggggtagtatttgtgccttttctgaaagaaaatctaaaaacaagacaataaatgcgccggcaaaagccaaactaacccccgtgtttaaatcgcctcccgtacaagtctcctgcccctaccaataccaacttaacccctcttcttccatctctaatctaatcactcctcccctcttccaccctccccccacctcgtcgcctcgccgtctccacccccaaaaccctagccgccgccgcgctcctcctcctccgccgccgcccgg

SEQ ID NO: 49162 - DNA, 351 bp, Oryza sativa
tgtgtccttgtactttaaaaaaattaaatggaactaaacacggccaaagtcataaacatagggttgccctgagttgggaacctttccctccaacataaaaaaacgaaacagctcattagcatataattaattaaggattaactaaagctaacttaaaaaaaataaagtaatatgattttaaaagtagcttttctatagattttttcaaaaaaaaatacacaccttttaaccgattaaaaaactcgcacggggaaaacatgggtaaaagttgggaaagctcactgccaaaggcagcctaatttccagccttcgagtgttttgtgagtgctgaaatttcccaaaattcatcat

SEQ ID NO: 49163 - DNA, 469 bp, Oryza sativa
tttggaaaagcgagcaaggcaaggtcccatcatccttgagcatattaaatccaagtttataaaattattttgatttaaatattgcattatcgctttacttaaatccccgcgttatcactgtttatttagccatgcctattaacctttgttatgaccttattattattgttattgatattatacccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacacctccccctctattcaaaaccctcaaaatggttttaggctgggctcggggtgcatggttttgatagtagcacctcggccatataaggaccggt

SEQ ID NO: 49164 - DNA, 1501 bp, Oryza sativa; identical to SEQ ID NO: 38638

SEQ ID NO: 49165 - DNA, 640 bp, Oryza sativa
aagaaaatcatgtagatgtctcactatcaataggtataacagacatatttcatcattgtgtaaaactttgatgtttttattaattggccatttaaggttttaaaatttgacggtacgtattttgtgacaacgtttatccaagagtgaaggtgttggttattcttactttcctatatgtgattttgaatctccctatttctactcggatttcacttcttatccccttctggtactaagtttgtaagtcagtcaaagttatattctgtgattaattgaatagcacgttgcattcagaacgctgagggagtgtttggttaggagggagggggaatgtttgaagatgatggaagtttgaggggtgaggagttttaagagcgaactctcgtcttttcaatatttgggtagaggcaggtaactgagagaaaaaaataagttagtatatcatcacttaaaattcatttctcactcaaattcatcataattctcatatctcctatcaaacgacagagattaaaaatgaaacttacaggatcaatcccttcattagcttattactctaaatttccaatctccttaccatgagttaccaaatatgtattgatgaaagttataagtccactttaagggttcctttggaaca

SEQ ID NO: 49166 - DNA, 1501 bp, Oryza sativa
tttaaatagggttggaagggggagagagcggccggaggggaaggaaaccggcgcgggaggtccggccgtcatcaatggcgccggcgagatttgcgggggcaaatccgcccgtttgaacgcgagagagagagggaaaaatggggggaaagggagaggggatcacggggagtaattccccccactttattgcacgcggggacggcgggaggcggcgggattcgcggcggcggcggcgctagggcgcgggggaggcggcgggaggaaggggatgacgggtgggccccacctgtcagcgagggtggcgggcgggcgcgcccgtcagcggcgcgcgcgcggggagaggccggatgggccgcggggagaggagagagagaggggggagagatgggccgggtcggcccaagggagggaagggggactttttagggttttttctttttataaaacctttttaactttgtttatttcttaacaattattatttgtgctctgaaaattccactaaaatttatttacgtattttaggcttttaggaaatatacaaaaatcctctaagcattatttgacttttaactttgcacattttaattgttggaggctttcacacggattttaattattctaggcataatttagaggatatattttagggtcgttttgggacgtgacacgagggcctcgggggaggcagcgcgagagcccgaggggcgtgacgtggcaccccgaggccccctggctacttctgcgactcgcgaggcgcggggggagggccaggctgtagagccacgtgactggatgggaaggtaacttcccctcactttgcctacccccgggcccatatctccgacagtagcccccggcaccgcgtcggacattggccccccgagggcagtccgacgtggcgcctcacgacttcccgtgccgagttgtgggcccgacgaggaatccagacggttgccgccgggcggccaggctggcgcattagtcataacggctatttgaccgccactaactgtgcccataacggcgatttgaccgccactaactgcgccgatgatggaggcgcttagggcgcgaaaatcggggggtcggccagaccacgcccagaatcatcacccacgccgcctcgactcccccgcctgccaggcacgcgacgggaccgacagcgggcccgcctaaccatgcccgtgaacatcgcatggcccgcgccgaatgtgccgctgacaggtgcaccaaacgcggggcgcgggttcagtggggcggcgtgatgagtgggtgcgagagtcgaggaggaaaccgcaggtgcaggaatcgagggggcaaccgcgggggcgtgaaacaaggaggcgagcgcgggcgaggcggggataaaaggatagggaggtggagagttcgtctccttcctctcgccgactgctcacccgcatactcgctcctcaagccctaacgcttctctcactccacgctattccgtacaccaaactcctcgccgtttccccgc

SEQ ID NO: 49167 - DNA, 1501 bp, Oryza sativa
gcaaggttgtcaactctgttgatgtgatgatgggtgtccatggtgctggactcaccaactgtgtgttcttgccacaaaacgctacattgattcagattgtgccatggggtggactagactggatatcaagaattgatttcggcaacccagcggaacaaatgggcctgcgttacaagcagtatagcattggtgtacatgaaagcagccttactgatcaatatcccctagatcatgagatcttcacaaatcctctttcgttccacaaacatggatttgaattcatcaggcagaccttcatggataagcaaaacgtcaagcttgattgcaaccgattcaagcctgtactcttggaggttcttgatcaattgaatcaatagaaaccactaatatattgcaagctggggcactgtttttgtccacaaatttttggtttcaccgttctttatttagtaaaatttgttggccatcttctgattacatgagcaaggcaggaattaatttatttgtctaatgtgtagaaaattatgctgccacatggatttaaactcagatatccatgatgtgtcatctagatcatatttctcgattggaaatagaaaataatttattttttacttgtaaatttttgtccatctggcttctgcattgctgtattaactatcaaaaatatcatccacatgaacattagtgatcgataagctgctaccgacagcatgatttgaggaaagtataatgaatgttccaggcctgacagcaaggatagctgaagaaattggaaatgagtaagtagagaccatcatttttttgtgctgtgtgattcattatgattctccacttctaagagcaagtttaatagtatagccaactactacctccaatttatatatagccaatctaatagcttattaatataatagttatatattacactattaatacttggtcccacctatcatacacactaggtcttggagttcgtgctacagctggctataaatctatagctcgctgcttttctctctcctcatttatcttcttaaaatatgtttgtacctcctctaatgagtagtacgtgcgcaagctggaaggggtaaggttggtgtaattaggtgtcaggtggtatggtagaagctaagctgaccaacctcttgaacctgcacattagaagacatatttttggtccttctaaatacattgtataaagtaaataaaactatataggtaggagtaggtggcaaaataagtcgcagtaggatagcaggagcaagaaatcaaatttttactgtttcttaaacgttttaaatttttatttttaaacacaaacacttcaaaacttatttctaaataatctttttggccacgccaactattagtaacaatggcacacctgctgtgaggtagagtgacagtattgttttgtcatgttaaactgggtgatgcgggcaaaagttttaaatttgaaataagttttaggatggattattttaaaattaaaaagttc

SEQ ID NO: 49168 - DNA, 1501 bp, Oryza sativa
cgataccgacgccgccacagccgccatgcccctgccgccgccctgtcgacgccgccatagccgcggccactgccgtcgcctctgctgatgccgccactgccgccgtgccactgcctctgccggcgggcaccagtgaatgaacgtgaacgaacgagaaaaagatcatgaacgaacgagaaaatgagtggaacgaacgtgaacgaacgatagaaatgttagaacgtacgtgaacgaacgagaacgacagaacgaacgagaaaatgagtggaacggacgtgaacgaacgatagaaacgacgcacacgccgccccgcaccgcggccgcgccaatgccgccgccgccaatgccgccgccgccatcacctctgccgacgctgtcatagccgccgcaccactgtcgccgcctctgccgacgcggccacagccgccgtgccacagtcgcggccactgccgctgcctatgctgacgccaccagtcgccgcgcctctgcctctgcctctgccggccgccgcccgtgaatgaacgtgaacgaacaagaaaacgaacatgaacgaacgagaaaacgagtggaacgaacgtgaacgaacgatagaaacgttagaacgtacgtgaacgaacgatggagacagaacgagaacgatagaacgaacgtgaatgaacgagaaaacaagtggaacggatgtgaacgaacaagaaaacgagtggaacggacgtgaacgaacgatagaaacgatagaacgtatgttaacgaacgaacgagaacgatagaacgaacattaccgaacgatagaacgggacacctcgttaacgaacgatttaagttacatttatattagaacaatttagactaatacatttgtttgcattttactgaaaaatacatggtcaagcactggtcgtcaccgttgctcaagcctaagtggtatcaagccctcggaggaatttgctcaggcaagtgacattaacgatcaaacgtgattcaatattgttttgaattgtaacaatcgtttgtgcccaaattaaaattgttattacattgtaataataagttgtatttaacatacacccgacataagtcaatatatgattattagagtttaaaccaattttaaatcttggacgatgtaaattgttctcgatgtattgaagatccatataatccaattgttgtgtggcatatgttaattatgtatgattattagagtttaaaacaattttaaatcatgcttatgttaattatatatgaatattataatttaaaacaattttaaatcatgcttatgttaattatatatgaatattagaattttaaacaattttaaattatgcatatgttaattatatttgattattacaatttttaacaattttgaataaagcatatggtaaatatacatgattattagagttgttattacattgtaatagtaagttgtatttatcatacacccgacataagttgtaaataacatacgcctgcaaatatttcttgtatgaacaga

SEQ ID NO: 49169 - DNA, 1037 bp, Oryza sativa
ggccacgtgcggccatgtgacggcgcgacgtccctctcgtggcctcagccgccctgacatggcacgggcttccccgtgcggcgagcggccggccggccgcgatgcccgccgcggcggccgcgcgcgccacctgcgtcgcttcgtcaactcccccatcctcacctcgctgtaaccctcacagttgcgagataatctccgaaatgccactgctcgtttgtaccgagacgatcctctcacagtggcaatcctgtgataagtcactctgatcaggggcattctcggtgatcaagggtgtaaccctctgtttctgggtcacttcgtcgcaaagtcaacccccaatactatactagaacccttgattgattcgatgatgcagaaggggaattaaggtgtggaaaaagataatgcgggggaagcatccatccatcagtgttgttcagtggtggtagattagattccagctgatccaatctggtccgggaattttttctagatctgacaccacattctggtcaaattcagagatccatgctgctctagtctgtactagagccgtccttggtgaacagttcttcgacactcacctcactctcatcgaggtctcccagcttgaggagcactgaagaaatttctatgttgaggtcagtgatctgatcatctgatcatgcaagctgaacaggattagttagatatgctgcagaaattttattagattttttgcattcttctgcaagtgttactgcatagttgtgttcatccaagttgatactgatctgatcatgcaagctgaaaaggattagttttactgcattgttgtgttcatccaagttgccaagaagtgtgaagattttgatgtcaatcactcacttggtcaaatttgatccaaagcagcgttgctaaattcatctgagttcagattgcgagtttgtgacattgggtttggttttgcgcagcaatggtgtcaagaagtctgcagcttgtcggcgcgttgctgctgccgctgctcgccgtcgtgtcgtcgtttgatccgttccacc

SEQ ID NO: 49170 - DNA, 1501 bp, Oryza sativa; identical to SEQ ID NO: 38649

SEQ ID NO: 49171 - DNA, 1501 bp, Oryza sativa
agttctttggagattggcttccggaaaagaagttgcaacttgttgatatgagtattctattaatcctattaagccctaggccgggatgttacaccctcaccaatgttacagcgccgccgctgccatcacccgcggctggttgcacctcggctgtggcgaactcggagccagacccgccgtgtggcccgtgggccccgccagggtgctgcgaaggctccgtggcaccgggtcggccgggtcccggtcgatccggtcgcttgaattttgacccctgtgagggatcggacgccgagaccccctaggaaggaatcccgctacaggagaaccccgatcacgttaagaagaaaaagaagggggaggagcaagaggccaaggtggatagagagcaccgagtcgggcgctagcgatcctacctgcgagggggcgtttgaaggtctacttcgggggctcgatgaaactcccccggcacggctccgtttgccctatcttccggagccgcttcttcttccgtccagcctcggacgtggcggggcgtttgtggcccgctggtggatggtccgccgttcgcttagcgcgccctatgcgcgggggagaacgcggccgagattcggacacctttcgcttccctttcgggtcgcaggcccctgaggcgatccgtcactgcgtcgtactcctcgccctgcgtcatactcctcgcccagttccaaaaccgccaaccacgcggcggatcgtttgggagggccggcggggagccgaagtcgcggatgatccggcagcgcggtgtaaaaccaatccgtcttccaatcctcccacttcttgcgaaggtggctctcaatgtactgccccgccgttcctggccggggctagaagtagcatcctcccaccaccacgccttgcagtagctgtgggacgaagaaggacaggaacagccgcatcgtctgcgcaccccgacgaacatctcgcagaagtgcgcgaagatggccagcgtcatcacagcgttgggtgcgagatgctaggcatgaatttcgtagaaatccaaaacctcatggaagaacctggaaaatggcgggatcagccccaccatggcgaaggacaggaggtgcacggatcgctctgggtactgcggccgcggccgcgactcctccaccctcacgacggcgtcctctggcatgatcttgcggatgaggctaaggtgcctctctgccatgatgagcgacgccgggggcacagcgtcaccagcgtcttgggccatggtgaccggcggggaaacggcgaggagtttggtgtacggaatagcgtggagtgagagaagcgttagggcttgaggagcgagtatgcgggtgagcagtcggcgagaggaaggagacgaactctccacctccctatccttttatccccgcctcgcccgcgctcgcctccttgtttcacgcccccgcggttgccccctcgattcctgcacctgcggtttcctcctcgactctcgcacccactcatcacgccg

SEQ ID NO: 49172 - DNA, 640 bp, Oryza sativa
tatatatatatatatatatatatatatatagagagagagagagagagagagagagatctagagagagaatgcaatgcatggtgcaatatatgcaatatggacccatctggtcgtaatgttaggagatatgttgattcccctgttggtacgtagtacatgaaacctcctgcatgcagaggaggagcagaattaacctttttctttttgtttttgtttgcctttgatctttgcaagaagttaccatgcctttgctttatccccctatctctctctctctctctctctgatctctcactactgttgctagctagctatagctgtttagctaagtgtatatgtgcaagatcatacaaagctagcttttccttttcctctaaatccaactttattctcctcttccttctcccaaaactctcccttaaaaagaagctgattccccatctgatccctcatcaaaacccttctcacattcgatctcgatcactcacacttacactcgcagtttgcacagctacttcatctcaagtagtagtagtaatatactagctagatcggtcggctatttgctgtagctagctagcgtgagctagcttggtttgtagagcttgtatacttggagggaggagatcgatagccatgg

SEQ ID NO: 49173 - DNA, 1501 bp, Oryza sativa
ttttggtatattaatggttagagaccgtattgtcttaactattataacgtgatagcctttaattaatgtagaaaccataccgatctctacctttgtacttgcacttactagctggcgaacagcgcggaagaaggaaggaaagttgctttgcctcctagccaagatggaaaaggttggcacatgggaacatcgggacagcgtgaaccgggcggtgcggcggtggttgggtcctctgtcgatcgaggtggtgctgttctcatcatgcgttcttgcatgcatccaagggattagcaggattaggcctgtgggataactaattaacatttctccgtgaattaaatttgcaccctcgatttcgtctctcggggcagacgattgaggagccgtatagccggtccatatgcgttgcaatgtcacctcaggtaatgtttgtccgcgtcgaacttcgctggtgtggacgtgtggtgccatgcggctgaactcgttcaattcggttgcactttagagttggaacaggtagattggatgtttctcaaatctcaacgttgtcccaatgccacaggtgcaagcacagtattacctctatcccattaatctagtacgggatatatataacatataactagtactagattaacttattttaggcagaattagtatgtaaggaatgtattttcattccctgattggcaatcaacggctcaccttatttcttatatattatgtaaataattataaaaatgttaaaaaataaaacggtactactccatgaaaatgcaaattcaaatttgactctataaattataaaagataataaatataagcatgaatgcacatgctagtttgagtataatttgtttttttaattaacttatagaaggtgaatttgactttgcatattctttttaagttactcgtcattttagctttgttttagtcaaacatttttaacttggaccctcaatttcttaaattttatatattttcacatcataatatttgtgtttttaaattcaccatgagaaaaactttcataatatgtaattcacatgtaattaaactatatgtataaagttaataatgtttgagttcaaacaaaactaaaacgataaagtaatttgaaacggatgatgtacactctttgtcactacataactactgtagcatcgatggcaaagggcaccctttcctttcctttctttctttctctttttttcttcctttctataaaggaaaaagtacgaattacccttcgaactatgacgatagtatgaattacccctctgaaccataaaaccggacattttataccctgaactatctataccggacgaataaccccctcgacccaatccaaagcggtattgtcctacgtggcaatgtagtcagcattttttttaaaaatggtggggcccacctttcatactctcccacctctctctctcttcctctcaatctctctgtctcatatgtggagccgcgagttggtggccggcgatgg

SEQ ID NO: 49174 - DNA, 1169 bp, Oryza sativa
attcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatactaattaaatattacaactgtttaatctttcaacttctgtttataaatgctcgctttatgcaaatgaaccactccagctcttctttgataattccctgcatcatacccctattccggtatgacttgctgagtacagtgggtagtactcagtcttgctctatttttttcccaaccccagagctcgagtatgtgtcagatgaaggtttctccgaggagtaggctttgtccgtgccgtcgaggatgcctgtggagtggtggtcccgctgcagttctagtcaaggcttagctcctgttgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcaggaatttctgggcgtgacaagttggtatcagagccgaacttgaccgtaggacaagccaaatggaaaaacctaagagccctccgaatccttttcattgcatatgttctttgcaattggatttgttccgggaaaattgggatctgttcttgtggttcaaggggaaaaatcttgatcgctcgtttaagtgagatttgtcaaaacgagtcagtctagggttttagtaaaactattgagatttattcgtcagtcagttgggatttgatgggtgaaatgcattaggtcctagctcaggaacatgggttgcaaggtatttatgttattagtgttattatagtatgtatgtaatttccccactattttatcgttatgtgagtctgtcttctttattcgctctcatgcaaaatgatctatgcataaaatttcgctcttattcgattctcttattgagtcttttattgctttatttaaatttggatttgagcatgcattgatcctactcctttgtcttctctagatggccggccaccccccccaaccaccgtggagaaggcatgatcgactttgtggcagagttggcacgca

SEQ ID NO: 49175 - DNA, 1501 bp, Oryza sativa; identical to SEQ ID NO: 38661

SEQ ID NO: 49176 - DNA, 690 bp, Oryza sativa
tgatcaatcaatcaatcgatgagctagctctctttatttaccacccacaaacatcttttaatcccctttgatcaacacatgatcgatcaccatctgtccctttttttctctgaatttgaatcgatcccttctctgtaattttctccttgccatacatggcttctgcctcttcttgctcagcttaaagttcagaaccctagaaagtgtttattggcttagctatagctgcttgctctcccaccaagtctacactactgtcacacactgacattgtccgtcctccatgtacatggatgcacagcaaaaagccctagcttaattagctacgtataccttccttgtcgccgggttcaccgcggcgaggcgacgtcgacgccgacaccggcgtcgccgctttgcttgccggcgaggccacctcccggatgcccctccatggccgtgcagtgaccacgcatatgcctgctcatcactttctccttgtagagttctaggtataaatgtctcgcgccattgttaccgtctagtgaaatctcgatcttggaacatttaggtgagattattgatgccgagttatctgcgaattttcatggagttttccggtgttttaattcgatggtgtggtttggttgcaggtacaaggttgaagacgacggccggcaacgacggcgacgatgacgatgaccggagggc

SEQ ID NO: 49177 - DNA, 1501 bp, Oryza sativa; identical to SEQ ID NO: 20613

SEQ ID NO: 49178 - DNA, 458 bp, Oryza sativa
cgatgtttttcaccggaatgaaaaagttcaaaagcatcaaaccatgatttttggacatattagagtgtgttgggtgcattcgtgccaaaaaatcacttcgtgattcgcgcgctgaatttttgtcaattactaccaatattggcacacgtggttgcgatgtttttgaccggaatgaaaaagttcaaaaagcaccaaaacatgatttttggacatattggagtgtgttgggtgcattcgtggcaaaatatcacttcatgattcgcgcagcgaacttttgtcaattactgccaatattggcataggtgggtgcgatgtttttcaccggaatgaaaaagttcaaaaagcaccaaaacatgatttttggacatattgcagtgtgttgggtgcgttcgtggcaaaaaatcacttcgtgattcgcgcggcgaacttttgtcaattaatgccaatattgccatagg

SEQ ID NO: 49179 - DNA, 1501 bp, Oryza sativa
gttttcacctggagagatttgtgaggatatgaaagagtgccatgacaacgcctccaaggagggaaacgacacccacgggcgcgccattgtcgaaccggccaaaagcacggtaaggctttcgccagcatcttcacaacacccacacaagcacccccacatcgatggccgcagaatagttcatgacgtctcagaagcaatcataccttgattgtaaccaacggcaaagacgggcccttggccatcctcgaaatgccatccatccgccgcaaacttctacagcaagccggagcctccgccctccccatagcattccccatgaccagaaaagggtccggccaaggggggaaaccaaagagagggagaacactcggccgacaatgaggaagtcaccgtcacggacatcaagcaccattcctgcttcacgccagcacaagccgtcgtcccgccatttccacatccgcacatcgctgcccatcaacaacaacgagacccaccaccggcagaagccccctgccgagtaggaggctggctgccagcgagccgccgccgcgcttgccgtccacacgcagccgtcccaccgaccagctgccatctggcgtggaggcgacgaatctagccgcggacggccagatccagccaggtacaggggatgaccagctagggcgcgccgccgcagcattaccgaagccaacaccgacgcttgacagacgccgacgacaacgccgcgaccatgacgggagcgagccgccactgccgtcgcccgtccaccgcgacgccgcccctgcctgccggtttccgcgcctccccggcgccgaccactctcccccagcccggattggagaggcgacgcgagggagcgccgttgccgctgctccacctttcccgccgcctgcatctcccttccccgcctccttgggtgccgccgtcgtcccgggaggaggccggaccgccggatttggcgagggacgccaaatctggcgtcgtcgccgccgcccccgttccgcacccagccgccttcgcccagctgttccgcacccggtcgcctctgcgcgcctagcccgacgccccgacgccgacgccgatgccaccgcaccgtcgccgcccccaactggtcggggtcgtgggcaccgacccgcgccctcgagggagaaggaaggccccaccgccgacttcctcgcagccgcgcggtttccggcagtctgctcgggcggcggcgaggtggaggagggagcaaggcggcggtggggagaaagacggcggtggtcgccacccgtgtcgcccctgcccctggaacgacacgggggcagttctcatagctctgttatcgatcactggttgcctagaacctcaatcgaacaccttgcgggcagggactctagttgctcggcaatgccaaagaacaaagaacttaatttgtgacctatctttgtgactttgtgtgtcttctattgaatggaacaagttgggatacaatttgtgaggaatgtttcctttctttttg

SEQ ID NO: 49180 - DNA, 1193 bp, Oryza sativa
  unsure (1)..(1193): unsure at all n locations
atgcagtgacgatgcatatgcacacacactgtgattagtttaattaagcttagcttcgatcttgctctctagaacaagttgacagtgcatgcatgtgatgcatcgatctgcgcaggtactggcggacaggttattcccggcgatggcgacgccgacgacgcgtggccccgacgacgacgacgacgtgtggacgcacgtcacgccggcccaccggcacgggtcgtcggcagcgcccccgacgggtcgtcggtcaccgccgtcttgaacgccagcgccaccaccgcctccacccgcgcgcctcgagtcgtcgtgggcggcggcgcgtcgccgtcgacccacgccgcaccgcctccaaagcctacagacaacagatcgatcggccgtggtgcgccggcacaatgccgtcgccttttcggtacgatgatgacgagtaggagagtggcggcctggtccgggcatggacgtccgaggagaggaagttggcgtcgccgtcctacccgctgcggccgcgtcaccggtcgatgagnagnaggtcggagagcgcctttccccccccccgggggcccctcttnncccgccccttcccaccaaccggctgnccgggcgagctccgcctcccgctgccggccgcccgctccgcctccgtctcagccgcccgccgccctccgccttccgccgctggcagcgacgcctgctcctgctctcgcgcggtcgccaccgtgctggtgaggagagagaggagagattgggatagagtagcgagggacagagaggggaggggaactgacacaggtggggcacactaattttttttaaaaaaaaattgctgtctggaggatccaaaaccactccggattaagtcgggggttatttatccgatattaataattgagggtgtagaatgtctggtttttaagttcgggggtataattcggtcgagctcgatagttaggggtaattcgtacttttttttttccttaattaaatcaataaactgcgtttgtgctcacttaatttatctcaacttttatgagcgtgaagacacaagcaacagccatgcccatgcacgctcctaaccacccaccattaaccaaccgtaaattagctcctaaccacgctcctaacctctcgttctcgacaccctcctccccttataaactcccctcctcttcaccctcttctcctccaacaac

SEQ ID NO: 49181 - DNA, 497 bp, Oryza sativa
  unsure (1)..(497): unsure at all n locations
gcaaaaactcaattcgtgttcgcacagcgactttgtgcaatcattgacattattggcacacgtgggtgcgatgtttttgacggnaataaaaaagtcaaaaaagcacaaaacatgtagtgtnttggtgcgttcggccaaaaaatgacttcgtgtccgcgcgccgaagttgggtcaattaatgccattattggcacacggtgggtgcgatgtttttggccggaatgaaaatattcaaaaggcaccaaaacatgatttttgaacatattgaagtgtatggggtgcgctcgtagtaaaaactcacttcgtattcggcgcggcgaccttttgtcatttaatgccactattggcacacgtgggtgcgatgtttttgcccggaatgaaaataattcataaagcgccanaccatgatctttggacatattggagtgtatgggggcgttcgtggcaaaaactcacttcgtattcgcgcggcgaagttttgtcaattaatgccaata

SEQ ID NO: 49182 - DNA, 609 bp, Oryza sativa
  unsure (1)..(609): unsure at all n locations
agttcctaatatttctaatataaaaatttccctttttcaatacatgtagaacaataccattacacgaaattacaataaataattaatactctttcacataaatcctttagctactatactngaaaaaaatacttacatcaactgtaaattattaagctttttcacagctatttagtcctattcttgcatcataattatcttatatcttaccgtagtatagccacttaacccagcacattatgttcttaccatatatatctttccagctacaactaagatttacatcacataaatacttacatacatcaagttatagatcacatacttcattgcatttctacatatcccaaaatactcaccctgtttgaaaataaaaaaattataataaaaactctaataactagctgagcctctcataactttttttatttatcaaatacatctaactacatgtgtatatatattgtagccacaatcatgtcttccgcagttttcgcatcaatgaggctgaatgcaacaaatcaaagctacttggtaagctcaaagtcaaacaaaactttctatgtacaatatgctgttagcaccagtgcggatatgatattttctttc

SEQ ID NO: 49183 - DNA, 1501 bp, Oryza sativa
ctagaagaatttatcgtgcttaccacaagccagcgtgggcaacggctgggcttatagtgtagcttttctctagctgacgcatccaggcaagggtgggcgtgatggagtttggatgggccctgtgacggcctatgcggcttccggattcacctaggcacgagaggggacttcctgtcgcccgctggggacgggggtgaaacctgaggtgtggtgtgcttggctagagggggttgcgcgaagggtcctgtcacggcttctttccggtatgtcgtggtggcatgtcggcgcacggaaacgtgtcgtggggctgtgtctcgtgggtacagttgtacacctctgaccagagtaaaactattcaaatagccgtgcccgcggttatgggcggtcaaccagattcaccgtgattagtctcatcctagtttagtgtaatgaaattggatagtacgggtggatggttgggcctgttgcaacgtggtgtaacattggacagtggatgattaatattgattaattattacaactgtttccgcattcaacttctgtttataaatgccagtattatgcaaatgaacctgtatagctatcccttgttaatccctgcatcatacccctattccggtgtgacttgctgagtacagtggatagtactcagtcttactttattttcccccaaccccagagtatgagtatgtgtccgatggcgggttctctgaggagtaggcttcgtccgtgccgtcggagtggtgttcccgctgcagttcaagtctaggcttagctcctgttatctttcgttttccgctgcatttatgtaagacttttataatgtttgtaagacgtggatctttatgtcaacattgtcgtttgtgtaccccagccggtcctggacgggggttttaatgcacattctgcttggaattctattcgggaatttttgggcgtgacaagttggtatcagatcgtccttgaccgtaggacaagccaaatggaaacctaagagccctctgaatcctttcattgcataagttctttgcagttggaattgttccgggaaaatttgggatctgttcttgtggttcaagggaaaaatcttgtcgctcgtttaagtgagatttgccaaaacaagtcggtctagggttttagtaaaattatttgagatgttttgaccatcagttgggatttgatgggcgaaatgcattaggtcttagctcaggaatatgggttgtaaggtatttatgcttttattgttattataagtatgtatctaatttccccattattttatcgctatgtaagtccgtcttatttattcgctctcatgcaaaatgatctatgcataaaatttcgctcttattcgattctcttatttgagtcctttattgctttatttaaattggatttgagcatgcattgatcctacccctttgtcttctctagatggccgagcacccacccaaccaccgcggagaaggcatggatgatttcgtggcagagttggcacgca

SEQ ID NO: 49184 - DNA, 1501 bp, Oryza sativa
cagccgcctctgatccctttcttttaggaaaatttgtaatgataattgttatgcagtggtgtccaaattattcaagaaaaaaaatggtttcatatctctaatgtttagttttgtaccttcatttttttatttgttggcttgtcgcaccaaagttgtgtgttaattcccgcatagttccacatttttctttattctttatactttgttattgacaacatgtttggtttagattattaagtatatcataaactaaatattgatatataatataattaataaatagcttaaaataagtggttaaaatacagtagaacaaagttttttgaaaaaaatatttttttaaaaaaaaagttgaacaaataataataatgaataaggccgacatatattgctgatcagtattcaccgaatgcaggttgcggtccttgcgttgcttgactccttgtggagcagtggaggagtgctgaccgttgttgacgccatcaaggaaacacagcttataattaccctttataatgggaaaatatgtaaaagtaccggccgattggggatgaaacactgaaacagtgaataacttgactcaggttaatggcaagtcttatgtagcgtaaaatatagaggcagaattttgatgttgtacggatttttgttttattttagggtattagggttgtgagagttttgcgctaactctactccgatccacatcaacattacgcaatgctgatataaattatgacagatccaaaatcactattatacaaacatgcaaattaatataaatttaatctacataaaaacaacaaataaaaatttaatcgacattaaaaaataaattctatttgtgtgcatgcacagtactattattatttttgttgcttggttttattatttttgttcctttcattgtagactgaatttatccttcatgtttaccccgtttgaagttgattagacaaagattaagctagggcacaaaaaacaagaaaaccattaacattaatttagttttaattactataaacttaaaaattagatttattttatattttaaatcaactttaatacatatatataattttcacacaaaatatatcatttagtagtttgaaaaatatccaaatcaagataacatatgtatcttaatttcaccagaatggacttattaatcctgtcccaatcaatttaccatttttttaaaaaaattctatatagctaagttatacaaataacgggtgcggccttgtatgtgtaaaaaaaaaaatcgatcccattaaatttctccatttaatttggcccaaattcacctcaagcacgtcctgtgttatctgtatatatatcccgacgcatgcaggtgcacgcggccgcatatttcgccgcgaactctccgttccggtgccccaacttaccaatccgacggagacccagctctcgtctcgccgccgatctccatggcccaaccttggcgcccgttcgtcgccgacatctcgccggtcgcagt

SEQ ID NO: 49185 - DNA, 662 bp, Oryza sativa
tctttgatgcatgatactgcattttacaataatgcttcataaaagggaatgaattcatgtggtcagcaactataaataatttcaaataattacttattatcaaagcgtgataatatgaaaataaactgatagaggacatctctccatgtgagtcagcctagtttcagaaatgcattagcagagcaaccttttatgagtaaagcaattctttgatgcaaggtatttacattgatgacaatgcttcataaaaggcaaataattcatgattccaacaagtataaataatttcaaagaaatgcttattatctaatgatgataataagaaaagaaattgatgaaggagagggcaccactccatgtgcgccgtcctagttgacaaatgcatgaatagagcccttttttttgtaagagttaacaatcaattctttgatgaacggcactaatctgccaaaatgattccaaaaaatcaaagaattcatgtgtccagcaagtattttaatttcaaagaactgcctaatagtatcatcaaaggatgaagataggaaaaggaattgatggaaggtagggaaagaatttgatggagggggtctctccatcagaggccatcctagttgacaaacatatgatcagcggaaatacagaatcgcgcaattgttattttg

SEQ ID NO: 49186 - DNA, 265 bp, Oryza sativa
acgaaaaagatcaaaaagcaccaaaacatgatttttggacatattggagtgtattgggtgcgttcgtgaaaaactcccttcgtcattcgcgcggcgaacttttgtcacttaatgccattattggcacacgtgggtgcaatgtttttgaccgaaatgaaaaagttcaaaaagctccaaaaacatgatttttggacatattggagtgtattgggtgcgtttgtgccaaaaactcacttcgtgattcgcgcggcgaacttttgtcagt

SEQ ID NO: 49187 - DNA, 493 bp, Oryza sativa
tgtttcactatgtgtggatcaaatgttgcagtgaactgaaacattctttcgctatttgccgaaacattgtttttatataaggtgaaacaacacctgatttaaacgagtgaaatattttcgatctacttagtgaaacaattccgatataactagtggaacatcgtacaacactaaaaaataattcaataataagctaatattttttttcatcggaatatatccatatatggtcttgttttgaagatttaattataacgaatttaatggtacaatcggattatgattttgataagtaatttaagagaaaaatcagtttaaaatagttttgcacgtaaatcggacgctaacgtcagcgcccgattttactccgaattgatcgggcgccccagcctaggctgccccgatttataattcgggcattcacgatactttagccataataagataataaagagacttcattcaagaatgagcctatacgtatagttggcca

SEQ ID NO: 49188 - DNA, 888 bp, Oryza sativa
ctgtgtacaaatgtacatgtacatgtgcttctgatcaaaaggtgaattgggatttgggagtgttccattgcttcaggagtaatgcttttttattgttccacaaaaagggtgagagatttaaacaaaacctctgacaagacatcatgtgaaggtgtagcagttttatgacacaaactgttagtatttaccctaccagtttcaacgggaaaacaagtagtactatttgtcaatccatctcaaatttcaaaattcaaaaattatccctaaataagtgaatattgtttgccaatccaaaatttcttccaacctctaatttaaaaattatatatatttattataccctcaactacagcccactagtgacatctctattagtatagggcatctaggtcatttaccttttctcataattgactcataagtaataaagtgatcagttattttgggatataggataaatatattcgggaaatacttactacctgagacctaagtacgaaagctcaatttacaaggggaaaatgacatatgagatactattcacaagtcaaatgacatcccagcggttaaaaccacttgaattcgggaaggggagatcacatgttcgagtccgtatgctaactaagggtttatgggactgtcgggtataaactcagaccgctagggtttcatgtagccagcgtgtttgagctgtttacaacaatcatatctctatatcgtttttttccttgcgtgttgaataaaaactttttttgaaaaaaaaaagaaatactagcaagaattccgcaaagccgacacgttggccgcacacggtttgtgagacggccccacccgtcagccacccatcgaggccggaaccagaaccccgccgtgtgcacctagcaatta

SEQ ID NO: 49189 - DNA, 1159 bp, Oryza sativa
  unsure (1)..(1159): unsure at all n locations
gcagcccgattntttgacatattggagcgttcgtggcaaaaactcactttgtgattcgcacgacgaacttttgtcaattaatgccatcattggcacacgtgggtgcgatgtttttgaccggaataaaaaaagttcaaaaagcactaaaacatgatttttggacatattgcagcgttcgtggcaaaaactcactttgtgattcgcgcggagaacttttgtcaattaatgccattatttgcacacgtgggtgcgatgtttttgaccggaatgaaaaagttcaaaaagcaccaaaacatgatttttggacatataggagtgtattgggtgcgttcgtggcaaaaactcacttcgtgattcgcgcggcaaacttttgtcaattaatgccattattggcacacgtggctgcgatgtttttgaccggaatgaaaaagttcaaaaagcacgaaaacgtgaattttggacataatggagtgtattgggtgcgttcatggcaaaaactcactttgtgattcgtgcggcgaacttttctcaattaatgccattattggcacacgtgggtgcgatgtttttgaccggaatgaaaaggttcaaaaaagagcaaaacatgatttttggacatattggagtgtattgggcgcgttcgtggcaaaaactcacttcgtgattcgcgcggcaatgtgaagttgaccctttgagggtgctgacacaaggaagggcaatgttggtgtcagaattatgcgaaatgaaagagaagacacaagatcagggagaaggaggacatgcttacctctggaatttcagatgagagtgccattgcaagctcggagaagctggaagaacaaagggtgaaactgcttggagttggcccctagaggggttgatggctaggaattgctacagtagaaggctgtggcggaaatccggtgggaaggcgaaagagctcagagcaacgggttaatatttgtgggtctaacggttaagatttggaaagcctcaatagtccgcagggtcagtcgaagcaaattctattgtactttcccaagtacagcggaattggggggcatgtgtgaatagaaaaatctggcagcagaagtcagatggacgaaaggaaatcaagacagattcggtgcgaaaacatgttgggttcaagattgaatca

SEQ ID NO: 49190 - DNA, 1501 bp, Oryza sativa
cgtgtgatcgttgcttgctacatctcaaacatggtttggatctgtccgtgcctagttgctgtcaaaatcccgggtgttgttgcatcggttcagagttacatttcacatgatcgctgggagggctcacatggccgtttcatcagtccgggcttgccatgcgaagcaatcacctgaactacatgtccctctctactgctgctatcacatgcccaagtgacagcgactgtctactatctcactaaacagtcaaatctttttgctcctgatgaaaatgaattgatcttagcaaccgtccgttcattccgatggccttttcattagaggtagttaagatggaactgtcagttttttttttacctggttttaccaccgtatatgagagagtcgtggctgtgttggcttgttatctcggtggtcagttgctcgaatatttgtgtcagtggtgaaagcaaccgactagaaaagacctgaacgacctgtatgcgttgggtgacactggagatggataagcaagttccttggcatgtcaattcaggcgaaaacggaaggccccaaagaaatggagctgtggagggtagctacttggtcgctttccttgatattatcattgtgtctgcgttggagataaagcaaatccttgagtatttatccggcccgaactgtgcaactagatataatagaaaaaaaggaagggtaaattttgcaaaactatagatatctcaaatcaaactattgtaaatttataaggcgttgtatgtatatcacaaagttatcatagatttttaccaaatttgttatgaaactatacatttataagatgaagtattgcaaaactatagtttcaatgattaaattatcttgaaattatagactttagagtttaaacccttagcattaatgttttgatttatttaccttggtactaatgttttgttggagcaacaaaagatatagttttgttacaaatttagtgtcaaatatgtattttgtgatactctgtcaagtgtatatataattttacaatagtttaaaattttataaaatttagttccatctattttttataaaatttactctactcaaaactgaaattgaagaatatggataaaaaaagaaagaaatttactctcatttgttttagtttttttcttaaaaaaacgctttttcctattagtacgcgcaataaatggaaatcaatcaagaataaatactcaacctcactaaattctccacatgtgtgtaatattcgtcggtatctctctaaagtgaaaacaataacatctttatgcgtaatagcatctaccttatttttttttcatggtagttagtgactagcaaattgaaaatcacacaggatatgaagaagttaaaaaaaaaaagttcaaataccccctaagcttgaaaacccaaattaacccaaaggaaaacaaaacgagtgaaaaagaataaaataggaaattactgcccatttccaccgctgactgtcctactaccctgaagc

SEQ ID NO: 49191 - DNA, 496 bp, Oryza sativa
catgataagctactgttatcctaacacataatccctactacatatgacgatttatttctactactcgatcgagcaccatgactcgatgaaagctttatattggttcaggtcctcgatgtgaggtaataccctaatccagttgtctcgatgtgaggtaataccctaatccagttgtctcgatgtgaggtaatacccaaatccagttgtctcgatgatccaactgtcttgatgtgaggtaatacccaaatccagttgtctcgatgatccaactgtcttgatgtgaggtaataccctaatccagttgtatgtgtatcggatctatgtccggtatggagtggagatgatgtatgcctaggttgtggagataatccgacctccccctctcgggacccctgccccctcttatataggatgaggggggttacaagtaaagtatctagttgattgtaactagatctccctattctatctataaagatatgtatgatcccccaga

SEQ ID NO: 49192 - DNA, 1044 bp, Oryza sativa
tattggtaaattaatatgataagctcctaatgaatctcttggggcttataataataagcatgtactccctccgtcctaaaatataagtgattttagatggatttaatacatcttagtatgataaatctggacaagctccaggatatgtcacatccatttaaaatcccttatattttaggatggaggagtaactgtcaccctattttttaaaatatttaatttatccctagaccacttgtttaagctaatattatgtttattttttaaaatatttaatttatctgtgtaatcagctaggttatctgtaaaaataatctatgcttagatctcctcatcctagaaagcattgctactatggcgcatgtatcgtaagcgaaattaatcttaaccccactttctactactatataaactctcttcgttttaaaatagttatccacatggggattcataatttatcccaaaatagttgttacaactactacttctctcatcaatcactttccacttaaatttctcctcattctactcacttttcttccaccattttcaaccataggcatttaatatggggtttttctttctcaaaccttaacctatgctagcctaaaacaacaactatttcatcaatccacgtatgatgtttgtcacattggacaatcctaaaaccggtagttaacatcaggacgggaagaagatgtgaggcgtggagaagaggacgagccaagctagtgatctcagcagccggcacggagaagacaagccaggtgatctcacacagcctgagacgattgctccctgcaggcggcagcgactgctttgtcactgaccgtttgcactcctcttccaagtgtgtgtgtgtgtgttttgaagggtgaaacaacatattctccgcagcagggatgcgacaaagaaccgcctgttaacctggccccgtttgctctctggccactttggcttgtaggatattatgatcttacttcctccgtctcaaaatgaagccatttatgaggttggcacgagtattaagaaagtaggtgagaa

SEQ ID NO: 49193 - DNA, 1501 bp, Oryza sativa
tgacaatgtggtgctatattaaatatttgctaacaacgaattaattaagtttaataaattcgtctcgcagtttacaggtggattctgtaatttgtttggttattagactacgtttaatacttcaaatgtgtgtcagtatatccgatgtgatacggcaaaattttttacctctaagatgtaaacacagccttattatagaaaaaaaagagtactctctctatccaaaaagaatcaacggacaacatgctgtgtttttccccaccattcccaactcaccttcattgtgttccgcacgcacattttaaaactgttaaacgatactttttcgcaaagaaatagtttctatacaaaagtattaattaaatttataaaagtaccaaatacttaattgaaaaaaatatgtcgctctattttatgtgcgcctatctcccgaacacggtcttatccaaattaaaattttgacccaaggacatagatattcaaattaaggcctggtttacttcccaaaattttctaaaaacatcacatcgaatctttggacacatgcatggagcattaaaatatagattaaaaaactaattgcacagttatggggggaatcgcaagacgatctcttgagtctaattagtccatgattagtcgtaagtgctacgatacccacaagtgctaatggtagattaattaggctcaaaagattcgtctcgtggtttccagacgagttatgaattagttttttcaaatatacgatgttacatcacattttttcccccgaactaagggcccctttgaatcacaggaacgaaaaaacggaggaataggaaaaacatagaattctggtaggaatacaagtgtaaaatagaggattgcaaaacatagaaaaaaacataggaatgaccgtttgattgagccgcaggaaaaacataggaatttgaggagggataaaatttcctttgaattaaatgggggggggggtaaacagcctcaagtacacaggactgtagccactcacctcccagatagtgtggcctgggcccacacacttcaatttttgaaccgttgcacgccatctcccgaaggagtgggtcccaccacccagtgcaggtcccaaagtgggagcgcaacacggcttttccccttcattcccgtcccctatatgcgttcaaaagaaaaacctcccatctcgtctcccccctcctccgcctccgccgcgccggccgccgatctccatctcctcgcgagcagggagcgcggcaggggcgccgtcgtcctgctgcttcccgccacaatcctggctggtgagcattccgcatcctctctttttctctcgcccactttttttctcgatcttttcttttcttggagtgtcgagttcacgtgcgttaaaccctagcttctctagcgtttcctattgatttgccttaacattaatacgagtactaacggcttgtttttgtttgttctccaaaaagtttggaggggcggtttaagaaggttcatctga

SEQ ID NO: 49194 - DNA, 827 bp, Oryza sativa
gatggcgccgctaatctacccgttcgctccccgtgcgactttcccttttctcggcgtcatctcactctccctccagggcttggcacggagcacgacgtgacgacgaccccgttcttttgcgtcaccgccctcgctttccaactaatggcccaatagggaactgaggcatcagcgagcagccatgcaagtggcggccgggcgcgccacgccgcgcgagggaaagcgagcgattgatgcgcgctgctgggctggctgatggcctctcgggggatctttttgttaagtaccgcaatttcaccacatgtcgatcgaaaccccacaaaggggcacggggcacccaattgaaacgtgttgccaattgtggccgtcgcaaaggaaagtcaccgttgggagctgacacgtaggacaggatcgatcgaccagcgaccgagcagggggtagtgttaactttatgttgggtcgctgttgaggtctacggtctccgagaaaaagcgtctggagatgggatttttttttttgtgtgcgcgtcgggtcaggtagtggaccaggttggttgggaatttggggccgacccgatggatcgaccgaatagtttgtgctgaccaattggtggtctgcttataaatatactctatatagaagcgtttggttagctgatcgtgcgatcactcacaagattttgttgtcatatgcagctcaattagctaactaatccatgctaactaagcgtgtgtgatctaacgctgattaagctgtgtccatatgatcggtacggcccgtgggtaataataatttattaatttgtcgttctgacctgcattgccagg

SEQ ID NO: 49195 - DNA, 310 bp, Oryza sativa
tgcctgaaggttgtcgctgcactctgcaacggccaccgcacccgtcgccgctgctaccacaactgcaacccgctgctgccgccgccgaggtcatcgctgcactccgtcgcggttgccgaaccccgccgcaaccgcaacccaccaccactgtcaaggtcgtcgtccccatccagattcggcgagaacaaggctagatccgagccgacagcggtggcggcagctcgatctcaccggtagagaggggggagagctcaagatcgagcaccgtcacatggatctcgacaccgctgatctcgtcgccttgtgcagg

SEQ ID NO: 49196 - DNA, 191 bp, Oryza sativa
tgacaaaatttagtaagacctatttaggcaacaaaccaaaccaacccttaatccactccgaagacagacacagctccctcctcccgaagctacaagaggaatcaaaccttcccatccctctggtcttcttcttctccaccccagtccgcaacctcccctcctcttccctcccccaccgtctccgtctctca

SEQ ID NO: 49197 - DNA, 286 bp, Oryza sativa
ttttcctttatatgggacttacataggcttaatctgatttttcacccacatgaaagttgtagagaattttgtttagatgtctaaagtgatatcggttgctactttttgttaggcgctttgtgaaatatgtatataacattgtataggtagtataggtagttttatgtaggtaccgtcccggttgacagataaattttggttttgatctttcatgatgttttgtacatgtatagatagtctcaaggattcctcaatagaggttttacttgtagctttactccacagg

SEQ ID NO: 49198 - DNA, 1501 bp, Oryza sativa
caaatggttgtaaaaaaaagtatttaaaaaattgttaatatagagtatagcaagatctataactccaaaaaaatcatgtccaaattcgatctgcacattgataaacgaaaaagacaaattctattcacgtctgagtttgtcttttgtttaattcctcaatgtgttttattatttaaatggtatgaatgctatcaattttttttctgagattcttttaacgatgatttagatagtgttcgaacaaaagtacatacataccggcgataacggcaaggcataatagtaatagtcgagcgtctcaagcgaggtaaccatggcggacagaaggtttggggcgcttggataggaggcctgcgcgaagtctgcctgcgacacgcgcggcaagcgcgcgcccacgaactcgacgttccccatcccgtcgatccgaaggaaccggaggctggacgacaccatcctcaccttgcggcgcccgtcgccgccatgttcacggcagtccacgtccacggcgatgcagcacatcctgagctcctccagcctcggggacatagcgacgagcgcctccaggtcgcgggcattgcggaacgcggtgccggtgagggagagcgtcgcgagggccgggaacccggcgaagtgctccggcgcggccggcagggcgaagcggccgagggagaggcgcctgagcgcgcggcaggcgaagatggagcggtgcatggggtgcggcggcggccggtacatggcgcgcacggtgaggtccagcgactggatccccttctcggagagggacgccatccaggcgggcacgccggggaggagctcgtcggtgaccctcaggcggacgcgctgcacggggcccgggtgctggtgcagcaggatggcgtcgatcgccgccttgtcgcacgccaccgccgtcgccgccgccaccggcaacgacgccgccgccggcggcggcgacgagacgaagtcgagctcgccgaggtggcgccaggaccggccccagctgctggaaaggacgctggagcgggcggcgtcgcggagcggcagccgcgcgagtatggcgtcttgaagctcccatgggagctcggggatgccccttctgctcgccattggcggccttcaagcaaagctcgacaaaacccctcctcggctcctccctttggtcctcacagcctcgacaattatgttaccgcgatcgcgagatttctctatatctactattataaaaattaaagataattaaagatgtttctactagtattttggtaggttatccatgtttaagtaggtttttaagttcgttcgcttttagaaatacagatccgtttttaaattgtattttaagctcatttgtttttggaaatataaaaggagacatataagaaatatcattaaaaaaacccgcatgctaacttgagatgaaatacggactcttgcagcttatgattttcgaaaaaaatatctaagcgaattcacacagtaaattttatcctagctaaaccatata

SEQ ID NO: 49199 - DNA, 1501 bp, Oryza sativa
cgttaggtgagttgtatcggtcaatacactttttttattgccaaatgtcttgattttatttaattttacacatgtgcactaatatttaattatgcgccgttaaccaggcaggtacctacttgtcgactccggatttcctaccaggatgggcttccttgcaccgtacccacatgtacggtaccacagggatcaacttgcggtcgagggagccccgccacccgtaggacgggaagagactttcaaccatcgacactccacgttgcgagggatcgtggaaagacaatttggcatcgcaaaaaagatgtggaaaatattgaaagaaatcccttattaccgagatgaggacatccctgcacgcatcattcatgcagctttcgctctacagaactttaggttggatagtaaagatccgacctatcggttcactaatgctctctacaacggcaatccagtgccgctgctgaacgattcattcgaccatatgtattacgcaacaaatagcgaggccgctatgagcatgttgcgtgactgtattgctgatgatgcgtacaataactaccattaggtaggtgatgttatccataatgcttgtcgtatgttcagtacttcaattttcaggattgtatggtttaccatttatttttataacgttaacaacaaatttgatgcaccgattcttgcgttatttgtttcacaattcatttttttcttaattcttgcgttattatttcagacaaaaaattaatcattgttattgcaaaatttatgtccgaatcttcacatattatgaaaattattattaaagaaatcacatgtgtgtgcatatcaaatatttctttcacaattggtgccgcgtagcaaatacctctttcacccgtgtcttgcaaaaaaacacccattaattcgcatgctacagtacctccactgccagcccctgcccggcatcgcacggcacggcgacggaaagtgtcggccatagacggcgtccaggctgccgctttccctccgtccctgacgccctgacactgctacagtggtctacagtactacatgttcccaacccaaaagtcaagctccgatccggcacttgcgaacgaagccttagactaactaatagtgccattagatatatatatctatatttagactaactaatagtgccattagatatatctaaattttagaggatactggaacttgaatgaggtcaaacaaagctgcagatcaagtgatatgaatttcctaagaattatttgtttttatgtctaataggaaaaggaattaaagaattccctggaaaggaaatgggaacgagggaccgaaattaaacttcttggtcgagcacgaggcgtggcccagagcaaagtgcgggcgcgaacgtgcacgcgcgagccgaagggcgaggcacggcccacgtaggcaaggtgcgcgcgaggcaggccggtggaccgcgcgggatcctgggtgggacccacctactagctacaaggttcacgagaac

SEQ ID NO: 49200 - DNA, 908 bp, Oryza sativa
agaaataaagatgcatatcttactcccggttatctctaaagatgatagcgccacgtggctgacgatgtcatctttagtctttttttattgttttttatatattgatttctaaccaaactcaacaataaaatcatcaacattcacataaacatcacaaaattgtccacatccacattcataattcatatcacaaatttacatattaaaagacatcataaatcaacaaattcatagataaatcaacaaaatctaacaactaaatcaaccggggctggctcctgcacaggccgccgcccgctgcacgtaggcctgagcaggctgccccctcctccaggctgctgctgctgcaagaaaaagaaaaggagaggataagagagaggaaagagagagtcgagagaggagaaaagagaggaggaagttaaaaaatgaggatgaaatgtttgtgatccagaaggagaggataaatgcgagggattatatatgaagcattgaattttaatcctggttgataataccaatactaaccagggctaaagataataaggggctggacgttttttgaacctgtaggactaaaaatgatctttagtcctgattgataacactaaccgggactaaagattataaaagtgacgttggcttttcaaccggttacaggaaccgggactaatgtggtttttagctaacccagcaaagattgtatctccagtagtgtatacatgtgcaacatcttatatctatatgactccatctgtgtgaagcatgcagcgctgtcagctatagctagtagtagtaccatactaccattatgttttacgttcgtttgcttgctcgtgcatgcgacttgtgcacaacgtacgtactccactgaactgatcaacacacacctcagccgttctgcgcgcagg

SEQ ID NO: 49201 - DNA, 1501 bp, Oryza sativa
aaccatatccaagcatatatgatatggttgttaagagaaatattatttggaaaaaagaagagcatattcaccattgtcacttcctatcataccaaaaatttggtgttatcaaatttcagtacggtgacaacctaaacatgatcttacccaattgcagaactttcctctaataaaaacgctattaaattttaggatgcatcaaactaaatatatctaactttaccaaaatttggcaacaccaaaaattaacattgttaaaatttggtaaggttaatttgggaacaaagcgaataagcctgaaatgttatttgccatttggaaccataatctcgtctcaactcatatatattaattgtttgatatatataaccctttgttatttgtttggcattatatatagatctgcacaagaaaacaaaaaaaaaacataaggatatatccacagaaaatatccagaattaaacaaaagaaaagggacataatgggtacataataattaagcagaaggttctccaacatccccactataatctgttttccactgatgagaaatgtctgtcgtgtgtcctatacgtacatatcaaagctacctaccaaccactgttactatagctagccagtactatatctactcccataattaagcatagaggccccatttgtagcgatgtgatttagcgatcctaccaatatcatgcgtatatatgcacacgtgccaattagctgcaaattggacaattactactcccttatctgtttccaaatatatatatatttgactattcctattattgaaaaaatacaaatgtaaaacatatatcgtatataaaatacctttaataataataatgtcatagtaaaataaataacatttacatagtgttttcaataaaaataaatggtcaaacagtatgtttgaaagttaaacaagcttatatgtatttgaaaactgaggtagtagtatcactactatagaattggtcatcttgatgctgataatgaagatgttttgggttgattttctacatgtatgatgattcactacttcaacttgtttgaggtcagtctaatatctgacagggtggtgcactcatatgtgaagtgtgctaattactactcgtcacaattgtctatcatcattaatgggtgttgacttgtcataggaatgaggtattctcatcggtgaccattgatctgttatgtactccctcagtctaaaaaaagacaaaccctggtttccgtgtccaacatttgacaatccgtcttatttgaaaaatttatgaaaaaaattaaaaagacaagtcacgcataaaatattaatcatattttatcatctaacaataataaaaatatgaattataaaaaaatcatataagacggacagtcaaaattggacacggaaacccagggtttgcttttttttttgagacggagggagtaaccaatagccatcataaatgtgggttatgactcgttatcatgaatgctaattccctttagt

SEQ ID NO: 49202 - DNA, 510 bp, Oryza sativa
ttttttttattgttttcttatgaaactcccagacgtcaggtttttatacagaatctagcttttgggtcactaccatttcgcccctcagatacaccctctgttaaaaataatctaacttctgtttgtgtttcttaataagtaaagctttactaaattcagctcattacgttaaggtgatacaagtgtatcgagaacactctcagtctctgtacaacaaagatacacatagccaaatgaacattctcaaatttacataaattggagtacaagaagtattactggccattcattttaagagtacctccaacaagctctctatatgcccctccaagcataaaacttagcaactcggaaaaatcagtcctccaacagactggccaaccagattaccaagccatccggctagctaatattggatagtcggtatccctgacccagcctcgtcaagtgtgggtccacgccatctctctcctcaacccccttgccataacttgctagcaacacttgata

SEQ ID NO: 49203 - DNA, 1501 bp, Oryza sativa
agattgggcgctcgaatcacccaatttatgatatcgtctccatcgatgaagattccagataacactagcatctcaagcaatggggaattctcgatgatctcctccagttggtactccccgcccgctcgcagccacacgtggtcgagggttaggctcctcaggttggggaatccggcgaaacccggcgggagcggcgggatgtcgcaggcgaagaggttgaggtaggcgaggcggtcgcaggagaagacggaggagtggacggcgaggtggttgtggatcggcgacgcgaggtcgagggactcgacgccgcggcgcgcgaggacgaggatccagtcatgggcgcggcgggtggtgagcttgtcgacgtatgcgctgaagctccggacgcggccggggcaggcagcggaggaggacgccgtcgacggcggccagcgccgcgccctcctggtgcgggaaggggaaagagatgtcgagggacgggagggactcccaccgccggcgccaggcgcgggagagcgcggaggtgcggacggcgtcgcggaggccgagccgggtcaggacgccgtcgaggacgtccggcggcagggagatcagcgcgtccttcgcctcctcctcctcctcccccccgggaacagcagcctccgccgtccgacacttcttgtgacggtgcggcggcggcggcggctccattcctccggcggtttcgaggcagtgcactctttccgccgacgcggtggaacaaaatggcgcgcagctgggtggggaaggaaaaaaaagcgcgggaaaagagcactcgcgtcgcgccggcgagatcatgtgaacaagcgcaactacgggccacaccacaagcacataagttttccggcccaaaatatcccgctttccaaaatctccatgtcaaatattctagttgaaatttatcagaatttctagtttttagtttgattttcgtgtttcctactaattaaagtgggatattgattattgaaggggtttctgttcaattttctcttgacagctgaggcatcaatatccatgtccagaacgtattcggcaattgattattcgcgcatcaatatccatgtccagaacgtattcggcaattgattattcgcaataggacactgtttaattaggtcccttttaaaattattaaatcactagaaaaaataccagtgtgttacaacgggtatatgctatttaaattttattgttgttatatggtttagctaggataaaatttactgtgtgaattcgcttagatatttttttcgaaaatcataagctgcaagagtccgtatttcatctcaagttagcatgcgggtttttttaatgatatttcttatatgtctccttttatatttccaaaaacaaatgagcttaaaatacaatttaaaaacggatctgtatttctaaaagcgaacgaacttaaaaacctacttaaacatggataacctaccaaaatactagtagaaacatctttaattatctttaattttta

SEQ ID NO: 49204 - DNA, 660 bp, Oryza sativa
cttgaaatccgggctcgaacagaaatccacaatcgcaactatacgcaactatacacaaccaattaaagacctatacaagaccaaaagaaagatcctatttaggcttcgttcgtatgtgcgagtcctgatccggttcatgttccgtgcactggaagcgtggtcccgcacacagtaccagaaggacggcttgtgaggcgacgttaacgtcgttaacggatgtgagaagttgccgttgcgcctcggcttttccgtcagagtcagggcatccaatgctctcgatccctctttcttcctcctctcgctgttgctatcttgcttccgcggtcgtcgatgcgacgcaggcctagcggagaatcgattcccctccgctgcaggctcccgtcctccccgattctcgccagcccccctcctcccctttcgactgtggcttgcaggcccgtgccccccccaatcgattctcgtccgcgcgtcgtcttgcggcagcggtcggttcaaggtgctcaaaatcggggggaagtggaagagctccacgcctgtcgagctgtctgcgtcgtcctcgaggggagtaaaagctggccggcgtgctcgctgtgaagcagcaagcatcggcgcccatcaggccgcccatctttggcagtctggctgcctgtgtgctcgtcc

SEQ ID NO: 49205 - DNA, 447 bp, Oryza sativa
cagggtggttagctttgcagcagccaacagcatcaacttacacaatctgcatcttccactttttaggacaagtcacctcacgctcaccatagatgctctgtgaaagttacctgcatcttcagtagtcgctgctattatctacactggaacaactactataattctctattatcctttgcttgcggtctatctaacttcacttgctctgtaagcacgtgacctataactgcttatcattgtcctcagctccttttgttatccataagctgagtgaacaattaaccactttatgtacaaacagctggcttgttatactacagctactatggtactatttgttgtttctttttaccatatgctttttagcttttcttagttaagagaacgtgtgcatcgcatctttccatcgacctgtctacaggcggcgcgccattggcgcgccccagc

SEQ ID NO: 49206 - DNA, 1501 bp, Oryza sativa
ggaagtattaatttataaaacaatactccctccgttaaaaaataatcaacctattacgggagagagtactcgattggttaaaaattttatgttaccgtttctatcccactttatagtttaaaataagtgagaaaaaaaaatgtgctactacatggaaagatgtttatagtgattttccctttcttgggagtctgaagtccatgctctagaaagtggactagtcgtagaattgtagaaagcagaaacgatcatgcaagaagcttctattgaaaggccatgagaaggtcaccgtttcagcggcgcttaaatatcgtactaatcactatcagtagctgtacctgttataattaattctatgtatgtaagcgacccgcgttgcccgttttacaaacagtgccgcacctgctgttcgattggttctgcacatgtttgaaagctcaaactaaataatactaaaacagcattacataatttggaatatatatatatagtggcctctgatgattgggttcagtttgagccgcgaactgctctttatttccagtggcaatcattaaacaaggctatacaaagattacagtgttaggtataatctttttcccaatatgttacttagtggagaattttatcatacgaaataaaaagcatttgccaatgttcttgtcgaataaaaggttcatgcatataagtgccactggagaaaaatactggatggattagaaaatgaccaccactagctcctcccgggcttagtggattagtacattccagataggactttgagatgatatttgtgttcccttggtttatcagttgggcaactggcatcgcatcaaccacaattatctttggccaatggagcatcaagttttggatagggcagaactttaacaaaaaggcatatctcgatttgttcaaagattaggcctaaagtagtagttacagtaacaccactacagagtttgatgccaattatctaaccaggcgacaccaacctttgcaatcgattagcccgataattaatttgtttacgaatatgcattttttatatttgttaaatgtgaggttaaacaaaggttaattgctcaagcaataaactgatggaagaagattcctcgcggacaggggcaatagagtcatttcgaaaccggccgcctttctataactggggagcaaagggtcccagattcctcacaaaaatccacaccgcaaacgcagcagtagaagcaaccccacacgctcacaagtcacaagagcgaagaagatttccccaatttctttcttacccttgccgttgctcgtcccgcgagaggcagcatccaaatccgccgaatttaatcgcgccaagaccgaattttggccatttttcattcaatttttggtccaggaaccccgaatgcgccgagttcacctcgccaagacatcaaattcgtgattttttttttttagtttgcgagttcgcgtgtttcgagctcgtcggagggatctcggggtcaggcgg

SEQ ID NO: 49207 - DNA, 1334 bp, Oryza sativa
atcccttatattatgggacggagggagtagtatttttttaaggatgataaaattacttagtactatcttttgaggtgcaacatgtattggtaatcctgttgtgctaataacaatagaatccatcgaacgaaaaagaaagaatccgtgctatttttctaaatatcttccctgaactactgaacctataaaaaaaagttacggcaaagtgtgctaacaaacgggggttgctttgataattattgaactgaactttcgaaattacgtgtaaaaggctatcttaccagacaggaagtaccagttggagtctgcttgtctggcgtcaggactcgcaaactctgattcaatcatggtcttgaaagtaatcggggtggatgcactttccaattgtgctgctttttggtaaatagttttaaactacgttgaatggggactggcagatcagtatgtcggttaagctggagattgctaactctcgagtacagtaggtgagaactggagaactttcaccacagaaacgattacaaaaatatttgaaaatgttaagcatgggacttaaattattgcactcgtgtgacatgcgagtaataaaataatggagaatctgacattattgtctaactagggtgtgttcgctactagaggttcccaaccaagagcggtgcacgcggaaaatggagcggtccattagcgcgtgattaattaagtattagctatttttttaaaaaaaaatagatcaatatgatttttttaagcaacttttgtatagaaactttttgtaaaaaaacacaccatttagcagtttgaaaagcgtgcgagcagaaaacgagaggggaaagttggaaccggcagtagtgacgaacacccctctagtgctgcttgcataatctgtttcggttgctgataatggagcctttcatatctcctgtctatttgacttgtacttcctccgtcccaaaaataggtgtccagatttatcgttagaattggacttttttttttggacggagaggtatctgtcactactctcaaataagcatacaattcaattatcatatgtctttcatgaatttattctgttacttttcgtccatttggcatatattcttgctactccacaagtatagtggcaaatatgcttcacataccaattgacaaacctatgttgaaaatgttcctggaatgttactttcgattataactttatatagtgtgaccgttgtagaaaaggtgcctcatttcaattatagcagacaaagtagaaaaaaggaaagtcacgggtggggggggggggtcctataatcagatcatttgagtgacctttaacttattctggc

SEQ ID NO: 49208 - DNA, 661 bp, Oryza sativa
  unsure (1)..(661): unsure at all n locations
ccgagtcaaaatatgcattgtttggaagagctgtggatttaggagaagctgcctaaataggaacaaaatctgcattcaaatattgccaaacggcatgacgcattttagttttagtttccatgtcaaatttgagcaaaccgaagttaatagtgattagtgtactaacaacgcgtcgtttttaagtgagagtgattatagtgataattaacagcagcaatgaaatggaagtgaacatgtcccaggtggcatatagagccgtgaacaaaggctccagtccagccaccggcggcacgccggcgacaccaaccaccagcccaagcgttcggcagcggcgacgtcggcagccacgcgtacagtggttggtcccacagccgaggattcaccccaagacgcgggatccactggaacaagaggccggccgtcttcttccagtccagctaccctcctgcaccggaagattccaccgagacacattcacctcgccagaaacggacatcccaagattctggtccacacacacagctgcatgcttggaagccaagcaggcaggcagacaccggccagctggcagtagctgacgtcactgctgctctcacagcagctctgccgttgacaacttggcattgcttccatcacanagatctaaaacaaggacacaggt

SEQ ID NO: 49209 - DNA, 267 bp, Oryza sativa
cagcggcttctcatgacgttaacaccgtcggatccctctctcgaacacgtggctttgtctcatctcttagatcttcattacccaggatgaaacgttttctccctcctttgcatcttcagttaactgaaactctgaactttctgaaatttcctccattcttcttacgagtctgacaaccgccgtcttcaacttgctggtctacccgctcgctgccatcggagtggccggatctgatggccatgacctcaaggccgccggatccgatgc

SEQ ID NO: 49210 - DNA, 828 bp, Oryza sativa
aatttcttttgtgtttttcatttaaaaatatattggttaaatgaggtatttcttgatttggttttaatttaaaaccttccttcgactaaaattcttttattcaaatttagtttcaaaacccttactattttttatggattatgatccaagaaaccttcccaattttgccattgaacctaaaccaaagtaattctaattttatcgggattatttgttagcccatcctttgaccttaaacatatcctttgattcttgatccaaattcttccttttgatctagccggtgatctaatttctgtggcttgatttccttctcggcacaagaataatattattacaaacattgtgaataattgctcttgtgctaagataatatattatatccttgtcatccaaatcttctttaaattcaaattctatccaaatatcctattagcctcagacaattctttgaaacccatgccatatattttgaggctaaaaatcctatctatcttcctccatttatttcctctccctctcatttgagtgcatcaaataaattccgttatattctatctctcaaaatattgcactcaaactagaaaatatctcttttggaaattatatccaaatataatttcctttcaaaattccctattcagattccttccaaatactaatctcatccaatttctatcatacaaataacctacaaaatttagaattgatttctaaatttaattgggctaaaatccctttatctcttccttttggcccatcttcctcttcggcccagcccagccgagccgccccttcctcctccgtgggcgcttccaggcgccgcca

SEQ ID NO: 49211 - DNA, 164 bp, Oryza sativa
ttcctgcagccctggcatttgagctcactcgatcgcctacataaagagcgggatagcttcgagctacggcatgcaattcgtctccagcgccctggcgacctagctagctccctcctccgccattgccacagaacacaccttggtgtcgtgcaatccatcgctca

SEQ ID NO: 49212 - DNA, 152 bp, Oryza sativa
cctatcttaagacaatattgatcctatgtggtactcatatggcagcagttccatcatgtgacaatctagatggttagaatacctctaatccactatgttctttctcctaaccccttctcaagttctcatcctttccttatctcataactagc

SEQ ID NO: 49213 - DNA, 371 bp, Oryza sativa
actgctagatagcattccaaatgaaaacataactttgcattctttttggtgttaggactaatattacttcagcatcacaaatgcacacacaaatacacaacaagctagaaaatgcaagtacagaacacaggagatcacaagatacaacagatccataaacaaattcattgtgttatttacatcatactgatgcattgcatggatatgttcctgacaaaatatgctttggtgaattcacttcctgaattggaattttatttagtattttatagtcatttcatagtaacacttcaattgtcagttatcttgtgcaattgtttttgtactgctgaagattgatgtatctatttctatttatgtttgttaacaga

SEQ ID NO: 49214 - DNA, 165 bp, Oryza sativa
agaggatgctaatggcggagaggccgatgagctggtgggagacgtggtgaggccaacggacaaaggaagaagtcccattcactcccttcctccggcggctgcaggcgttcgtggaagaggagcacgaagacagctgggacacaccttcccccatgcgcttgcagt

SEQ ID NO: 49215 - DNA, 643 bp, Oryza sativa
caccgcggtgttttgtcgctctccaactagggatccccccattttctactttgtgttatacaaggatgtctagttcctttggtgtacttaaatacttgcctatttgttactggagaaaagatgatgtgctcatggcaatctcccaagtcccaatcattggtgctgcaaatccttcttctccattttattccactcttttctttatccagaagactgattggaaaaaaacaacccatgctcaagcaagccaagcatgtccataaagcatttagcttagggtttcctattgatcaaattcgttaagaccctattgtatttgaaatttcctgtggagaaaacagtctcaagttgtgaattccttctggaatatttttaatagggtgtgttatgctgggttacctggaatatgtactgaatgctggaaagaggtatccaaaagaatgaaagagaattagtgcctgcttacgttagcagtcatgattactgcttaatgatatttcctacttagttgcttcttttatcatcacataagactagttagaaactgtcttatctatttgaactttgcctgcataagagatattatagcattaaaatgatttaatgggagcacttatggaacttgattaattgccctttcagg

SEQ ID NO: 49216 - DNA, 609 bp, Oryza sativa
  unsure (1)..(609): unsure at all n locations
cttcctcggctggagccagcagttcagttgttcggctgccgccacccctgttgccaggctccctacgaaggccacgagcctggnttggnaaacnnaaatcatgnacttnatagtttggtttgcattatgcattaagagaagtgatatgttatgtattgtaggaggtagtgtgcatactagttccatttcattagaacagtaggctagtaatgcagctcgtgttgcacaaacagcacaaaagttagtaaaacaagattagcggcaagttagttaggagcatgcaggattagtggagcacgttgtggcgtggctcgcggtcagcccggaggagcgaatcttggcgtaagatgcgcagatcgttgtatgagtgagtggctcgtagtcgtgcgtgcgacccggccgggctgttagctatgtgcatgtacgggaggctatataagccgtgtaatcatcagttagttttagcagatcagcaatatcagagaagccagcaaagacgtgcgtcgccgacggaatctgttgtgtgtgtgtccacccaatttgctgctcgtgtgtgttctcccgtgagtttgttgcttacgtgagtttgtgattttcttgggccaaagc

SEQ ID NO: 49217 - DNA, 1087 bp, Oryza sativa
agacatgaatactctcgctgaactgtcactgcgagttcgtaactgggatggcatcttttctgcgtcttctactgtagcatctatgatatgaccactctccccagcaccactctgttgaggtgaagatattactatgctcaaggtatctgcattccaatgaagagaagttttccttgtacttaagctggacgctgcaattttaatgctcaaaccctcatccggagaccacaccagctcagagacagatctcatgccgaatattatgactgcatttacacctgcacctgaatgccaccatatgccttcagtagactataagataagaggattttttttttagctaaaagataataggattatttgcaggacatatggcatgagtctgtttttcttttacactggagcatatcaaataggaccctttgaaaagattaacagataaacaaaaagaaaattttctgttcatatcatagcatacatgcaaggtagaaagtaattataaattagagttcccctacaaatgacaaaagtacatatttttcttatactgctgtataataacaacgcagttgggcatccatctaactgataagagtcatagtcaagagtcaagactagtctattataagttcttttccactcatatgcaagaatcgaactatcctaataaatgaactagtagatgcaaaaactccaatcttgttgtgtctttttgtccaaaaaagcagatattcccagcttcttgatacctttcggtcttagctagacccaaacgaatccgtggatggatcagacgaccaagataaagagtaaaaaaatgcatctacgctaatttgcaatttttcgttctttcaaaaaatttgcaatttttcaccttctaaaaaaaagcctgtaatctttctacgtgatatgtaaaaataaaataaaataaaaactaaagctctacagaaaaagcagattaaacagcacaaagaaaccatctacaagaaaagacgacgtagtataatagatttctactcaatcatcaatctgtgatgcagcagcccacctcggggagtagcgcatcaccaccatctcatttcacagc

SEQ ID NO: 49218 - DNA, 574 bp, Oryza sativa
cctgtgtccctggaactactgcaccaccaccacctgctccccctcctccttgccctgcattgttcagataaatacagttacttaattacttagaaccaaacagatggagtgatgatacttccaatgcaaggatcgtaaaattccttcagattatatatgctgaaaaatccctcaatacccctatctggaaacgttaaaactatggcattttcaaatttaaagctgatcatttccaaacaagaccaaagtcctacttttgaacaaaaagacaagaagccatgcatcccatatgttaattaaaagtggatctaagatagattaattacctctacagctggagataccaatggagaagagcaccacagtgaggcacacatgtctgagcttgagacaggccatggcatgcaaggacatgcaactgaatgaactgatcaaaattcagttactactccctcacagcttgagattctgcttctagcacacctagcctgcagtccctctttatatgtgcaggttatgcaactgaattggcaacaaagctgcttataaaatgcagcactggattaaagaagca

SEQ ID NO: 49219 - DNA, 428 bp, Oryza sativa
aaaagagagcaagagagagacagaagaaagaaggagagcatgatgatgtgttcactggtagggtccacgtggatcctacgctgactcagctaccacatcagataaaatcggggtcaaacccaccaaaagacctgtggtgaacggttttataagttaaggaatgtcatatatctgtttttgtggttggggaacaataccttcggtgtactttttccttttgagaatgatttatatttgtattatttttatgtggcacttaataaatatgtttatatccgtggataaatatgttctattttttttgaggaaaaagatgtggtaaatatgattaacaaggtcaactcctttcttttgcattgtactattggagagttgtgtatcatattgcaatacaaaaatacaagatcaattcgacttttcgacctgaa

SEQ ID NO: 49220 - DNA, 338 bp, Oryza sativa
aaatagacacactattaactttttttgaaaacaaacaatgctcatagccaaaaaggtttattttttttataataagttatcagatgttcaattcgctttttccataattacagcgtggacaattgttctacaatttggtcagcttaggataaaattaacataatagtaatactgcattttttttcttatatttaacattattattacaaattatgcatggccggtgatctcctctgtctgtatattaccagtgtcagtgacttttgagtgtcgtacgttcgctcatcacccaactaaatgaagaaaaaaaacgtttaattatattaattaatcttgtg

SEQ ID NO: 49221 - DNA, 385 bp, Oryza sativa
ggcatctcgctaatatttgagagcactcacagcaaaactcgccgaatccctgagaccctgactcccctgttgcggccgtcgcgcgtgcgcggtgcgccggacaggaggctagggggtaccggcaccaggcaggcaggcaagtacgcccgtgggacgagcagggagctagccgggtaggaagggcgcgcggcgatggagtcggggccgcgagcgccagtcgtatccctacgactacgtgctgacacagcttgccgccgtgccgaggcctggctctggctgatttccgtcgctcgtgctcgcgctgatgctgtcgctcatatgccattatttctacaggcaggcaagaccggaacaccaggcagtagctactcattgtgctgctagc

SEQ ID NO: 49222 - DNA, 218 bp, Oryza sativa
aagtacgattttcgcgtgtgggtgcttatgtcgtctgcacgtaaaaatagaaatccgaaaaaaagaaactagaaatcacgaaaacataaccctagaaaccgccgccctcctcgtcgtcgccgtcgttggtcgaagccggctaggggcagccgggtctgcccgctcctgttgctggagctagagccagagccgaatctgccattccagtgcctccccaa

SEQ ID NO: 49223 - DNA, 211 bp, Oryza sativa
gcgattaaaaaataatttgttttaatttttttatatgtattcttactatttaaaagctaatactgaaaaaaaagtggtgaaaacatattaaaattaacttcaaattaagttaagtttcaaacttaaattttactttgacttattatttttttatccttttaagaccaccaacggggctcttgattttttttattacccatatatacgtgca

SEQ ID NO: 49224 - DNA, 160 bp, Oryza sativa
tgttgacgatcgttaatactgattttgatactcagtatcataataaataaatgtgaaaactttcgatggcctgtaacaaaattcaaagatcaactttcgatgatatgaaaccaattttgcttataaactatatcagtgatgggatcctatggcccctagg

SEQ ID NO: 49225 - DNA, 207 bp, Oryza sativa
  unsure (1)..(207): unsure at all n locations
ctgaacacacaattcgtgcagaggggaaggcaccatttaagaaatatnnnnnnnnnnnnnnnnnnnnnnnnnnnnnnnnnnnnnnnnctccgggaatacgcggggtatcatagttacgtagaccggtgtctgatgatcctcctttactaacacatttttcagcttctatcctcagatttctcattctctgtttcacattttacgcca

SEQ ID NO: 49226 - DNA, 1457 bp, Oryza sativa
tcagcagtgaacctacctagcttggaatgccagaaatgagcagaaccaccaactgaaagacataataagatgaaacacgcgatcgattgatcgaagagaaccgaacaagctagacatgagaaaaaaaaaggaacataaattaaaacaatgaaattaagacaaaattaaaccaacagatatgcgggtcaccaaaatggagtatttgtgcctcctaaaagcacatagtaatgaataaagttattgaattattgttgtaaaaacaacagaaatgcgatggcagattggcatggataacgagcaaaactttgtcttcctatgtgtcctcctagattttgctttaggaaagatagacttgcaaatataagcatagacctgggaattcttttttttttccttgtgaagaaaatatacctataattatttttcacggaactaattaataccagtgaatcagaatctctcgtcgaggaattgcttgggagaaggaggattttaagcatatatggacacaataagatcgatcaaaattttagctcttggattcaaattttgtaagtgtacaagagaagagacaagagaggcggtgagatgttgaaacatgcagaaatcagggtatatttgaaatcagggtatatttattcgagtgcatgcataccatatacgagcccaaaatttatgccggttttgggccaaatacgggccttccgaacagacaaattatggtccttatatatttgcggtggatatttctataggtagaaaataaattatgttcttaattaataaatctatatactaatatatggttcgccatttttatatattaagatgccatgtcgagcacaatctaattaacatagtacagtataagttatcatatcctagctgccaacgaaatataatcaagatgttacctttcaaaattcaaacagaaaagaaggaaaatcgcagtatacatatagtagtacctctggtatcatataattaaccggaataaagtacttaccatacgacacagatacctttacataactggtgcaattaatacttttgccaaaaattaaaaaaagaaggttctgccttacaaaaacgccattagaattccataacacgatggggatcgatcgatcgatcgacgtccaacgtcgcacccgataataaacttaccaataaaggaattaggtaccaaaatttttttgtacctgaggtactactcccgtatctaagataccaaattttacatttaaaaatatgatacctttgataccttcttaataacgatgataaaattaccctaccaataattacaacgcacattccatacttatgcctataaaaatacagctccatcgcatgcagccaagacgcactcgcccatcgtcgtcgttgcacgaagctagctagctagcatcttcaccgccgcacaagcagacacagctagacgacgtcgtcaacaa

SEQ ID NO: 49227 - DNA, 326 bp, Oryza sativa
catatatttggatgctttcttgctgaatagggcggtaggttcaggggggcacagctctttctgttgtgtgttgtgatctttgtggttgcttcagtgtgtgttctgaaaactgcacaacttcacctttttatgcattgagatatacacaccagcatcagagcatcttgcaactgattaatttgcacttgttattatgatctatctattgattcttctcagagttcgagtacatgtgtttcagcaactgaaaagctagctagctcctttctaagcctgcattttgcatctgtttttttattctttttttattttttttgcagggtagt

SEQ ID NO: 49228 - DNA, 349 bp, Oryza sativa
ttcactccccaccgttcccatctttcttggtctctctttgtcacaccctaattttcgttcgggatcaaaaattattaaatagcgcatatctagaaattatgtaaaagttaattttatcaagtaaattaatgagggaattaaaatttccttttaaaatcatggccgaaaatatttttgcaatatcctttgtgccctaaatattctctgaaatttctcttgaatttttggagctcaagaagtaattttaaataaaacaaagttcattaaatcaattaaattaaattgaaaaccaattaaagttctcccaataaaggtgcagtgttaggggtaccccaagacgatgaaaaga

SEQ ID NO: 49229 - DNA, 1501 bp, Oryza sativa
taccatacgacacagatacctttacataactggtgcaattaatacttttgccaaaaattaaaaaaagaaggttctgccttacaaaaacgccattagaattccataacacgatggggatcgatcgatcgatcgacgtccaacgtcgcacccgataataaacttaccaataaaggaattaggtaccaaaatttttttgtacctgaggtactactcccgtatctaagataccaaattttacatttaaaaatatgatacctttgataccttcttaataacgatgataaaattaccctaccaataattacaacgcacattccatacttatgcctataaaaatacagctccatcgcatgcagccaagacgcactcgcccatcgtcgtcgttgcacgaagctagctagctagcatcttcaccgccgcacaagcagacacagctagacgacgtcgtcaacaatggccaccggcgccgccgctgccaaccacggccgctgctccctcctcctcttcgccgccatcgccatggtgctgctggtgttcgtggcgacgacgacggccgcggcggcgcgagatgttcgtcgtcccgccgccgtggagaagaagatggcggctgtgatgaggcacgatgtccccagcagcgggccgagccccgtgcacaacggcgcgccgactcctccggccgccgccgacgagcccacggtggccgtgacggagcgtctggttcccaccggatcgaacccgttgcacaacatgcccagtcctctacaaggccgcacaccgaccaagaagacggttaattaattgagatgattccatcatgctcaattccaagtggttattaattaggaaatttaattatatagagaaattttatagttcttgagtattttttacaaatcttcgtaccttatatagtatcggaaatataaaatttggtatccctccgtaccttctcgaggaccgtaaaatctcttagatagatatgcatgtatcacagatgcttattataattattaatcaggtaccatacaatatgttttgcgtgagtaataaataaataaagagatttgcccctagttagtcgtactgttaatttatcatgtgcgtgattttgtatttggttttaatttgtgtgcaatggaagattttgagtttgaaattttcaatattggtatgttgcgtacttgcgtgttgtgttatgcgcctggccggaggtttccttgatattgattgatgatccctcttatctgacgatgtttgccacgtacgcattcaccactaacactgagaaactaattattttttttgatagactgagaaattaattattggtaacatatcgagaggattagattgcttgttcgatgtcaacactgagaaattaattattggtaacatatcaagaggattagattgcttgttcgatgtgtggaatttgctggtttactgttcattcttatcaaattcgctttaataataataataataataataataataatat

SEQ ID NO: 49230 - DNA, 991 bp, Oryza sativa
gattgcttcgtttggtcgcgtctccgtatagaaatggcaattttcggttcactcggtgtatgatgcgattgtgaactctagtgtgacggtccgcaagaggatctcttatataggaggttgaaggtgccactgaaaatcatagtatttatctagttgtttcatatcaaaataattctaacaaaggataaccttgcgaaaaagagttgcgaggtgataagcaatgttgttttttagtgtgcaagagacaaccaacccatattctttgaatataacatagcacgtttttctcggggatgtgtattctttgctttcaatattactagttgtggagattatggataccccatatcaacataacagttataatttagtcggatatacggtaccaaatatagatagaatatctttatgaggactcgggttagtttctaacttgtatgtcaaggaaatacccgagatcttagtcggttacgattgtattttatttgtaatcgcatattccgttagggatatggactgtattttgtaatacggatcccttcccctatataaggaggggtctgggttcctctcgggatgattctctttttcccaaatcatacgatcaataacatactcggcggaatcatccccggacaggagtagggtattacttcttgaataagaaggcctggacctgtataaaattccttgtctccaaacccatccacttttctagcttgatagccaccccttttagtattgccgaaatcttgtttcgacactacttctcggagcgccaaaaatatatttggaaattggtttatgggagtgcccagcttaaacaaaatggttttatttgggggccagtagtctatgatcaatttggtattactgaaatgataatattttttataataaaggattggctaatctatacatattatcttcacatctaccagctagctccacatttgatctttgacgctatcataggagaagcagaatatta

SEQ ID NO: 49231 - DNA, 368 bp, Oryza sativa
tttgcagcaaaagttcccatcaaaaaacatccttccaaaaagcgcaagacgcgacggtccgttcgttcatgcctgtgcacttgcaggcagcagttggcccgatctgggccgtccgattatacgccctccaaagcctccaaatatccttctccaatcgcaacgggcgcgcagccgcgcactagaaaattttcccccatatccccccagtttttgcctccaacccaagcctcctcctcctcctctctctccactctcctcactccctctccggctctccctcacctgctcaccgcagtgcacaccacaccatccagcgaacggagccactcctccaagactcactcactctctctctctctctctcttca

SEQ ID NO: 49232 - DNA, 449 bp, Oryza sativa
  unsure (1)..(449): unsure at all n locations
aacgacacaaangtccacggnataagtaagaacaaaggtgaagcagatctttgagcgtaaccaaacctcatcataatatccactaactattccgatacctccaccccccccnccccagacagcnaagtagaacgnctgatagnaaccnncnnnnnnnnnnnanngaannaaaaanaccnanaacaaccacaaacacnnncaaaaaaaaaaaaaaaaagccnncntctttttttttccccaaaanaaaaaaaaacaaggggaacaaaaaaatacgaaaaaagagaaacaaacaaaaaaaaaaaaaaaaaaacaaaaaaaacaaaaaaaaaaaaaaaacgaaaaaaaaccgaaagaaacaagaaaaaaaaaaaaaaaaaaaaaaaaaaaacacgacaaaaaacacaaaaaacaaacaaaaacaacaacgaaaacaaaaacaacaaaaaaac

SEQ ID NO: 49233 - DNA, 175 bp, Oryza sativa
acatatccaacacaatttaacatttttactgaaaggcaaacaagaatgtagaactatggtatatgatctgaaagtatatttaatacatcactctctaaattgcttcactttttatgtaattattttcttatgtatcatatgtaaatactgggctgttgcattcttctattacaga

SEQ ID NO: 49234 - DNA, 1501 bp, Oryza sativa
ccccattagccaagcatcaaacatatgagatatgttagtaagaaggttaaaacaaaatgagaactgaactgctcttcatataaactttgcataatgacagtccataaaaagatgttgaatagtctcatttttcatacaaacatcttaaactactattccaattccgtcttgccaaattgtccttagttaacacaacatctttaagcaagtaccacataaagatcttaatcttaatcttaagtggcatcttaagcttccaaatacacttattcctctcgatgtaaccattattaattaaagctagatacattgacctaacagaaaaccgaccattctgatgataattccatctaaaacagttagaagaatggttcaactggatatgcacattagaagcacacaattcatgcccatatgcaaggttctgcccaactaaggctctcctaaatgaaacattaagcggaacagctcccatgacattagcaatagaagaggttttccttcggacaatagcatatagagatgaatatttatccttaaaggccaaatttcctagccatttatcttcccaaaatcttacttgctccccattattcacatttcaggaaaccatatttaagaaatcacttttgaccttcatgagacctgaccaaaaatgagagtcgccttatttcctatcaacttgcattatagacttattataaagatacttcctcttcaataattcttgccaaacaccttcttcatttattaatttataaacaaccacttactcaaaacacatttattttgaatttccagattgtgaatccctaatcctccctggtctttgggttggcaaatgatatcccatctaatgagtttgtactttttcttatgatcattcccttgccaaaagaaacgtgatctataataatcaaatttttgaagaacacctttcggtatcttaaaaaagaatatcgtaaacatggctaaacttaaaagaacataattaaaatttcttattaaataaataaattcattacttataaagaataatataatacttttacgtaactatataactatttagcaacacacaattacacagagaaaaaaaagctattttctcgtctgtcttttttccaaccaaaagctattatacctcgttttgatttagatagttctttctaaatttagaatgggcttcatacttggagttgttttagctcttcttgtacagtcatcatacgcctagtctaggtacaatctaggaataagtccacttaactctcttaactattggccgaatccgatttgtatccctaaaccacaatactggatatctcaacccccaaattatcaaaaccgttgcaattttactcctttgtgctgacgtggcattcacgtggcaccctagtcatcaaatatttttttaaaaaaggtggggcccacctatcatcaaatcaccctctatgtactaatctctctctccttccctctctgcctatcttcttctagg

SEQ ID NO: 49235 - DNA, 798 bp, Oryza sativa
aaattcaatttttggcttactacggtccaataaatccacttggatcgacttccattttatctatatttaacaaatgatacataaaataaaataaagttgaccgaagggagtacttatgccatataacaacaaaaagaaaaaaaatggcaagaaacattcaggataaaaacacagagcaatgataaaaataataaggaaaaatttaataaagaatgttgtgacttagcggttttagctgtagaacatcgtacaaaagtagcttttggaagaaaatactctacaaacgtaaaaattaactcatggatgccgtacctattaaaatattgatttctaatttgatgggagagaaacaatagttcacaactttcacattgttcctctcccctatttaatcataaatcacctttatagtgtttttttctaaagtcacttgtgtaatgtcgtacggtgaagatatcgaagtcatgatgtcatgtactcatgtaccaaattttgccaaatacctatgtttacgaaccaaagtcattgataagagtcacgtacgtgtaccaactacttaggcacttgggtagtacaaacaagacaaaattttgagctattttcaagtacttggacaatctacctatatattatgtccgattttccaatctgtccccacaaatcgagagaagggggagagatcagtacaagccgcaccatggcgaaacaaagcaacataattcttcgtgcttatcttttcctctctcgctcgctgtggatagcgaaagaaaacgaaacgaggaaaagaaaaataaaaaa

SEQ ID NO: 49236 - DNA, 635 bp, Oryza sativa
gcagaaccttgcatatgggcatgaattgtgtgcttctaatgtgcatatccagttgaaccattcttctaactgttttagatggaattatcatcagaatggtcggttttctgttaggtcaatgtatctagctttaattaataatggttacatcgagaggaataagtgtatttggaagcttaagatgccacttaagattaagattaagatctttatgtggtacttgcttaaagatgttgtgttaactaaggacaatttggcaagacggaattggaatagtagtttaagatgtttgtatgaaaaatgagactattcaacatctttttatggactgtcattatgcaaagtttatatgaagagcagttcagttctcattttgttttaaccttcttactaacatatctcatatgtttgatgcttggctaatgggggttgacaagaaaatgagtaaactgatacttgtaggagcatctgtcatatgttgagctctgtggttgagtaggaatgatatggtttttgacaaatcaccatctatttcttataagcagataattttcagagcaacacattggctttggttttgggcacaattacaaaagtgtgaagcagatgaagagcatctgaaagttgcgtgtcgt

SEQ ID NO: 49237 - DNA, 304 bp, Oryza sativa
tcattatgcaaagtttatatgaagagcagttcagttctcattttgttttaaccttcttactaacatatctcatatgtttgatgcttggctaatgggggttgacaagaaaatgagtaaactgatacttgtaggagcatctgtcatatgttgagctctgtggttgagtaggaatgatatggtttttgacaaatcaccatctatttcttataagcagataattttcagagcaacacattggctttggttttgggcacaattacaaaagtgtgaagcagatgaagagcatctgaaagttgcgtgtcgt

SEQ ID NO: 49238 - DNA, 1501 bp, Oryza sativa
gtgtttaatgcaggcttcaaggaaaggctgttgtttttgcaattgattttatttgaactcttttctgaaagcaactaagtgagtgcttctcaaacaacatggatgagacagtgcgtctcgtccggtcggagtatgtgcaaatgtatcagtctttagaattgatcaagattggcacccggccaacaactttcaaacggccacccgggccaacaactttcaaatggccacccgggcctagctgatcccatcagctgcagattttttaaacatcgaacccctttccacaacagcaatttcacaagtagtagtcaaacaaaactacactaggaatcacctcacatccgcccatgaccgtgggcacggctgttcgaacagtttgttaacctctgcagagggggtacactttacccacacgacattactaacccggatcacccagcccgtgtggatcagccacgtcgggagacctccaagctttcatgacaaggcattttcaaagccgacacaggtttaccatatgccgacgagaggggtcccagaccaacaacagattaggtcccagaccatactgtgccaggaaacccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaaattcatttagttcgcaagcaccgacccaggtgtcgggttttccaagtcttttgtaaaacccaagttttacccaagaagtttttcagattttaagtttgaaggcgatcgtcgatactcgtgcagagtgcacgattttcgaggcgcaactgggtggttacaagggaacatggtataacaattaacaaaggaaggatcaaatgcaacaaactaggtaggtccgacaatctgccttgcagacgggacaaacagattaagtgcgatcctatcaatgcataatatttttcaagcaacatgattaaattcaaatataggctcgaaatgttcaaaggtggcttgccttgctcgagatcttgagcttgatcctcgaaatcctcgcactgcgggtcttcgggctccgaaactacgcgcagaacgggacaactcaacaaacggcgaaaataaagccctattaatgacctctaagcatgccattagatagatcttaagatttgagggattttggaagttgaacggagtcaaacggatttacggttgggaagatattgaatttctaatattattggatttttggtctacaggaaaaggatttaattaaatcctttttgaaaaagaaaagaaaagaaaagaaaagagggagggaaattacacttccctcggacggctagggcgcggcccgagagaaaaggggcggctcggccgagctaaa

SEQ ID NO: 49239 - DNA, 181 bp, Oryza sativa
ttttaacagcttttacctaaaatggcagtggaaaaggataactactacaatctgcggcttgatgggagaagacctttttttttacagcaggatcgaaagaaacaaaatagttgatgttcacctttttcttttttgagaggatacttgggactgtctataaatttatcaacaattcatttca

SEQ ID NO: 49240 - DNA, 183 bp, Oryza sativa
gcgcccctctacctactctccaccggggaaaggggggaaaagaccccacttcacctttttggccttcaagacgtgccttctctcggaagctaagccataaccgatccttgagcggaacccagcgccgtcccccgcctgacacggtggtcagcccggtcattccctcataaatgatcgaagaca

SEQ ID NO: 49241 - DNA, 787 bp, Oryza sativa
  unsure (1)..(787): unsure at all n locations
atgaagttgcnnnnnnnnnnnnnnnnnnnnnnnnnnnnnnnnnnnaatcatagcttgcaactgcatatgtagggcttgggatccgttccatcaattggtccgcgggacatggaaagaaaaacttggatggaggtttcattttccagtgagtacatgcatgatccaaaattatattgaattgaatctctaattacagttaaaccggcacttcaaccatttttcccggtccaattacacacgtggggtgtgtttgcaaaccctttttcccaacccatctccctcatttttcgcgcgcacccttttcaaacggctaaacggtgcgttttttttaaaaagttttatacgaaagttgcttaaaaaaatcaaattaatccattttttaaaaaaaaatagcaaatacttaattaatcacgtgttaatggatcgctccgttttccgtgttaactgtgcacgttgggaaactggagtagcgaacacaacccatggtgggtcttttaactgaatcggatcggccgagtttccagttcagatgggaccgccggtctggtctgatcctcgataaccagtgacgatcctatatatactttcctcgggtactcggacctcggataaattaaccaattctaactaaattatatcatgttaattagtatatagataaaaaaattagataattaatatgtattggattcccgataataaaaccagtgttgtggtagacaagttcattaatacatcaacgtcaaacaacaatactgcagtgttcagcgacacagtaccagcagat

SEQ ID NO: 49242 - DNA, 702 bp, Oryza sativa
tataatactcccttcgttccaaaatataaaagattttgggtggatgtgacatatcctagtactacgactttgaacatgctacattcattcaaaatcccttatattttgtgacggagggagtataataggttatacttgcattggttgcttactttttaattgacagcctacttgatatagctagttagtaccaatctatactgcatccctgtagcctgtacatgttgatttatgcagagatgaaagctcacagaggtacagattgagcaggatcactgatgattgatgaaacaaccaacctacctgatctgatacacccatctaaactaaaagagcattactaatatttgtaataatatttcttcctacatatccacaatgactctcatttggatgttaattaaccaaacaatagatctctcagcctgccattaggcactgaaaatgttgcagattcatctcctcctgacacatgtagtgtgtggccaatactgacaatgactgtcaggtaacaaatcagctcaaacatctgtaatcacaattctgacagtgactaagcaacatttaaagagctcacacattattagcactaattaattttatttatcctaaaaaaaagtgcagtaattagctagcaaatccagcctatataatccccagccaaaactgatcatatcctccaagcttgaacgccaagatcga

SEQ ID NO: 49243 - DNA, 1501 bp, Oryza sativa
gcatatcacaatcttgacaattggcttcaagttgctgttacaccaggcattgaagaactcacccttatggtatgtagactggagataacgtacaactttccctgcgcacttttatctgatggggttcggaactcaatccggtatcttgaacttggcttttgtatcttccgtcccgcaactgaacttggccccttcagaagactaacaaagttgcatctgcaatacgtgcgtattacaggggatgagttagagtgccttctttcaaactctcttgctttagagcagttggcactcattcactgcgatcatataatttgcctaaggataccttgtgtgctgcagcggttcagctgcctgagggttcatggatgcgtgaggctgaaattgatagagagcaaagttccaaatctctccactttagaccttagcggaaaggcggaactgttgcttggggaaacattgcaaatgaagaacttaagcatgcgccatccaaatgttgtctgttatgctcgttctgagcttccatccagtatgccaaatattgatactcttgccttaagctcctatgatgaggtatactctaaaactttgtgttgtcgattagcaatgtatgtgtatcacatggcttttgaataattgatctgagacgtggcatattggttgcgcaggtggttaatacaccaatgctgcctaccaaattcctctacctcaagcacctgaccatttgtttgagctccggaaccttttcgccgtcctatgactatttttctctggtttctttccttgatgcgtctccttccttggagactttgaacttggatgtaaagctctgttcatcctatcctgcaaagttatctggtcactgtgtcaggtcaattgactatactttgttttcatcttcaggtaacaaatgatcctatgaagcatgaatcaattctaggacattcctcaaagtcacatttgaggcagatggctgaagaccaccattgccacctcaagaatgtggagatcacagggtttagctctgctaagagcttggttgagctaacttgttatatcctcaagaactcggtgtcgctcgagtgtcttactttggacaccctgtatccgtatgattttaggtgttctgacgaaagatttgaacggtgcagaaccatgcgcatagtattttgagggaagcccgtacagcgcttgtggctatcggaagatacatcgaggataaagttcccgctagagttaagttgaccgttgtggagccctgtagtcaatgccataagttgtcataatcactcgcataaacgtaggatgttcttaacttcggatgagccatatgtttcttgaattattattggattagttataggaatcgagcaaatgtataatcgttgtaatttgatttgagatgaaaaatggtctttgttttttgaattatcggcaatatgggcccacacgagccctagtgggtgggcccagacggccctaccttccccgtcccatttcc

SEQ ID NO: 49244 - DNA, 1030 bp, Oryza sativa
cggtccagttttcaggacgaacatggtcgggcaagacctgatcgtgtgtctcgatccgaaggtgaacagcttcgtgttccagcaagaggaaaggctcttccagtgctggtaccctgattcgttcatgcggatcatcggcgccgacaacatcatcacgacgctcgggtcgtcgcacaagtacatcaggaatctgatccttcggttgttcggccctgaaaacctcaggcgtgcgatgctccaggacgtgcacagaacggctcaggccagcctgctctcctggctcgatcgaccgagcatcgaactcaaggatgcagtctcaagcgtatgtctgatggaatggctattacggattcaccccctttaattttttgcgattgcgaatatttcagttgaagtttttctcttctttttcagctatgtgtgaattaactctgactagagaaaatttgagtatgttccagatgatattcagcgtcacagccaagaagttaattagctatgactccttggcctcagatggaaagatgtggaaacaatttgatgctttcattcgaggtctactggcatttccaattggcattcctggcaccgcattctacaaatgtatgcaggtaaatatctactagtatatggtgatagatggttcagctacatgcatgttaacaaaaaggatacaaaacatagctggtaattggcagaaataaatcaacttgcagaggagaaataaatagaggaatttagccgctaagttatagcataattatatatccacttattattggtaaaaaaatatatccacttatcgatacagaggccggaatccattaccttaaaaaaaagttatcgcacagttttctactctcttcaaagttgacaatagtgtcctatatatatatatatcaatttgtaatcttaaaaggagatcccacatggagatggattcaattcttgcaggggcgaaagaatatcatgaagatgctgaaagaattgattgatgagaggaaggaggcatcagggcgacggggaagca

SEQ ID NO: 49245 - DNA, 704 bp, Oryza sativa
taagtaatgcatccgcacttcatcgtcatcaaatgataaatacaacagagcaaaaatgacccattttagttttgttctgtcccgggccaccaaaacctcaggacggccctatgcatatagatgcacgaatgcgagtgagttcttattccttcagtaacctaagctagctactagttcacttgatgatattgaaatcatggtacctagctagtaactcgttattactagctcctataataatgtataagtatgtatattaattatttctctatgccatttcattaattaattttgttgtccgtctatatctccggatcatcgtcgccggcggccttgtgcctctcctgcttcactcctgccgccttcagctgcagctcctgtccttttccccacaggaacgcgtagagccccacaatgatcagcagtgccccgatcacgctacacaaaaatagttaagaaaaaaaaagtctcagattaaacacgggtattcatatattttccgtatttcctaccctacacttagtaacaagtaatatacatgacatatatatagctagcagcgagagtaatatatatgctacgtagtatagggaatcgaggtacactcagtgtttaggtgttacttttgtaataattggctgtaactccgatgagcaaaggccgggatgttttattccattatctaaaaaaatagggaattgagc

SEQ ID NO: 49246 - DNA, 1501 bp, Oryza sativa
aatgacagattaattaggtttaataaattcgtctcgcggtttactaacagattttgtaattagttttttattagtgcccgaacaccccatacgataccctatataatttccgatgtgacatgccaaaactttacacccctggatttatacacccccgtagtaatagtaatcacgttcgaatcgagtgaattgaagacaatttgtagtaatataactgtgggatacacggtacacaccgggtacccaaggagaggcctttgggccgtacgacatagggtgggcaaagagccgtaggcacatgcggcatacttgtaaataaagaaagagaaatttccagaataagatataaatctgggggatcatacatatctttatagatagaatagggagatctagttacaatcaactagatactttacttgtaacccccctcatcctatataagagggggcaggggtcccgagagggggaggtcggattatctccacaacctaggcatacatcatctccactccataccggacatagatccgatacacatacaactggattagggtattacctcacatcaagacagttggatcatcgagacaactggatttgggtattacctcacatcaagacagttggatcatcgagacaactggatttgggtattacctcacatcgagacaactggattagggtattacctcacatcgagacaactggattagggtattacctcacatcgaggacctgaaccaatataaagctttcatcgagtcatggtgctcgatcgagtagtagaaataaatcgtcatatgtagtagggattatgtgttaggataacagtagcttatcatgtgtgttttgtttgcaaaatgctatgcccagctagccgctagcgttacgagcgtccaccgccaacccattctgcagggtgaaagattggacccctttgtgcggcccatggggcggtgaacagaatcaccccgcacgacgcacacgcgttcgccgcgcgcgcgcgcgactacgcgaccgtgaccgcgacgcgggcatatttgaaaaaaaaaagaatttgtgaataaaacttttatatacgtgtttttaccgatctaaaagtaaagactaaaaaataaatttcgataaaaaaacccctcaaaattaactttaaatctaagatagaaaatttaagttttggctgataagtataagtataagtgaaaagataaggcttttgagggccagtcgtggtatcggggcaaggcggggatgtgccggactgccggtgcgccaccatacactgtgaaactaaaagaaaatctcacaattcacaactatacgttatgaaatagcctgcggctaactcacaccgtttagtagtttaggaagcgtgcgcgcggaaatcgaaacaaactcactcacaatcagccaggaaagaacacagccttaagtttccaatatttttgatattttttttcagcctcatcgttatcgttcccgttttcaagaaatatat

SEQ ID NO: 49247 - DNA, 692 bp, Oryza sativa
  unsure (1)..(692): unsure at all n locations
aggcttgtnngnattgatgnccnccttgaannncactggatatccngctnnnnnnnnnnnnnnnnnnnnnnnnnnnnnnnnnnnnnnnnnnaaatagagggacacaaagtgaacgtattccaatccatttcatccttaaggcttcctttgcattagtggatttctggaggaattttagaatacttcctatcctttggattaaaaaaaaccacaagaaaatcagagaaaactttcctttgctgtcgttttcgcaggaaaaaggaagaaaaataatctatccgctccgagctattttttttcccttcagataagatcgagaagatcaatcactaaaagccagtttaataatatagctaattactatctctaaaaaactcaaatctattaccaatccaatagttaacttatacaatatctagttatagatatatagtgcattgttaatacctaatatacttatctttctcacgtactttcttcgtaaaaaaataaacatcgaataatgatatatcctagtatagcgaatctagacaaactcttaggatttgtgggatagatagagtattttattagagcttatactgtagctatatataaatctatagtctccttttctctcctctcctttccatataagtacaaatgatatggcaacttgtataacctgtttccattatcttattgcacttagc

SEQ ID NO: 49248 - DNA, 1501 bp, Oryza sativa
cccttcgtagcaatagcctctttgtttttgtgtacagtttcccttttatccataggggctgtattttttttacctctatatccaatgaaatagcacaatctcgtgctgattctttaaaaaaaataaaagaagaagtgctaagacaatgttcagttccaacttacaatggtctattcaggatattaactgtgtgggggtgatgcatgttgcttgcactaattcagaaaaaaatatggtactgccagcaaaatgaacatgatcaggatattagcaggtaacctgctaacagtaaaaaatcagaagaatctgcaggcaccaaatagagaaaacaatctgcaatttctgcagaattgagttctgcataggaagtttagaatggtataaccaaaacttggtaaaaaaaatgtgggcaattaatggcaaagaatataaaataaatcaacattcagacaatttgaaggctgcattcagcacagaacctcaatgttcagactttcttcaggaacttctcagaaacccctttatatactgatagaattgcataaccaaacatcgaattccatgaaaatataatccacttaacgcaaagaaagaaatacaccgccatctgtctatcagtaaaggtgtgctcccgtctaagcaaaatgtaagcacacagtcataagcacatctccacactgaatatcagtggcaacacaaggatagatatgacgggttatcaagtatcaactatttccaagtcttgaatcatccaaaatggaaacagaaatgtagcaaacgatgcacttggatcgaggtacacattgatcatatcagcaagagatttgtactagaacaggagttctgccttctgctaattaacagctaatatctcagcactacaataccatcacactcaccaaaacagcaaagagggggaaacaaacacaatgcagaggaagcacacgttagctaagatcataaactaacttgacctgctgatcgaccaatgttcccaaacgaaacggccaaaccttgctgtgtggtccgccgactcaactctcaagggagacaccaaccttggggggtgtagcctatcgccgggaagcagcgctccaccatggaggcaggtgttctcgtccatttctcacagtcgttgaaggagaatagcgtcgcgacgcccagcggcagcatcgccggatcctggatgtcatcatcgaagaagtagacgccgccctcgaagccagggtactgatccgcgtcgtaggatctggagcagccgcgcccgacgaacagcatccggccttccagcgagggcagctccagccagacgtagtgctgatacgggaacacgtcgtccggcccggcttgcgccatccggaacaccctgaactccgacgtcggctgtccaggataaggggagcacctcaccaccatgagcaggtcttcgcgggactccacgaggtagcgcgcctcgacgtactgatcgtattctcgcccaatgtgttcgaaggcgcgcatc

SEQ ID NO: 49249 - DNA, 165 bp, Oryza sativa
  unsure (1)..(165): unsure at all n locations
cgcgcgggatgagagcatcgtgctnnnnnnnnnnnnnnnnnnnnnnnnnnnnnnnnnnnnnnnnnnatattatttgcttgcagaaactttttcaacagcactgatatttaccgatatatgcagttaaaagcttccatccaggaatggcaatggcattgagaagag

SEQ ID NO: 49250 - DNA, 1501 bp, Oryza sativa
actcacatgggactgcttgcggagagtggaatggagaggattgcgctcaagtcaaaagagctggagggagaggaagagtgatattgcaagatagtagatgactcaaatgttcgggaatgaagtatatattctgcactgggggataataaacaaaaagtacatgatggcgagttgccttctctttttatacagcttgggtcatgcccaatttacaacaattgcataatgagaccgagtcaaattagagaatcaaactgttgagtaccacaaatgcgttcatgtcctttaaatttcaaagaaagtactggtgcagccatgctttcaaccccttattagcaaaaataaagaacaaagccatttactcgtagagcactgcagatcatttgaacaacatctactactacagaaaacttgttccataagcaattatctaaatttatatagctccagaaaacataccaaattggataaagtcctaactcctatcagtcattaagatatcctttagtaagattaaattctggacaacaaattagattggtatttggagatattttgtaaagctttacagatatattacctgaaccatatgccatattgtacagttacagacttatagttaaggcgactttttcttttaccttttgtgatatcaacaaaccaacagaagttacacctgtaatggagatagactgatacaagtgtctataaaagatagtaatatgttaatactaaatatcctcatttgtacttatccattgcagcagttaaatgttaatggtaaaaaacccaattcatacttattcaataagttgtagtggttagtacatcaaactcaatacacgtctgacatttgacatgttgattaggctaggtcagcaacttgaaatgcagagtgatctgctacctccttttatttctcctttttctcttttcacctctgaaagctatactgagaagagaaaatattggggacaacctttagttaatctgaatacaaaattgcaagtggaaaatattgtttcaataaaattgggctcacctatctcatgtaaagttaagttattctctgccttctgatgcaggtgacaactaagcagcaaaagttgcttagtgaagaccagtaaaaaaactgaaacatgtaatggctgtaaacaaaggatatatccattaccaaaataatattgcagattgcaatctaactgtatattagtaggtaggaaaaccagcacttcgtgtattataaccactatatgttccaaagagcccattggagctattgctcaaaacagtttgtgttatttcctattattgctagctgccagaaattttttatgaaacccaatagatgaaccaggcaccagcttggtacaagatgaaaactttgcgatgcaatagctacaaaaggcaagaacgtaagcatgagcgcaatcattcagataattcgtataaggatcaggtaatctcacgaagtgagaatccggaacggtacaatatatat

SEQ ID NO: 49251 - DNA, 1501 bp, Oryza sativa
cgatattgcttcattcaccctgccagctccttctgcatgcatgcatgaaaaagtccactactatgtgcctagcttctcctatcgtgaggggtcagggatctaagcacgtgattcagcctttgcagacgtactccctccatttcagaatgtaagtcattctagtatttctcgtattaaatattgatactaataaatctagacatatatatttatctagattcattaacatttatatgaatgtgggaaatattagaatgacttacattgtgaaacggaggaagtactaaatttactttctgatatactccctctgtctaaaaaagataaactttgtgtttccgtgtccaacgtttaaccgtccgtcttatatgaaatttttttataattagtattttcattgttgttagatgataaaacatgattaatattttatgcgtaacttgtctttttattttttttcataattttatcaaataagacggacggtcaacctttggatacaaaaatctagggtttgtcttttttggggacggagggagtagtataggagtaaaactggcttattaatgcggtcacaaaagcactttgtggtatgtatatacaacatcttggtcatatataagagtaaaactgtgattatatgttaatatttaatgcggtcacaacaatgttgggccgtgtatcactaccacgaaggggtacagctcgcgctacctccgacacttgttaggacgtcgtgttacacttctcactaccacgatttttcttttgtgccaggaagttagcagcgatctcaccaaagcacacccccaatgcgtgacacaccacatcgagtgcgcgcggacgtccaacctaccctagcgcggatcagtcgatcaccacgcacacccgcaccgagtcacccacgattaccgggatttggccgcgcaaactccaccgcgcgcgactcgcgtgcacgatccccgcgcgcgtcctcctcgcccggcggaaacccgcgggatggagaggcgctcggcgcagaagacgatcgagccagccggccggccgggccgcgcgcccggcgaaactcccgtgcgcgagacggcgggggaagctgctagcaaaagcctgcactgcatgcgaggaacgcgacgaaaacaacctggctcgtgatgtcacacgagtcatatgctgcagccgcagctgcgctgcgctgcaacacgccgggtgcaggcgcctttcgtaaacaaacgtccacaccgccagccaaccctcctcctcgtcagcctcagcgcccgcggggcccgcgcgccacaggccttttcccttttcccagaaatggcctcctctctcctccactccacggcttttttttttttttttgaaaacacatcaactttattaagcaggaacagatctagggaataaaccccattacatatccaagcaaaagagccatccttaagaaaggagggttaactgaactacgaaagcaaccttcctgaaataacctaacatcaga

SEQ ID NO: 49252 - DNA, 1501 bp, Oryza sativa
  unsure (1)..(1501): unsure at all n locations
tcgacctcgagtcccaccagtatcggcgccggcgcaataacacccttcagccaagctagcaccacctgtgccccatggctttggcccctatcttgagctcgagctcgaccggtcgatatcatgctccatctctagctccgccagtgttgatgcaacgagcgcttgagctcaagttccatctttatccctgcaatggccaaggtcaatggagatttttttttgtgctttctttctaagctcaagtgcaaatatgtgtgggggagatattgagatgccactcaagagcgatgccggcgagctccgacgtgagcgttgtggcagtggcggttgagcgttactcgacctgctcatggtggttcctagcgtgaggaaggagagagggaaagttggaggtagaatagcatgcccatggtgaaatatttggtattttttcctagcccaacttgaaaatgtcagcttacccccggtccaaagtacaatagtggtaaaaaaaatatggcccaatatacaatttagtttttttaattttatagtttttaaaagttacanataanntcccctctactccttttcgtttgcctcctattttcgagtcacataacaataacaattcagtaaacatactcacgagaaatgaggtaatagtcagattggagaaaaacttaaggccccattgacttacctttttggattgactacttcattgttctatgtgagcacgttttctaaacggttagttttctttaagttccttttcaagttctattaaataaataaatacactttacggtagttaatattcacagtatgatgaatccgaaccaaaactttctatattttgggacggagggaggagggagtattaatatttagggcatgtttactgtgctactattttcaaccttaacaagttttggcattgccaaatttcgataaggttaccaaaattttggtaaatttgtcaaattttcgcaagatttcatatgtacttactaaaatttggcaacaaactaaatgcagctacttttttttataacttaaaaaaaaggtaaagttaaaaatggtaacaaagtgaacaagctcttaaattatacattaatgatttagctcgtcttaggtgcggtggaacagctgagcttaaccgcaaagcctgtttctattgagaggacgcaaaaactgcagtggaagaaacgaacgacagaagctgccgtgcaattcgtagttgcgtttggttctcgtcgagaggtcgagtaataactttggaagaaaggcaaaacaaacgcgttgggcttaacacagtcttacacagatcgcttcacttttacacgaagcccctcgcaattcttcgacctcctaaactcccccatcgcgatccctctcctcctcctctttccccaatctcgcgcgacgcggcggaaccctagcccccaccgcgattcgctcgccggagagggagagggagggaagggaggctaggggaccccctcgccggcggcggaga

SEQ ID NO: 49253 - DNA, 1031 bp, Oryza sativa
acaaaatggatctttttttctttccaaacaagtgctgttatctggttaattattttattttgccaaatcccactttattagtcaacttgtcattccgatttttagctaaaattttccatccttgtagtccatgttttgttggccagttatattagtcgagttatggctaaggcagcattccttaggagaataaaggaaaaaatatctctcattgtccactcgtacgcttctcaaatgattaaacgggacgtttttcctaaaaaagaatttctatataaaagttgctttaaaaatcatatcaaactattttttaagctcaaataatcatatgttaatggtttatcttgttttacgcatcttctcaatcttttcatttcccctccttccaaacacacctaagtcaaataaccctatggatttttgtgcgcttatataccacttctacttttttttaccgaatgaactaaccaatgtctggatgaatttagtattattgttccactggataaaagaaaattcaattggaacaacttatgttccaaaaccacgaatgcattcccggcgcttatgtgaagcaaaaggaaataagaaacaccacatgtatctagaaatatatagtagtactagtaattactttgtcctaaaatataaaatttaatattaaatatgcatttgaacagctataaaatataatgtgtaatcgtagttttttatattttggaacaaaagtagtttatgttttggaacaaactgcaggggtgaaacgcaaaaactgcctctacggcctccggcctccgcgtcgtatctgcgaggacgaggcgtggcggtagggggaggtctcggattccggctcccggcctccctctatgcagtttgcaccgcacccggatgcgaaacgtggcccgagcctccgcctacaccgacccgcggggccctcggttcgtcgcgtggggtccaccgagcagtggcagaatcaccggccgcggggccccgtcatgggagaagccgctttttttttttttttttggatg

SEQ ID NO: 49254 - DNA, 1501 bp, Oryza sativa; identical to SEQ ID NO: 7560

SEQ ID NO: 49255 - DNA, 1501 bp, Oryza sativa
aaataacttgcactgtatcgtttgaggagcttggtctaggtggcatccgaagcgcggcaaatgcggtggccgcactgaaatcgcccttagagcaaggataatagtagagccaacttcctactaatacatcttaaagcctacatgtataatcagtgttctaaaaatcggccctaggcgccgcctaggcgcccattaggcgctaggcgccgggtagccgccgcgattaggcattcaatggtgcattaggcggttaaattacttaggtagtgttttattgctattttagtgttatatagtctaatttctatgcaatatgcctactaatttcttgaatttaactatttgacccgacctaagcgcccgctaggcgccgcctaggcgaggctaggcgccaattaggcgctaggcgccccctatccgcccaactagcgcctagcgccttcttgaaccatgtgtataatagagattagctataaggttggctacaattttcttctcctctctctatctctcacttatatcgattatcctacgcctcggtcgcctggggaggggaggggaaaaatcggtcgctccctcccccccacgacatgcgcgcacgtgcaccctagccccacgatgtgtcccagtctacctgctacgtgtccctaccacatactccgttgcaacaaatcacacacatattttggaaaccctctattaagggatttcgtttcattttttgttccaccaaaaatgtttcacctagtgtactcacaatgtttcactatgtatagatgaaatgttgcagtgaactgaagcattcttttgcaacaaatcagccacatattttagaaaccctctattaagggatttcgtttcatttctgttccaccaaaaatgattcacctagtgtactcacaatgtttcactatgtatagatctaatattgcagtgagctgaaacattctttcgctatttgctaaaacattgtttttatataaggtgaaacaatgcccgatttaaacgattgaaatattttcgatctacttagtgaaacaattccgatatacttggtggaacatcgtgcaacatttaaaaataattcaataataagctaaatttttttcgtcagaatatatccatgtgtggtcttgttttaaagatttaattgcaacgaatttaatggtgtaattaaatcatgatttagataaataatttaagagaaaaaaatagtttaaagtggttttgcacgaatgcgtcatgctgacgttagcgcctgatttttcctcttccccagcgaacgctcgattctaagttggctcccacttatctatactaatataaaaaagtacgagttcatcaaacacccatcttttctgacccttagatcgattcatctaacagcttatatcaagatctgcccctcaattagcgattcccatgtcgtaaaccagcggttagcgaaaataaaaagaaaagaatccactaacgccgaaaaagaaaaaaaaaaaaagaaaag

SEQ ID NO: 49256 - DNA, 1501 bp, Oryza sativa
ggaccaagtggattagcagtcgaagtggcattggggttcctgctaacaaagcttaggaatcctgatgggaggagaagcagaaacatttacagtctacaggtctactgggctgtttctgggagatcatactatctctcagattcttcatgctccaatactgtatgtctgtatcatgtatcactgaacaaatgcacctagacacatatgttgctactttccagacacacaaaaatcagaattacttacttaactaggtaatgagcccacccaactacctatatggaaatcggaattatctataatttaattacgcaatgagctcactggagctttcagttgttttagtaaactatctagtctgaatcatggtatcaagataacatgaacaaataatgtttagatgtaaacagaaatccagactaaagagggagtgcattacgttgaatgtgaaactcactgaactaaccttgagccttctgtataatgcagcagaattactccatgtaccatcaagcaaaacaaagttaaaaggttcatctttcacatcctacattgcaaaagatatttcattatttcatccatacttatttacatgatgttttagagtgtgcagcgaacctatttggatgtgccatgtgcagatgacattgtgtagatgtctcataaaggtaatctttgagaacttataactagaaaaaggaatggtcaaatgggtgtgggtaattgatatcttattgatgtcttaaaatgagaagtaagaaagcatggaggaagtaccatgttacttctacaagaaaatacttgttctaactgcattagcatgggaaaccagttaccccaaacaccatcagtacttatcatgttggataaaaggaggtgattggaaaaacagatcctccaaagaaggcagcattgtttatgctatagaaactttactaaagataggtgtgttggataagtctttgtggtccttggtcgtgattcttctttttgcttttgggtagtttcacctttttcaggacagcatctaccctttagcatatttttcagttgctaggacagctgcggttagtaggacagcagcagttagtatctcctttatgcctcctttatgctttattcagtttggatgccctctaggacagcatcccattcaaatttcgaattttagactaggagggtgcagcaataggctagcagccagctatggctatatatatgtatccaacctccctcgggtaggtatggcttttgtgttttgtgaatgaagaaaaccagaaaattgccccatctcgagtgccatcctcttctcaatgagagtaaccattgaaattctaacatctggtatcagagccacactttcctataggctaaacatctcttgttccaccccttcccaagctcggttgagctctcagccagcagcagcagcagcaccggttgctcctccttcccctttcccttccccctctccacgcagcagccccccggaggtgcgcca

SEQ ID NO: 49257 - DNA, 1501 bp, Oryza sativa
gatttcgtcaggttttacctgcagtggccggacaaaaactttgacaggatgtggtacaatattcttgcccatctttgtgacttttggtcgcactcctaggcgtgtttaacttccttaatctgtcttcctcgctgtctcagcttaactaagtaattaaaagggtcaatttggttctgtgcatctcactccactacaattttgcatgtgataagccagtattttgcttctccataattaatcattgttcttgtgacaatttttgtctagtgagagattcttatcccaaataatctttctactccaagggagaagcagaacattgttcaaaaatcaagaccttatcataatttatttactaccaccatgagatgatgattgaggtaaatagtaaagcatcgaactgtacggcggtggagttgtgagggcataataccaacgaccaaagttcacattctttgagcatgtgttaggttagtcaaaagatgccaagatggtgtccgtatgtgcttggtcaaacggttaattaaactataaccttcgaaaaacaattaaacttaagaaacaactatatgtctataagagtataagcaagttaatcctaaagacttatttctttttcaaattaacgtgttctgtaaaaatcatcggcgatactattaactcaaattaatatataaatggtcctaaaagcttaaggcccctttaaatcgcatgattgagaaaatgtaataatagaaaaaacacaaaaatttgatatgaatgtaagagtaaaatagatgattgcaaaacataagaaaaacacagtaatgaccgtttgattggaccgcagaaaaaacgcaggaattagaggagagataaaaactcaaaggacgatttccatgaggtagaacctcgtgttagatttcctccaaaatttacgtggcattagacattctataggaattttataggattccaaaagatttcactcatttgattcaaatggctatataggaaaaatttctacagggatgaaatcctctaaaatttttatgaattttttttgaatcaaaggagaccttaataatgatgaacttattagcttatggtatctctctttttcgtgagcacgttttttcaagccaataaataatctgtttttacagaaactatttacgaaagttcattgtcaaaaaataaatatatttcaaaatttttaaaatacccattcgtctctaaaaacaaaaacaagtccaattctaactacgaacctagatactacttatgttagagattttatttttcttttggacagagtactagagtagtacttaatgatttgaatgtgcgctattagcccgtcatgttgtccgtgccgccgtaattaagctcaaaccattcaatcgatcggcgccaaagactacaggatcaacagccagaaaccctatataaacccagctcgctcagtcacaatcctcactcccctcagtgacactctcttagcaagcaagctagcttagcc

SEQ ID NO: 49258 - DNA, 1501 bp, Oryza sativa
cgacgttttggaccacttctccctacacattctcctatccggggcccagtgatgcaaacacaaacaaaacccaagtcgcagaggttacacggcccaacagaaagcccacctatcctctccccacggcccagtccgcgtccgactccgcgtcgcctctcgcctcctctctctcttcttcttctcccccaaatcccaattgcttattctccttcgacaagccggccaccgtccatcgctgcttcgcttgctcccacccgaagcaacgcgaacgcgacgcgctcccctccccgccacctcgcggcggtgagaccaggcctccgcgaccctcgccggccgtccctgagcgccgcccgcaccggcaactcggtttcgaggctgatctcggcaggtttgtgtctgccctcgatccaaaaccggtgctgtggtttgtttcacgatcccgttaaagttgtcgaatccgttcggcgattgtgattcaggtagaggaattagttttgcaagacaggttttacaaggaattttttgggggggagtgggggacacgtttttatgctgttgttctgatgacttcttgaaagtcacacccaagttagttagttatcagcagctcatggtaatcttcagtgatggattaaccgctctacggtatctaggcaatttgagagtagaagcaagccgtagcctacagaacattttgccatccaaatgcttggcattttgatttgattacgcaggcagtaattttggagtagaaaacgcgtcctaccgaacatgagacttatcacaagtatatcgttttttgacaatagtcaataggaactctgcgttgaggggtttgatttcaatttgttctagatttgatccattcttcttccttttatttttctgatgcaaccaacaattagtctggcattggcgttagcgattaccatctactagttattttccgttagaatctatatgcatgtacagcttattgattaccaccaactgttggaacatatgtaacctgctatttctttttatgcagattgctctagtacaatgagctggagatttcctctttttgggtatgttatttttactgaaagcaatacttttttcgtttgttcttcttatgtctgttcctaacctttcctcgcatagcatttgtattctataaactgagcttcctcttttatttggtagaaagtattgtatttgttgatcagtgccagccagcaggcttgatgtgattcgtaatccttagtttctttctatactaaaaagccttcagatattgatgctcaaaaaattgctttgcttttgttccaaaagtttattttatcatccgaacagtgtccaccactcagctactctgttatttcttatggttgggtcttcagttacgctgaatttaatttttagcataagtaaattaacgtggctatttaatatgattcacttattgccttaagctttcctgaaaaacgagctcctctggcttactgtctttgtttct

SEQ ID NO: 49259 - DNA, 753 bp, Oryza sativa
ccgcgtttagtattgtataacctcatgtctaaaacatccttgaccatgacagatcaacccaatgaaactgggggctctacggagtattcaacgccatatgctattctgtaaatgaaacttgcccatgagaacctaaagaaatgctaggtgaaagaaggataatgtttaagtgccaatcactggtgctaacgaactcaacccaacaaagatcattggtttagaagtacctaccatacatacgaaatgcataaagcagcctctccaagcttaaaaacatccttgacagtgacagatcaactcaacgaatctgggggctctatggagtttcatgcaaacttggctaaatacaaggcgaacactcagattatcatgtcgaattatttagccgattggatcaccggtttcaaaggcaaagtactacctaatacgggcaccattatacaccactaaagctaattaaataacctaccagcttatcactacagctacaaggataaaacttttatcataccaaagtttagctacaacaacacacatcgtgacttcgcgagtcatcaataaagcaagaaactttttttcgcggccaaaaacagcgagaggccggccacgattgacaaccgaatcgcaaccctcaccttgttgatctcgagctgcggcgcccacgagtggagcagggcgaagaagtagtcgaacatctcgacgcccgtggcgaactccttgggtcccagcttcaccggcttcgcctcctcttcc

SEQ ID NO: 49260 - DNA, 1501 bp, Oryza sativa
tggacgaatcagggagtactccatatgtcaaaaaagaattcaactctacggatgaatctgaacatatagattttcttttaatagaaagagtataattactccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcgggagtggccgccgccgcagccatagatctgcggcgccgcgtatctcgcggctggtttggctggtgcggttagcggctagggttttggttgtttcgtctgatcgatcctccccgattttgcggcggcggtggtgaattggtgtgtgatctgatatggctggcggcggcggtggcgggggaaggggggagggggaggggagggcggcgacggggaagagggagaggatagcaatacggaggatcg

SEQ ID NO: 49261 - DNA, 1501 bp, Oryza sativa
gccagtgacgggaagcatcaccgctgcaccatgcctcgtcatcgccgcctacgaccgccgctgccacgaccgccatcaccgtcaagcccaccgtcgccaccgtccacgacaagcacgcgacgacaacgacgatggccggcacttcctcctcctccacctttactggtcggtctctaaaccctctctttccatctctatatttgttcaaacacccaagaggactacccgagtagatctaaagctagatgatcctaaagtgaactctaacagatcaaacattcatgcagaattgaactgctctttttttgcggggaaattgaactgctcttgactgaactgttgaagtggagtgatttcatgcggtacaaagtgcgagtgaggtttgattctcattaattgtagcgttcaatttatacaaggggatacggtcagaaccacaggagcgcgaaccatcgcgccagttgtcaagaagtgccgaaggagagaaggggcatggtagccttattcccttctctgccggttgtggtaacgggaggcatggcaaccgcaatgcctattccatcggatggatgagatcatatatatatatttcttaacaatttcgttgtcaagtactttaaattaaacaaaaataatgctttcctctgggtgtctaatgtggacacagaaatcgaattgctgtcacccattcatgcatttccccattcagtatttcatacgcaagtaaaattttcaacatggattcacgtgccttctttccgtttcatcttttggggaatttctgtttttcagacttcggatttctcggggggtcagcatgattttacccatcagagttcaaatctaatgtctttttaataagatcagagatatgctgctgatttctgtttatgtctttttaagcatgtgttaggggcacatttgcctaagtatgtgactatgtgtagtgatgtagtttgcgtgtgcatttgttgtgtaataagaaaataaaataaaattgaaatgagcagtttagaataagaggtagtttattgaaaaatcatatatctatactaaaagtccattaaactttctacaaacgctcgtaagtcatcacgtggcatcctataaacgcttctaagccgtcacattgcactttaaaaaataaccgtcgattttcattcaattcggtggacccattatttacaactattataatttttttttttaaaaatcatctcctaaacccggccccaccgagcattatgtacttactccctcccttccttcgattccctgttctattttccattaattctttatcctattttcatactttatttgttaaaaaatcaagtaactacgacatctaaatcatataattgtttttttaatccatggatgtctttagattgtttatgaccaaattcacggttgaagaccaaatttcactataattaaaagttgaaaagaaatacgttagtttgggctatattttctgacttttgcatgcatttcaaac

SEQ ID NO: 49262 - DNA, 1501 bp, Oryza sativa
aagattctcctactacttagagcggagtatctgtttttgcgttgcctacaaatcgatcgatttgccttgattttgggttaattttcgttactttttcttgattgaggatttacatctactacttttgaaaggattttatcactaaacggctaagattagatatattttgctcgccaagaggccaagaggataagagctatagccaacaagcttgtgctcgttgatttagagctgccagtcagcaagagctaattgagagccacgatatatcaaaagctcaagatcgagcgaagcttttgaaacttggaacacaagatgaagatcacatacgtcagctggtaacgtcacccaaaatgattaacgcgtcgtcagcctcattgccgcaaacaaaccagcagaaattaatcaagcttgattgtgctcgtggacggccggatcgcagtgaagcatgcaggaaacacttcgatcggacggtgcatgttgcggcatagcaagctcgcgcgatcgatcggtgggatgagaagaacgcgtagtaggttaccaaacactacggttttctagttttatacacaatgattctctatcggctgcatcgtcttaattagtactagctattttcttcttcctctccttcctatgcataattaaaaaaaaactgttatgcctatgaatattactggcatgtgatcagtagttgggcttttcataaaagtttagcaagttcagagatttattattactaatgcgagtctccgactatttaagtagtactatactactatgtatgttagataaaatttgtgatgctatgtgtagaacgcacgctaaaagaatataaaagcagaactagattatgtggtttgacttggaaaaagagcctgaatcggtttttggcttgggtcttggagaaagccagatcatgttagatagatctccctcctcttgagcccaacggcacaaggggaccttgacccgcgtcctgatcgggggcgcccagcccattggctggtgggcccccgtcaccctgcgccatataaatagagggtggaggccgggacggcacatgatacgaggttcgctgccgccgccaactccacccacaaaaccctaaccgatcgagggggcgcagccagtgacgggaagcattaccgccgcgccacgcctcgtcgtcgcacctacgaccgccgctgccacgaccaccatcgctgtcaagcccactgttgccgccgtccacgacaagcgagcgatgacaacgacgatggccggcacttcctcctcctccatctctacccatcagtctttaaaccctctctttccatctctatatttgttcaaacacccaagaggactacccgactagatcaaaagctcgatgatcctaaagtgaactctaacgatggtatcagagccaaaccctagcgattagatcggttcggggaaagaaatccaaagaaaaagaaataaaagaaaccaaaaaacctaaccctaaatccttacttcg

SEQ ID NO: 49263 - DNA, 1501 bp, Oryza sativa
gtaccgcaacgtcatgcattgcaggcacaacatcagcaggtagagagaagaaaggctcctaagtcgacgaagcgggtacagacacccgcctcttctcaagatcaatttctcgaactactgagctccccctaatcattttgtcttccaagaagacggcgtgtatcgtttagacagtagaaacgataaccctttgatctagaataaccaacataatgagattcatttacaaatgtaataatgttctcacctttctttgccatgatcattttcaggaagtcaggataatctttatagtagttccttttcttgcagtggagacactgatccttttcaactgtgaactgttgttgctgaggcagatgctgaggctgttttgcttttgaggagggtgtcttgtagttcttttccttgttatctttaacaaagttaatagagccaccattggactcttttgattcttttctcctcttgcacacaattagcgatgagcttttcaaaattccatttctttggacttattttgtagttgacaacaaagttgtcaaagtgctttggcaatgaggccataaccagatggatcagaaagtaatctaagatgcccaaatccattggcttcaacttggaagccatgttgctcatcctaagaatgtggtctcttacaccacctccatggtacctctctgtcacaagctgctttatcagctgtgtagcataaatctttgaagaaccagtaaactggctctttattattttgaggtactcaaagacggtgtcacactttgggattaagcccaatatagttggctcaattgtgttctttaccgcagccaaacatttcttgttggctaaggaccatttcgcatgctcaatgtcatacgacattatgaggggagcattgtccctctctctcttttgccagtcagcatctgactctttttcacctctgacaagtgcagcaggttctatcggatatggggtggtcaacacccagtccacctttcctaagataaaagcaaggtcgagtttttttttccattctgcgtagttatctcccttcaaggtcggaatatctttaatgcaacccataggagtagccacctgaaataatcatgtacagtgagaacaaaattaacattaaaatgttatgcattaaatctacatcaccgttaggcaaaaatagagataacacataaggccataactataacattgcaattaacaacgttggtcagaaaattacaacatcatagtacagaattaatgttcctaaaattaaattctcccgttggttcgaaatttaaatttagaaacactaatttttatcaatttcatctatttgcagcggaagatctatataaaattcatatgaacagtagcaaattatgttatttacactatgtaaaaattacacctttggttcaaaatttaaacagaggtaaggcatgcaaaatcgattaaaaaatctattgaaatttgcatgaaaatagacaaaataaaaaga

SEQ ID NO: 49264 - DNA, 197 bp, Oryza sativa
  unsure (1)..(197): unsure at all n locations
gtgtcccaatgaatgcnnnnnnnnnnnnnnnnnnnnnnnnnnnnnnnnnnnnnnnnnnnnagtggattttgtcctacgtggcagtctagtcagcaattttttatttaaaaaattagtggggcccacctatgatattctctcccctctctatccttttacccctctcacctatctctatctctcttttgcgttggagg

SEQ ID NO: 49265 - DNA, 189 bp, Oryza sativa
atcggttgttttggcacagttactgcatggtttctagcgataaccacaatattcacatggttattgccggttgtatagcagaacacatcttaactagtgaaaactaaatcacacgatgcatcaaggaatgtgccacgccttcaaaatagtggctctgttcggttgcaatttttattactatactgcagt

SEQ ID NO: 49266 - DNA, 1501 bp, Oryza sativa
caattgatccattgaaccaggggttagctagacgtgtttttttttctcaaaacggattaggaatcatgcttctcatcttaatttgttcatcggcatttcttaaaaaaatattttctaaatcgacttttcaaaatttaaaatatatttcttttgtttgttccttcaaattaatttctacaacagaaaattataaaactttatagttattttgggttggtaatcatcctatataataaagaacgatccaacggctatggtattcttgatgatgtgtctacatgtaattgcagataaatgaggctaacttgtataggaatagtatatttggtcaagctaaaagaagtgacacgtgaaaatataaaatttagatatggaacaaaaggattggaagattattcagagctgagaaaaaactacaataacccgatggtgaaatttttaattaatattttaacatcttgaaaagtttgcttatagattcagatggtggtaactcgaagctaataaacacaggagtgagtgcaattcactggtttaacatataaaatgttacatacacgtggtttatttgcctattaaagaaagttgaaaaaatacctaaaagtttcaaagcaatttaaatttacagaagagttgagatttgctaaaaccacatacatgtagaattggaggaactattaactttgcatggaagtgcatgcatgtgggctggggatacattaatgcctacaccctctattttgcaagttataaacattcatggaaattttagcagaaattaagactaaagtgagaaataatgtgattgcttgaaatgagaatgtaaattaattaatttaacaagaaataattataattggatgagacaaacgagtagatggagaaatgtgaaatcctataacacttatatttaaaaatggaggaaataaatttatcaatggtgtacatgtcctttgtacgtggaagccagaacagaagtagagccacaagcagacaagctaacagcaatttgcaccagtccagaactgagaatgcgttgaataagccaagacttgggccgagtttagttccaaactttttcttcaaacttttaactttttcatcacattaaaacttttctacacacacaaactttcaactttttcatcacatcatttcaatttcaatcaaacttctaattttaacgtgaaataaacacacccttctcgagcgggttctaggtctttgggtcatagattaatttgagaatgtgtcggcttctaatttcgtccaaggcatgagtcaagtcgtctcctatcataatccatgaaaaatcagtatataattaagtgtcagtgtcaaacactggactaaatttaatttcaataggtgtcaatgtaatgagttgactaaatacgagataaatccaataacacataagtatatactaagtatatatgaaagatcaggaaaaaaaactaattatattgtaatcatttagctcttttctatatagcagaca

SEQ ID NO: 49267 - DNA, 401 bp, Oryza sativa
ctgaaaggggggggttagtgtgtgtttgacagtgacacagtgtattgcaaatttgcaatgggaccaccacattagttagttgttacatcaatctagctagagataactaacccgtattatatatatatccttcaaacatatatacacatatatataaccacctatatcaaagtgtgtactggtcggtcagagtaatttggagccactgctatataaagcctctcagagccttcttcttcctctcatatctctctctctctctctctctctctctctctctctctctctctcgtgtgtgtgtgtgtgtgtgtgaattttggctgtgtttagttcagtacaaagtttggattttggttgaaattagagatgatgtgactgaaaagttgtgtgtgtatgacagg

SEQ ID NO: 49268 - DNA, 808 bp, Oryza sativa
ccttgcgtttttgtcatgggaattattgtttttttctttttaaacatttccgatgtgtttgtaaagtatataaaaaattttatcactggtaattgtaatttctgaaaaagattgatctgatggtaccatggtaatgttcacgcttctgctaaattgattatatatattttttattttttttgtcttttgtttgggagacgagagcaagtgaatatagttttgtgtcactccttggtctctccccctgccttatttgattgttcatatctccttatttttattttatttttttgcataaaaaaagagaaaaaagctaagttccatgaagatataattatactttttgggtgaggaaacccgggcaaatatttatggatctattctcaaaagattatgagtaaccatttggctactcttttgtagctataaaaattgatacgaagatttgtggctgacctatcttcttgcaaggctcatatgttcatggaattctatattaagatttataataaaatagataaaaaatacatattgattgtcctaaactgctaatttcttatttgttctgtcataaaatatagcaacgtagaactggatgaaacacattctagtacagcgaatctggatatatactagtcactaatatcattattattatatatgtgtgcttagcagttatattaagaattagattaggattaggattgtgtcaatgttccataagagacttcgaatcctatacgaatctcaattttgcagttataccaatttataccctcccctccgtgggagaatgttcctctatagc

SEQ ID NO: 49269 - DNA, 1501 bp, Oryza sativa; identical to SEQ ID NO: 49077

SEQ ID NO: 49270 - DNA, 213 bp, Oryza sativa
aggtcaggtgggtggggcccacgcggggggaggggggaggagaaggtgcaatgcatctgctgctgcgtttgcccacttgcgtagggggagtaccagacacgggccgtgctgtgtgtgtgtgtgtgtgtggtgtggcagctgtccgcggcgacggcgacggcgacggcgcgcgtgcattggttggcccggcaaggaaagggaaggggaaggaga

SEQ ID NO: 49271 - DNA, 1501 bp, Oryza sativa; identical to SEQ ID NO: 49080

SEQ ID NO: 49272 - DNA, 1501 bp, Oryza sativa
gtcaatagaaataacaaaggagataggtattactagcatcacagtttatgatatgaaaatgaatggttagtgtcagaactggagctttacaaattttgttggatcagggagaggataagagtgccaactccattgcattggcttgttaaatactactagtagccactaattaacatgaaccctccaattgtatggagctagcttttaagtacctttagctaattaaacacccacttgttgatgcagcctactggcaaaactggaaggccgtactccgggaacggtttcggtatcgtgagatcgttgccttgttgtactggtaactgtgagtatggacgtcactggtaaattactgggcttatctatatcctgcagttactgaacccttgtcaaaagggcaggccatgtgcaaaccagacgatcaagaactcaattcccgtttataacattggagttcactgttcatcgcagtaaatgaacaactagctcgtacaaaatttctgcatataattatataaaataggattattgaaaaatttcacaaaactgcagatattttgataaaactgtcacaaaatcacatgtttaagttgttgtgtcacaaaatacgcatttaacatcgaatttatcacaaaagtatagatctaagctatggtatctcgtaaaaagcacatattaaacacataattaattgcaaaagctttgcaaaagtatatattgtaaaagttatcttgatgaaacttttaaaatacacaaagttaaactgggtacaaagcgataaatctgtagcttcgtgatatcatttcttaaaaatatagttttatgataaattggaccacgttgattatgtgtaaagctttaagtctgtaattactatggtactccctccgtcccaatatataaaaacctagaaccggataggacatttcctattactgcgaatctggacatgccgctaggaaatatcccatccggtgcctgtctagattcgtagtactatgaaatgtcccatccggttctaggttcttatatattgggacggagggagtagttttcaatgaagggtaaacggttttgtgaaatttactcaaagggattatcctttttatggaacttcttacgaaattctaacccaagggtaaactgtgtgtcaactgtcaaggagtagtagtaggaactgagcatccaggctgggagtttagaaattagaccaggttcaggttctgaaaaccttttggtgccaagcggtggaggcgacgagagagaaaggtcagaagtgtactcggttggtgcaatatgccgttcctatcctcaattcctccatcctcccacccacgacccttgagcgcctcgcaacgtcgtcggctcggctcgactcgtctcgtcgcccacgaattttggagggtcgcgtactgagctcgtggcccgcgtgaccatttcttttattttctccccctacttttcccgcgctgctttcccctcgcgccatccaagcgcccgc

SEQ ID NO: 49273 - DNA, 1501 bp, Oryza sativa
accttcgacgcgctggagggtcccggggtggcggcgctgagggacggccgctgcctctccaaccgcgccacgccgccggtctactgcgtcgggccattgatcaccgacggcggcgcggaggaggagaggcacccgtgcctcgcttggctggacgcgcagccggagcgcagcgtcgtgttcctctgcttcgggagccgcggcgcgctctcgccggagcaggtcagcgagatggccacgggcctcgagaggtccgagcagagattcttgtgggcgctgcgcgcgcccgcgggcacgaagccggacgccgcgatgtctcttcttcctgacggattcttggcgcggacagccgacagaggcgtcgtggtgaccgcgtcctgggtgccgcaggtggcggtgctgcagcacgcatccacgggcgcattcgtgacgcactgtggatggaactcgacgctggaggctgtcgcagccggcgttccaatggtgtgctggccgctcgacgcggagcagtggatgaacaaggtgttcatcgtggaggagatgaagattggcatcgaggtcagagggtataaacccggggcacttgtccaggccgacatcgtcgatgccatcttgaggcggatcatggaatcggatgcgcagcagggagtcctggagcgggtcatggcgatgaaggagagcgcagcggcagcatggaaggaagggggatcatcgtgcactgcattcgctgaatttctcaaggacatggaggaggggaatgttgccatggcgcattccaatcaggttgaaacttgaatttcttcctgagcatggctcttgacctttgcatttgtcttccatcaattaggatccatagaaaattgtccaaacccatctgcaagcaccacagttggtcaaatgcttgtttatgataagcttaagttcaaatgaaattcactgaccccaaatatgtgatgacaggtctcttacttgttagaaattcaagcttttcaatttcgtagttcgtagtggtctggtcaattatacatggtgcttcattgctgttgaacagttggggaggcctccaagataatttcccattaaggccttgttcttcggttaatccccataatatgggtataatatgtacataagagcaaggataatggtgagctataagcaagctaaatgcttatgtggaagagagagataaataaaagtggagagtgttggctctcatgcaagagctagctacacacaagctctaagaaatatgcattaaattcgtagagagataaagagagaggatgaaaaaaataaagctaaccttatagctaacctattatatatgttagctttaacattggcttatagtaagtagtgggctgtactactaaacttgctctaagaaaacataaatttatggaaccttgtggaggacagggaaacttgttaaactccaagaactaaaatgggacttatgatcctattgcatccgaaacaaatgcaggacgatttttctcct

SEQ ID NO: 49274 - DNA, 485 bp, Oryza sativa
ggggacgcgagcgtagcggcggcgcgccgacactgcagcagtcagggcacgcggcactccggccgctggctactggcgggcggcagcaaggcagggtgcaggtgggctggcggccagctgggggatgcggcggcgtgacgcggcatcaagcagggaagggggcatctgggcaaggtgcaaagggcgtcagcagcaagcagcagcactgcagcaggtcatcagcccattgcccagcacagcagattgaggaattgtggtatataacatttttgatttgtcatttaaaatcaatttcaattgtcaagtctagttgttactaatagctcaagtcttcaagaaatcatagagatattgaactgaaaaattttgtttgtgattcctagttgctactttgttatattgctaggttgtgaagatgccgaaaagaacactgctcacatattattctagtttaagtaacacaaataccagcgatcctccactca

SEQ ID NO: 49275 - DNA, 329 bp, Oryza sativa
atactaacatattaaccctaaaattttattattggagttgaatcttcttttgaaaaaaaaaataatattgtaaaatttatactaccaatgatcaggatgttaggaaacacccaggtgcattacatttactttatcagaacggaggccccacatttggctagatttggaataagtaaactctaataccaaaacaggtacaataaaataatatcaatataaatgagcgcatgaccccattggatcgattagtcttacgcatgcactgtaagtatttttctttaaattaatattgtaaaagacgtaattttatataaaaaaaatcttgtaga

SEQ ID NO: 49276 - DNA, 1501 bp, Oryza sativa
gcggatgctggttcctggtctggagcaagcgatatgcctcgcttctagctctggactcgggggtcgacttctttgcatggaattcctcccagacctgttccgtgatccaaggaaatttctctcttggatttggatttgccgggttgtagacgaactcgtcgactagcttagtcttgaagttcttccaagcagtgcccataaccttgaaagcagcccgcctgagacggtccttatgctccgtaggataatcaaagctctccttgaacgttagccaagcaatgttcttctctgcggccggcacgagcttgaagtcgtcttgcagaatactgaatttctgcctccctatgaccccgcagatagacctaaatcggctcaatattttccttggagatgtcagcaaccctacggcgtccaccgctgttatgcggaaccgttccttaggaattttgttccctgtcctaggagtacgtgcccttgaggacccactagttgtcgtcgacattggttcgccttgctgagacattgtgtcgaaacaaattttcggcaatatgaaaagggggtagcgcacgagacctaaaagtggatggatgcggagacaaaggatttagacaggttcaggccctctcaatgagaggtaataccctactcctgtttagggatttgaatccgccgggtgtatattgatctgacaatcagtttgtctcatgctccctagagggcctcctgccaccttatataggatggggggcaggattacaagatagaaaccttaactaatacggtatcggtttcctaaatctattttacaatattatcaaatcaggactttaggccgctccataatataaaaggaaacgtaatacccaagtcatgatcggttacatattccatagatataagctatcccctataactagtcggataaccatgccgtgtgggtatggggtacccataatctccacagtagcccctgagaccttcacagtcggaaagataatcttctctcgaactagattactccaaagctgagtgcttcaatcatcttcgccatgatctcccgaatacttttaccaaatatgaagattgtggagggctgaaaaataaagtcaggtgcatcgaatagatgtacctaatagatgcaccaactgagtggttttgataattgtagtcaaccaagtgacttaatattaatatatagcatatgtggcgtgaatccctgaataacatgatccgagtgatataccgactgctttgtaaaatatgatgcgtgcaacctaaagctgactacatcattgaatacacatagcaaaacagctataaagaagcttgtatgttgtgaataaataaatttccaaagtattgggcatacaccatgcgcacactgctttaacagatgtgcttgagtccctaaaagacacatggtttcaccacacctggaaatatatggcatatgtggtataaaatccgagtaaataaactcataaggatttatcaatcgtct

SEQ ID NO: 49277 - DNA, 406 bp, Oryza sativa
  unsure (1)..(406): unsure at all n locations
agagttaanccttgaanctgatatccnnnnnnnnnnnnnnnnnnnnnnnnnnnnnnnnnnnnnnnnnnnnntactcatatttatcaaatgcggcatgtggagacatgagcgccacattgtcatgatgttgatgacatgatttgtgaaaggagaaataaaattaaacaattgttttcgactggggcggacggaggatttgggtggtatctgggaaaggctagtaccgtccccggtcaattaaggaccgagccatgaagttaaacatgaaacgacccccgtacaaccgcacttctcgtatgggtatagacctagcggattagatagccgaacggaggcagtatccctgcatagatggttcacccctgagtgaggcaggtgcgctacggtgggacagccgttgaggtag

SEQ ID NO: 49278 - DNA, 464 bp, Oryza sativa
acatgttccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgagaggagttctagcgctcccgggaaagagaagtctcacacacatattaaattatggttcaagttaagttctctctctcacacactcatggcagtcctaccaatggcgacaccgatgtagggcacgcctctcggccctacctcaacggctgtcccaccgtagcgcacctgcctcactcaggggtgaaccatctatgcagggatactgcctccgttcggctatctaatccgctagg

SEQ ID NO: 49279 - DNA, 687 bp, Oryza sativa
  unsure (1)..(687): unsure at all n locations
atcatgttnnnnnnnnnnnnnnnnnnnnnnnnnnnnnnnnnnnnnatgtcgatgttgtgatgaaatatggtgcatttatgaatttggtgatagatgattgtagtgatcgatgaaatgtggatcatttaactttatttatatgcaatgtggttcatgttgggatgaaatgtggtttattcatgttgggatgaaatgtggtttattcatgttgggatgaaatgagatttatttatgttgggatgaaatgtggtttattcatgttgggatgaaatgtggtttatttatgttgggttgaaatgtggtttatttatgttgggatgaaatgtggtgcattaatgaaattattgtgaaatgtggttaatagattgtaatagattgtagcactcaattgtgtttttttttgtttttttggaaaaaagtagacaatgtgtggagattatgggtaccccatacccacacggcatagttatccgactagtcataggggatagcttatatctatggaatatgtaaccgatcatgacttgggtattacgtttccttttatattatggagcggcctaaagtcccgatttgataatattgtaaaatagatttaggaaaccgataccgtattgattaaggtttctatcttgtaatcctgccccccatactatataaggtgggcagaaggccctctagggggca

SEQ ID NO: 49280 - DNA, 799 bp, Oryza sativa
cacgatagcggcattagtagacggcataacgctattgaagattcaaacttgacaatactgagacaatttgttaacaagatttagccaaaatctacaacccgaactgataattataatatataaggaatcaacgagccttaggcctcccagtcgttctcttgtctagccatgcaatcatctcagatggtgcatctcttgtttaaaatagtctaaaataagagtttagctacaaatccaatcactaactgacaatgtaaacatatttaatacaaactctaccttggcgagtatgctacaccaatttgaattagttccgtgtacatttgaatctccgtgcacctgggcttaagctcattcattgctcatgcggagctatctgataagccttcaccaggtcgttcataattagacaaattattttgtggatttgctctaaattggttttttccaattttcctagcaaaactatagttaaaatttgtttgtgttcgtatattgtgaattgtccattttttctcatgtaattcaataaggtatgagagttagatgttttaagttcaagtcctaggtagcacaattaaataaaatcgtataactcatgtatattatattcgacgtttgagatataagggaccattgactaaggaagccttgagcgaggggaagttttccaatatagtgtggggggagtgttggaatataagtattcgctcgtcaatttaattaagcttttagattgaattgattggtgtccgcaactcaatattctcaatatatgccgcagatcacacctagacaa

SEQ ID NO: 49281 - DNA, 557 bp, Oryza sativa
tttccgctcttctcttcaatacttagatcgattcttgtacttacgtgaatatggatagagaatttggacaagtgcttatttagatttatagccacgaatgaaagtttgttttaagtaaaggcagtaggattaaaaaactgtttaaaataatggctaggacgacgtcgtacaatcacaaaaacaataattaagtacaataaaaaaaatctgaatcgattgatagaaaagaccaatgatcatatactatactccttccgtcccaaaaaaaagacaaaccctggttttcgtatccaacgtttgaccgtccgtcttatttgaaaaaattatgaaaaaaattaaaaagacaagtcatgcataaaatattaatcatgttttatcatctaacaacaatgaaaatacgaattataaaaaaatttcatataagacggacagtcaaagttggacacgaaaaccagggtttgctttttttaaggacggagggagtacggctattcgaaagtcaagagcttggcggcgtttagcagcggttgagacgagcagctgaccaatcttgagga

SEQ ID NO: 49282 - DNA, 1501 bp, Oryza sativa
gcacctgaaatggtccttccatgctggtcgtctttattgtttgaaaatgtagcacccccaagatcctgagtatcaggtggtgttatgctgatgcgagctgaatcaacattgaaaaagtgagtaggataacccaccatgtaatcagcagggctgttgtatgttcctccttttgttcctgcaatagccacatcggcatcaattctactggacgttggaaccagcaattccccatgaaacttatttaaaacaatttcttgatgttctccgatgacagtgtccttctgcaccaaatgatctctggacatctccttcacttcatggttctccgcagtattgtcttccacaaaagcatcaattggagcatcgtcagtagagaatagccattcattgacttcatctcctgaattctcggtagcttggtttttacatgcagagtggaggttcttacatctcccggaatctaatacttcattgtctgaagcaatcgacagggatccttgatcaccatgagctgctcttctgagaggaatctttggatcatattgtagacaatgttcacgagggtgtacaaggacatccaaagccagcaaagcatgtgaacaaaattttgcaagctcggtaccagtctctagcctccctgttatgacaagaaaagataaatactacaacaaacaaaattaacacgttttgagaattacatggatgtaattaagtaaatgaactgctatatgaaatgcatgatttatttagctagcttaacaaatttcatgcgtatgtgtcctagtgggtttcttctgtatatcgttaactctacgttttaccaatgaattagcaaaactggaatgcatgtggaaatagatgataaatacagcaaatacagattggctcagaacctggaagaaggtattacctttgttgaagagctcaagacctcgttctaaataaggacaattgtcaggagaagaaagaaaggatgccaatagagattttaacaaggctaactggaagtctgaaaaagttggatctcctgccaatagtggtcttagttcatacatccccatagtacagaaagactctcttgcaacattaataagaagcaggtctatttgtgtcctccagtagcatgctctgaatgaaccaccctgctcatgttgagagtcaatagccaatttcaacagaatatacgcaagattatctactactagtcccccatcccaaaaagacttcatttctagctatgaatctggacaaacgaagtctttttgggacacatgtctatacatcctaaaagtaagagtggcacaataaataacaccttggaggcaacctagccaattgagtagagatacgaaatgatgagtggattaagaagataatggtactctacagtattctgtttgtattaatgaccaacagttaaaccgttcttataaggaatgccaccgtgaaagtaaaatagtaataccagttcaaatagtcaccgttcaaaaaacaaaatgct

SEQ ID NO: 49283 - DNA, 1111 bp, Oryza sativa
aaaatcccttatatttagggacggagggagtatgtatagtagatgagctataaggttatctttatttttcttctcttctttatattcctcatctatgtatttaatgtatttatcttgaagtgtgtgaatagctaacttttgcataaaaatcgaccgcttcattttttagattctctcttctttacataagtggtttataacctactaatagtattaatcttgttctaacatgtaaaatgtaacctctacacaatcttaaaaaaaatggaaagagaaagtaaaatatatagtgtgagagtgagttagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgttccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtaggga

SEQ ID NO: 49284 - DNA, 1501 bp, Oryza sativa
aatggtgaagtgttttttttttttgaaacactagtgaaggcttacttaactaatccctttacaggttttgagcaggcaatccaatcctatgcgatacatgtgctctccttgacataccagaaagttcctaggcctgttcttgcggaggtaaatgatgtcattttaaattaattattacacgagtcctcgagggagcatgagttttcattcaatcctttttgtttaaactttagatgaccaaggattcgtggtaatattaagtttcatattactaatgctacaaatatttgttacgccagaagtgtcaccatcatcatccaaattttgctatcatttaggtgttattggttgcctcgcacatggattgtcccttgttggctgaaactcattacttttcttttcaggccatcaacattgagggtcttgcattggacaagttcctggagcaccatattgcaaactccggttgggtgatcgagaagggtgcacgatctcagctgattgtccttccacgcaacgagttcaatcaccctgagctcaagaagaacacagctgaaactgttccgttcgagcatgtaactcgcatattccctgtccttagctgagtcaacaaccagaccaactgagattttgcattacagaacttctgagcgcgtgaagatactctgggcgcatctgttttctctgctgtgatgtactgcgttttgatatgcctgttttagctaaacaagtcaattctagtgacgatccgagcgtcatatctgcctagttatgtttatgtaagcattctgccatgatattacattgttggcaagatattttatcaggtcagagcaaaattttgcatagcggccgtgttcggctttgggcacaactcgatcttccatttaccacgagactacaaccattcctcgttgtcagatttttgcgattgctagtgttctgttgcgtaggggactcattgtgaaaaaaaaaacccgtatgtggtcggtgtaaaaacggattggttttagcctattttttcgtacggagttggcttgtagtagttgcatttttttaccagttttcgtttagttttccgcaaaagtggggagtggttttgacttccaaaaacaggataataaactcttattaccacaagcatctcttagaaaaaacaaatatgtatatcatttcatcgagcgaaacagcttggatatcgatttttgttgtcgctggcaaaagaaaccgcccaaattcatattgaggaaaaaggagtaaattcacatgaacagggggtctttctgcaaaaagaaaaaaaacttgggccggcccatgcacaccctgcccaaggagagtcgctgcctcacctaaacgccaattagggttttcaggggggcggagatataatgacataaaagcccctctccttcctcctcccttctccttcgcgccgccactctctccgagctctcgcctctcctcctcccccgtcttcccttcgcgcgcgccacccccacac

SEQ ID NO: 49285 - DNA, 1501 bp, Oryza sativa
gctataagtagcaaagaaatgacatggtggggttacactgttacgcttgatggcatgaaatctaagggtttctaaccctttctgcaaatgaggacaaacggctggtcttatactagtgttactcatggtttgatgcttccaaattctgaactttatgcaagtctgtgggagtataaccaaccctgggtaaacactaaagacaggctgtgggctgaaagaagagcccatggtattctttcctactgttttgtgctatactaaagtatactcttttcatgacagcatctacaccggttcacattagctccaacctattctaacaagattttgacagtatcatttggagggtatattcagaaaacctttctttgtgcacgtggatatgattttgagttttgtcataatgctcacatgccagagagagagagagagattaagacatcactgtgtgttttgccattggacattggacagtgtttgggcgagctccacatgttagtgactagactaagagcattaagatttacaattgttgtatattcattcatatcatcaaatgctccttgaataggactcctttggattaaaggcacttcaaaggaaatttggaggattttatttcttcggaaaatttccgtatactagctcatttagaacaaagggatgccattggtccatctctcataaacacataataagatccatgctgcagctggctacaaatctatactctagtatgattttcttctctctctcttttcacatgcgcttgtagttactccccccgtcccattttaattgcagtagaatagtgtgggtttctgtatctaacgtttgactgtccatcttattttaaaaaattaaataaaataagtcacaaataaagtatcattcatgttttatcatataataataataaaaatattgtttataaaaatatttcaaataaaacggatgataaaacgttgcgcgcataaacccacaattacatttaaaatgggacagatggagtagtttatagcatgctattgtatttgttgaacccttaatcccagaaaatctccacatctactgaaccttataggtgtgtttggcaaatgagttatgagaggtgtgattgttaaagggaaatagatgaatggctataattaaatgaggtgagaagtatggatgctagtgtacaatattaccctatcctttttttcccaataaagtctatgtccttatcccagtaaagttcacaacatcgaatatccaatcaatttaacctgcaaccaacttttgccacaatttttttaaggagacgaattgacaacgaggcagcccacagacttcggcgcccacaagatcgggagatagcggcccacggagactagacagcccatccccacatcagccagcgacggcgacgccgacgacgacgacttttcctctatttaccactctcccgcgtcgcgccatagcgacgtctctcccggagaaagaagagcgcgccgcgcca

SEQ ID NO: 49286 - DNA, 617 bp, Oryza sativa
ggtttcatatatatggagagatctttgtgtcagcaattgaagctcacgcgctttactttgttataatggctgtgtttttgttcgtttatggttgattagattcttgagtgatttaatgtcctcactgtctgtgtgagggatctcctttatgattggttcgcttagtttttgttatagggtaaaaggctgcaaaaaggtaagggaagatccctccttttgttttcttttgcaggggagaagagcgtttaagaaaagaggttataaaggggggattttttcttaaagggggctatcgtttttcaggcagattaaacatttgctttctgatgatcttgtttaatcatcattatctaaaaaagattttgtttattgatggatgctgaaccgccgtgttgtttgcccacgaatgtgtaattgaatcctgctatgctagtgccaaaatacattgtttgagctgatcttgtgcattactgtatatatattgggattttcaacgcgtagttagctttcagcttcgtgatgcagaaaccaaggtttctctatttgtacagcaacaatttataggagctatttttcttcctcaatgactgtttcattgctacaagggagtgttgatg

SEQ ID NO: 49287 - DNA, 1501 bp, Oryza sativa
tcggcggcggtcagccgccggggcaccctcgccggggtgaaatcggcgaggattgcaccgccgcacatggcgcggcgcgctcttctttctccgggagagacgtcgctatggcgcgacgcgggagagtggtaaatagaggaaaagtcgtcgtcgtcggcgtcgccgtcgctggctgatgtggggatgggctgtctagtctccgtgggccgctatctcccgatcttgtgggcgccgaagtctgtgggctgcctcgttgtcaattcgtctccttaaaaaaattgtggcaaaagttggttgcaggttaaattgattggatattcgatgttgtgaactttactgggataaggacatagactttattgggaaaaaaaggatagggtaatattgtacactagcatccatacttctcacctcatttaattatagccattcatctatttccctttaacaatcacacctctcataactcatttgccaaacacacctataaggttcagtagatgtggagattttctgggattaagggttcaacaaatacaatagcatgctataaactactccatctgtcccattttaaatgtaattgtgggtttatgcgcgcaacgttttatcatccgttttatttgaaatatttttataaacaatatttttattattattatatgataaaacatgaatgatactttatttgtgacttattttatttaattttttaaaataagatggacagtcaaacgttagatacagaaacccacactattctactgcaattaaaatgggacggggggagtaactacaagcgcatgtgaaaagagagagagaagaaaatcatactagagtatagatttgtagccagctgcagcatggatcttattatgtgtttatgagagatggaccaatggcatccctttgttctaaatgagctagtatacggaaattttccgaagaaataaaatcctccaaatttcctttgaagtgcctttaatccaaaggagtcctattcaaggagcatttgatgatatgaatgaatatacaacaattgtaaatcttaatgctcttagtctagtcactaacatgtggagctcgcccaaacactgtccaatgtccaatggcaaaacacacagtgatgtcttaatctctctctctctctctggcatgtgagcattatgacaaaactcaaaatcatatccacgtgcacaaagaaaggttttctgaatataccctccaaatgatactgtcaaaatcttgttagaataggttggagctaatgtgaaccggtgtagatgctgtcatgaaaagagtatactttagtatagcacaaaacagtaggaaagaataccatgggctcttctttcagcccacagcctgtctttagtgtttacccagggttggttatactcccacagacttgcataaagttcagaatttggaagcatcaaaccatgagtaacactagtataagaccagccgtttgtcctcatttgcagaaagggttagaaac

SEQ ID NO: 49288 - DNA, 1501 bp, Oryza sativa
gtcttaactaattatcaccttgcatgcgaatccccacgaagttatcccgcaccaattctgcgtgatcatggcactgtagattcagcactgagctttagctttacgcggagaaaatttttagttgatcttgtaataagaaaggcaggtagttaattaaagagtactgctctggtaagtttcattaaacatcgaaaaataatttataagtaaaaattttatatcggtgttattattggcagtctaaaaacaaagggctaataaataggctaacatgaaaaatgacccaaaaataatcatctctaagattaagttataattttaaatttactttagcctgataagccaataaataaacgatgaaaataataatccggtaaacctaaacaagctaatgctatacatgttatctttaattaggtttatcaggtaccgacaactacttctgttcatattaattgtgaggataaagatgtagcggtatttctaaccgaaaataaatataatgacaaatattcttaatatacatttaataaaaactggttaggtgttgtagtaaataaagtttaacttggagagaaaaaccaagtgatatggagtgcgtggttactagtaaaacaaactaatgattgatagctagaaggtggagtagggggtaacacttcaggcaagcctactaatttccctccacaaaggatcctaaatgctataggttaagttgattactcagcaatgatgtcacacacttccacaaatactaacaattaagctctccaataacaacaaaaattcagtttaaggtagctagagaacagatcaacaacaaagctaaagggattagagcagacgacaggctaattagcattgttattatccaccatccgcatttttttaagcatgtctccttcccaatgcttttctgcacttatggctattttttaggaatcgatcgcgatcgatccttgaatggtaagttcaatgctcccttcttaaaatatgtggctcgtggtcaccacgctccacttacttggcaaagcagcaaatataattaataaaatgagctgcttccgaggaaaataaaaaatagtactagaagaagattccactaaagcactgtaaaaatagataaatagcacaacttaccaacatgacagtgatcagcgctcttcatggaaacaatttaggggccaatatgacaccctgaagcctaatgtttatgatcaagttttgaacatggagagtaccatctccagaacttagacatttaaattctattcttgtgatattttatttactcttttaaatatggaaacctaaatactaccaactactgcaattttcgcaccgtgtagatacatgaagcacgcgtccatccacatcaccccatgtactagaatactgtcatatggatttcgagtatttttttttgaaattggtaaatcataatatggaaaatacatttttttaacgattgtactgaaataattttcatatatcaataaat

SEQ ID NO: 49289 - DNA, 1501 bp, Oryza sativa
atctccgataaaagttggataaactttagcataaatgtggcacgtttttcaaactgctaaacggtgtgtttcgtgcgaaaactttctatatgaaagttgtctaaaatatcagattaatccatttttcaagtttgtaatgattaaaactcaattaatcacacgttattaccatctcgttttacgtaaaacacttaatctttgtctttatcttcatcttcaggagattcaaacaccacctatttatccgaaattgctatttagcgcagctgtgttttcggcacatattttctgataaaagtttttggagttttagtttagaattgtgtaattcttgatggatgttttgaggccatagtcaggagtttggtaatatgattttaagttataattcgtatgatttggtttcttgaaaaacacttgtatggtttgagttgaaagtttgttactaaaatggaaaaaagtgcgggtggacaacgtagctacgctaattaactccttcaatggcacatatatgtccttggagcatcaaggtgtcaactttttaaaaagctagatgacatcccgtattttgctgcatgatatacaaataaatacatcttaaattttgtagaatgattgatgagttttggttcaaatattgtgaaaatgatataataagtatgatgatttaccaggcttatatatcgagtttaaattttagtaatttgtaaatgatgtagtatagttgtattttaagttataatatgtactatattattgtacttgcatgttgatcatttgatgcttagtggctgtaactatataaaagatatagattaattatgtagtgtcaagtttgctctgattgtgtaatatgttctgatttcgcctatgttctttttatgcccacaacttcgaagttttgctcgataatatatgactgttgtcaagtaagtgccgctcatacatattgtatgcctaatctggtaagttattgtataaagggagagagagacgaattcaatgtcataaacttgatagcgtataaaatactctctgattttatgttagtgcctttaattaggtcacctatatatttattcctcataattagctcagatccactcttcaaagatgagcttccactaaacaaaatatgatgcccccactcggccaactcatcagcccaacacacaccaaatgcacctgcactacatattcctctcacagtatcaccctttctcctctcgagcgcatatgacattttgttttatttgatacaaagataaactggtggttttttataatgcaattctggacgagctagaatttaaaataaaaattacaatggtgacattaaaccttcataacaaatagtatgatgacttttttttacctcttctagtaatatactaacaggcaaacaattgcggagtggtctgtcccctccaacaaatttttttgacatagttatctaactaattaattaattaacctaaataatggtgtattaggtctcctc

SEQ ID NO: 49290 - DNA, 274 bp, Oryza sativa
  unsure (1)..(274): unsure at all n locations
agggatgtagncctgattngcccactgananccagctnnnnnnnnnnnnnnnnnnnnnnnnnnnnnnnnnnnnnnnnnnagtggtcacgaacacaaactcagtcgatgcaccggaatatatttggtgtccatgccatgattgcaagaaagacagacaacttccagctaagcgggtccatttacatctccttacaaggggttttatggacaacttccttggcgaggaggagcaaggtgagggaagtgccggcaactgtcacgggcatgatgcaga

SEQ ID NO: 49291 - DNA, 410 bp, Oryza sativa
agatgtgtcttgtgggtaaagatgtacacctctgatcagagtataacctattcgaatagacgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaaatgctgtttactgcaaaacctaacccttatattattaccccttgtctcattcttgctcaatctttcccccccccccttcagt

SEQ ID NO: 49292 - DNA, 257 bp, Oryza sativa
  unsure (1)..(257): unsure at all n locations
ttcctcttcaccgcggtggcctccctcctcgcgacgaatgacgacgactgcgaaaacgcgaagggttccttcttctccaacgtcggggcggcgggcgccntccttcatgacgtccgcgcgttgcngcatccttcctggccgcnggcggcctccctcttggacgacgacgacgaccgcgacgccgccgacagctccttccgctctagatccgcgcgccgcggacagctccctccgctctagatccgcgcgccgccagc

SEQ ID NO: 49293 - DNA, 287 bp, Oryza sativa
tgtagtgagtaggtagaggatcataggttgcaccagcaagaaaggcagatcgatcactgtaaagatcattgtaacttaggctgacttcagtccttttccatcacatcaacctgtcatacacacacaacttttcagtcacatcatctccaatttcaaccaaaatccaaactttgagctgaactaaacacagccttataagcatgagtgtagttcttcaagtgttctaaggcctagcagtattaggatctatggatagacattctgaaaccataattttgtttttcaga

SEQ ID NO: 49294 - DNA, 231 bp, Oryza sativa
  unsure (1)..(231): unsure at all n locations
agggtgtgaaatgtatcgcctgctagctgctgcgtagatgctggtannnnnnnnnnnnnnnnnnnnnnnncgattgagatttttcctcacatcagtgacctttgcccattgacgggggccttacccgatagtgatgatgctttcagcccgtcacagataagcgatcctgttctagtgtatgggcttcacaatttattttttttgaaaagtatgtcatgtttattttgtagt

SEQ ID NO: 49295 - DNA, 337 bp, Oryza sativa
ttttgcaccatttggccttcatatctggactttttgtgtttataaggttgagaagatgtttttggcacaatgttaaattttgcataactaaactaattaaaaaaatccttagtcaaaacagaactatattatgattttctcaaagagtaaagtacataatagaaggcaagaattaattgatgccctaaagatacttgactggtagctaggttcatcctgccatgatctctccatatactacattgcttattttgtgcaggtagggcgttgcttcggtacacctcttttcaaaagtctactaatttcatgtcaaggtagttaatattttttttttgag

SEQ ID NO: 49296 - DNA, 292 bp, Oryza sativa
ggagcatcggtgcgtcagccgtggattcgcaggtggtgagcggcgggtgaaaacccagtctggccttggccggaccgacaacgatggttcattccccctcctgagggcgttgtcgtgctgtctcacccctcaagggtgattgccgggtgaaagcccagtcttggctcctttgagtcccgacggacggcggcggtagttttttcgtcgcttctcttcttgaagacgccgttttggcatcccctagggggcgatctcgtctgtgtccctttgttagtctagtggcagtcggtca

SEQ ID NO: 49297 - DNA, 1501 bp, Oryza sativa
ttttgatacatcattgattgcatggtcttgtaggaaacaatctagtatagctcaatcaactactgaatcagaatatgttgctgctgctagttcttgttctcagattcgttgtctaatatcaatttcgaaagattatggtcttacttttgagaatgtacctcttttttatgataatactagtgctattaacattgctaagaatcctgtacaacactcacgtacaaagcacattgatattcgctttgactttttgagggatcatgttgagaaggaagatgttgaattgacatttttggatacaaagttacaacttgctgatattttcaccaaaccattggattcttcttgctttgcctttcttcgtgtttattattcaatctatgtgcttgtaaagatgttgcattataaatcatatgaaatctgaattttgattgttgatttgaacttaattgtaacatctatggttcatgattatactttagtgcatgcttgctatgttatggatgggttcatcttcttcttattgcaacacataacttgatgtgctatatgtatgctaagctcttgaatattaatgaacataattcctatgcttgctgaaatcattatcaaaagggggagaagagatacaagtgcatgtttttcaggtcaagggggaatttctttctttttaaagggagagaagttttttttttgaatttttgagcactccttgctttttaccacttttgtttttatttttccaaacaccaaaacattttatttatgggtttgccaacgtgttcatcaagggggagattgtaaaatcaaagtgtgtttgattcttattctgtgatgaacaattggcatatgagattattggtttgatatttggagtttattggtgaagtggtttttggagatgaataggtactgctggagatttggtcctgtcagaccgggcagtgggtgccggtcagaccggtgtgctcaggttatttcgttggatatccctggataatttgtgtttatgactttaagatggatactatgcgtatgtaatactattgtttgctaatatggtttcttgtttgattcatgtgaaggtaatcttgacacctcgggagagtgttgctggtgatggatcgggagtcaactttgagatatggtaacgtccggatggtcagatatcatgcgggacactcacactaaagatgaatgcatgtggttggtgaagattccatatgacatacggtggagatattgtgtgagtatgagatgcggtgtagaatttggaaggagtccaaatttggtacaattgaaatttgtaaagttggtttcttgtacgggaaggtttcctagtgggattaggacttcttatacgaattttgtccgaggctttaagctgcctacctcatgtatcaatagagagggagggtgtgcatcccggtatcgctttagagagcattgagttgagataatagttagggttttgagtttagtcaagattttcgtgaggagt

SEQ ID NO: 49298 - DNA, 314 bp, Oryza sativa
ggtcttagcggtcatggaaacaaataagtcaagtaaaaaaatatcatctaagaaaacaaagactcggatatattcaagtatgtagtaatagtagtagaaaatggatgaaaacaactactacatgcttcaaattttcgtatgttggtaattgtatatgcaaaattaagggtgattgcttgcatatcatgatatcgttatagtaacaatgtagttgctttttagaaaaaaaagggataaaatatacaattgaaaaaaatagaactagaaatgattgtttggtgcaatttagatttaacctatcctttctcgaaaga

SEQ ID NO: 49299 - DNA, 1433 bp, Oryza sativa
aattaatccatcaattttaatcaccactaaccagcacacccatgctgtcaaggcccaaccatcctgaacacccataccgggctgtacagatctatctccaaaccaggaatataccattccaaaccaggagctaaacaaattatttccatttatagcatcttttattacggtgagaagtgtgaaactaatcacgaaagacattgttagacccacccataaccgcggacacggctattcgaatagttttactctggccagaggtgtaccactgtatccacaagacacagccccacaacatgtcaccatgtgcctcaataccaccacggtacctcggaaaggagatgtgacagtacccctcgcacaacacaatccaccacagtgcaccgttcctggatcataatcacccccttataaacaaggcatggactccccagcgacccccgtgggcttatctccgccacttctcagtctggtgctccgcaatgaaccatactatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcatgattggccatcgtgagctatcattaagccatcattaaataatagtgagtcataagttatcccaatagtgtgctaatgtttctaagcatggctaagcaatcatatctaatatctagctgaaccaatatatatagcccgactagtccagttataataacccaaggtatcaaggaataaagtaatcaagaacaaaagggctataacaaacaataggttaattccacccaatgacattcgaaaataaatgcaatagttgaatggaaacaatagctttaaatgggatcaacatgctcaaagggttatttgggatctgtgtaacttgccttgctggccttggaactcttcaaattcttctcctgcgaaaacgaactctccgaaaacgtcggaatctaaacagaaaggagcaaaacaccaaaacagcacataaacaagcatgaacagtacatgtggatatttttaacatgtatatctcaattttagaaaaattttgagacttgaaccaactaaatccgagctgtgatgaattagttatgaatttttaaagattaaatcagattaaaacacttatatgggtattaattgaattatgacgcaataatgaattatttttgaaaaggaaaagggaattattgcgtcagcggctagggttcgcggtgaaccgggtgcacggcggcggctcacggaaacgaacggccgagatcgatcctatccaaaatggacggccaagatcgatcggatccaccgtggctcacggatggacgacgacga

SEQ ID NO: 49300 - DNA, 781 bp, Oryza sativa
taatttttataactcacatatactatttatcatgtagtttttttttaataacgcgtgtgatttctatctagtaccaataattcgctcattcgctgtgccctcgagaaaatataataataattcaatgtgcgacggtgacgacatgagtgataggactatttcatccccctcatttctctgaccaaataaaaacatgattcactccatccatctaaccaaacatcctatcacaaaatttagagaataatccaatccatctcagctcgatctcacaccaaacacgtactaagataagaagtgggtagatgctggcagaacaagttgacaaaagaagaggacaagatcgatttaggccatgttcagttctcaaaacaaaatttttcacgctgtcacattgaaatgtttggacacatgtaaagtattaaatgtaaaaaaaaataactacacagattgcatgtaaattacgggacgaaccttttaagcctaattacagcataatttgacaatattgtgctacagtaaacatttgctaatgacaaattaattaggcttaataaattcgcctcgcaattttctggcggaatctgtcatttgtttcgttattagactacgtttaataattcaaatgtgtgtccgtgtatccaaaacccaaaaattttccccaactggacgaggcctttacaccccataattctcgagtggcagagtgaagaacaagctagacaggatcgatcgatggccggcggcagcgagtttgatatccaggaagccgcggcgtcgg

SEQ ID NO: 49301 - DNA, 366 bp, Oryza sativa
gagtgttctatgataaatttaaccttgcaaaaatatatgttatttcaagttgtatactaactaggcgcatgtcatagaaacatcgataaaaaaatcttaaataaatcaataatatatatattacataattgtatatcctttaataacatgcatagtaaaattacatttacattttcaaaactaaaaacaactccagttgtcccaaaaattactcattacttaaaaaatactgaattacatattactaaatttatcatgagtgtatttttatgtattatgtgttttatttattcatatataattagaagttgaagatcaaatatattcttttggcaccatttctatgtcctttatctcgtacttagg

SEQ ID NO: 49302 - DNA, 227 bp, Oryza sativa
gttaaaattgaagaattttgactaaaagaaaaaaaatcaaataaattataatatgaaacggttggaatagtttagaaggttaagtgaactaatgtaatataaaacaatttaaggtgtaaaatggattttctttccaatactaaaaaaacaagaaaacctccatttgaaacgatggattgacgaaataacgagagaagccaagccaagccatctccttcctcttggcc

SEQ ID NO: 49303 - DNA, 1501 bp, Oryza sativa
tggtatgcagtgctaatcccaacaaccataggtcaagaagttcggatatcacacgccatcagaagggtggatcagctcggaggaaaagtaagccttaccaggagaaagatgactctgagaatattgatgaattcgatactgatattatgtcctccaaaaatggaccacccatctctttgacaagcaattcccgtcctcaagcaacatcagtcccaggggaaagagagaaggagatagtagagttgtttaaaagggttcaagcacaattgcgagcaaggggaaaagggaaggaggagaagaagcctgaacaagcaaaagcacagggtgagaggggcagtgttgactcccttctaaatctgcttaggaagcactcagtggaccaacgaaggaagagcggtgatgagaaagaacagagtgttgaccaaacaaagagaagcaatgaatctggaaataaacaaaattcaagcatcttcataaagaatgacactcaggaagaacagaaaaagccacatcctgcagccttcaaaaggccagcttcaaattttaggcgaagatcccctgttcctaatgtaaagttccagcctgttaccaatgttgatgccgaacgagtcatcaataacatcaatgatgccgtacaagaggctaagccaactttggaaaataaggctgctacagatgaaccagactcggtttctacattcgaacctaattctgtaatagaaccagaaaacctatctttggatgaccttgatcatatttcagatgatgaacctgatgcttctgatactgatgaacccagtggagaatatgatgagccatctttgcaaatcccaagtgttccaattattgatgaatctcatgatacgactctgaaatcttccttaggaggtcctgatttaagcactttgaaggtcacagaactaagagaacttgcgaaatctcgaggaatcaaaggatattccaagatgaagaagaatgacctggttgaactgctgagcaacatggcttgatccatcagcagccctgtcaacttggctctgttttgtcccttgttagtcacattgtcttgggcatatgcactatcttgccattcctatcttatctagatgaagttcttttaggtagaaaactgtaaatgagcaaggtaaacaatgttctgttctggttttatcgttgccctttctgttacctagcctctagttaccattgtttttgcgtaaatccttcatcagaattgaaccctggattggccataagactggcaacgattcgacgtcatgctgattatgttctgatgtgtagtgttctattcttatctctgttgtttctcctttctcatggcagctcttgtctgctgttgcatggtttctctcgtttacatccatggttgttactgaacgtttgatgcacaagtcttttgtgtgttcatgaaaagaataagcagaagcaacctataatggatttctttggtgttcaatcgtttactgtctttgttcagagc

SEQ ID NO: 49304 - DNA, 1501 bp, Oryza sativa
ctgaatttctcatttgccaaacagcaatcaggtagatgatcagaaaaccattgttcagtattcctttttttctgaaaacccgtacggttttcctatctgctggcaatcctgtttgccacaacacttgatcagttcatatcatgttttatgttgcagcttgcaaaattttttaaaaaaaaatctgtcatgttttatgttgcagcttgcaaaaattaaaaaaaaaataaatctgtctttttcagcaagtttttttattcaggaacagtaccgctactacagggatgtgaaaaccgacgcgcgaaacggtgggcgccttatgaaaccgtggttttgcgatttgattagtgatattttagtcggcaatttgcgcaaattgctcttatctttcttacctagatgaggccatgacagtgactttgctcaactaaattccaaattaagttggggttgcaggattctcaagcaaatataaaagtttaggtgcgcacacgcagcaagcaaaggcaaattacctaatgaggatgagcagagaacttggcaaggtctgcagggactagcattgtttaaatgcaagttgagtgtgccatggcattatacaccaggaccattacatgctatacctaatctcatctccttcagaaaaaaaaaactactagttgcacacttgcatgattgcatctattatactatgcatgtagtcgtagatagctcgggaagatagcccaattcggtggtccatgattctccattgaagattggatctaccattcattgttcatttgttcttgatataaagttgtgttgagtttcaaatggctacttgaacctgttccactatctgaataattttccctgcagatcctaagaaaaaaaaaatagaatcttcaattctcttgatgataattgttttcatggcttggagggtttgcacaagcttttcttatcctggcatagaactttcaggatcaatagaagaaactgaataattagtaccatcataaccagctcctaacttcttttacttggagaactaccagttggccatgcttatggttgtggaattgcaaatagccctaaaaattttcctctagccattttgtggaattcggattttggttctgaattccatcaaacagatagaactcctccaattaccttcatttccatcgaaaaagaccggtagaacgtgaccaactgcctattcacaacacacaaacattgtgcaagaatttgttagtactgagtgctccgttaacaaaacttcaccaaaagcaaaagaagagtatagatgaacactcatatacgcttcctttcaaaaacaaaacagaaatcactcacatatgaaaacatagatcaccgatctctgctgaaccaatgcaccctgatggaaacaacagccttcagagttcagagttcagatttcagttcagacacccacattggacatcatagtatgcatctgaaaaaggagagaaaacatgaaatggatcatcaacttggg

SEQ ID NO: 49305 - DNA, 1501 bp, Oryza sativa
tctttctactgactactgaggaattctttttaatctaacatgaactacctatggattatttttatgaatgtttgctatattggacactttcttatggcaattgatatggattctttccgtttgacctaatggtgaagtgttttttttttttgaaacactagtgaaggcttacttaactaatccctttacaggttttgagcaggcaatccaatcctatgcgatacatgtgctctccttgacataccagaaagttcctaggcctgttcttgcggaggtaaatgatgtcattttaaattaattattacacgagtcctcgagggagcatgagttttcattcaatcctttttgtttaaactttagatgaccaaggattcgtggtaatattaagtttcatattactaatgctacaaatatttgttacgccagaagtgtcaccatcatcatccaaattttgctatcatttaggtgttattggttgcctcgcacatggattgtcccttgttggctgaaactcattacttttcttttcaggccatcaacattgagggtcttgcattggacaagttcctggagcaccatattgcaaactccggttgggtgatcgagaagggtgcacgatctcagctgattgtccttccacgcaacgagttcaatcaccctgagctcaagaagaacacagctgaaactgttccgttcgagcatgtaactcgcatattccctgtccttagctgagtcaacaaccagaccaactgagattttgcattacagaacttctgagcgcgtgaagatactctgggcgcatctgttttctctgctgtgatgtactgcgttttgatatgcctgttttagctaaacaagtcaattctagtgacgatccgagcgtcatatctgcctagttatgtttatgtaagcattctgccatgatattacattgttggcaagatattttatcaggtcagagcaaaattttgcatagcggccgtgttcggctttgggcacaactcgatcttccatttaccacgagactacaaccattcctcgttgtcagatttttgcgattgctagtgttctgttgcgtaggggactcattgtgaaaaaaaaaacccgtatgtggtcggtgtaaaaacggattggttttagcctattttttcgtacggagttggcttgtagtagttgcatttttttaccagttttcgtttagttttccgcaaaagtggggagtggttttgacttccaaaaacaggataataaactcttattaccacaagcatctcttagaaaaaacaaatatgtatatcatttcatcgagcgaaacagcttggatatcgatttttgttgtcgctggcaaaagaaaccgcccaaattcatattgaggaaaaaggagtaaattcacatgaacagggggtctttctgcaaaaagaaaaaaaacttgggccggcccatgcacaccctgcccaaggagagtcgctgcctcacctaaacgccaattagggttttcagg

SEQ ID NO: 49306 - DNA, 1501 bp, Oryza sativa
ctgcatgcttacaacattttaagatggatgaagaccccaccacccaacacacaaaagattacttccattacacaatcaacaggcaaagactctaattttatcagaacattgagtaaaatcattagactccctccaagggcccttcagagatcaatcaagtctagtaacctagcacactgttcgacaaggcacgcggtaacaattgcattactctaatgtcaattggaccttttcacaagtattacaatgtaggaatgttctcaaatccattggagtaacaaccatctatggcccagttgaatacgtatagcagttagaatatggctagatatgatcagaaaaattcagacttcacactccgtattaatgatgtatcgtgattcatgagacgctaaacaacagctgagaataaaggtaaagatctcatatactgtgatccaagataataaactaatagtagattaaagttattaggtcaatgatcataaaaaaaaagagaggaagtcataccatccacaaaacttctctaagctaatggaataaaataggcaatgcagatcatatgcccaacttgtatcatatgaaatggatgaaagaagggatatgttcttacatgaaagactgatactaacaaaatgacaaatggtttccataacatagcattgcattgcatttgtaatcagataaaactgaactgtattgcaaaacaactaactctaaactccaagctccgaccagttgaagacatgaatggtgagttccattagcacgcggcaccatgttcaacgagttagcaccaaatatctcatatccagcacacgccaaccttttcctagatggaaatcagtacattaactgaaatctcgcaccaattagtgagcctcccgggtcctaaacagtataattagcccgtaaatttccctctatacagtcggccaggccacctaaaatcacaacactaaaatacgcgacgatctcacagggtatcacaaaacaaaaatggaagatgcgtattctccatctctattgctaatcccctaatcccctacgcttcccctcaccccccacccaaaaaaaaactatgcgttaggtacaagtgaacaatgcaggagtgtcgatttgggaaccaaaccagcgcggcgatgagcttggcgttcttcccgcgctcgcgggtgaccacgacgtcgggaggagggggcgaggagcacgctatgaacctccccgtggcgccggctcggcccctcccgccgccggcgtggcgtgctcgtgggaaggtcgcgggaggccgggagaaggggaggaggtgcgaagaggaggacaaggccatggcgtggcgaggcgagcctgagcttgtggagaagacgctgcttcggcctgtgggccccccgcacgttccccctccgcctagatctgggccgacgagcgctgatcgtacagcccagtttgaacattgggctgcttatattgggccgtatttgaatcgggccttcatcttcttttt

SEQ ID NO: 49307 - DNA, 1501 bp, Oryza sativa
tcccatactttcagttccaactcctacctgaatttatgtgtcaagaaacaacagaggttagttcgatgatgaacattcaggttcagatgatgagttgtttactgattgattttgcatgtggcaggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaataagctattttttcttaaagttctagctagcttggtacagttcataagccgtagaaaaacaaaggcaaataggacaatatatcaaaagtcatttttaggtaaagcttttatatctccattcttaccggtttgaaagcaaagtctgcaaaataagactacgatgaatgtcaccaagggaggaaaatccacaagcgaagcatatcgcatctaactttcaggctaatctgcatgcattatacaaagagcgatttttttgggaactaatgaattgacatgcatcgtccattaaaatagaggcctgcatgctttgggcgggcaagatatgttccattgcgtcatatggattggactaaaagtgagatgtcagctttagaatcttgagctggaaacgcattatctgacagttgaatgtgcaaaggttggagcaaactcatctcgtccaccgggaagacgataaaatgcgtccagatctcgctcatgtacataaaaatttcagattgcgaaattatccccagggttaaaagttagcactagtaaagtacttttagtttagggcaatgatgcacaagcctttagcgtgcactggatcggaaaatcagtaaagctttcagttttgttgattctggctgtcagattaaacaatgcaagtagtactgagatgaaaaaaaaagttaactttagccctgcttcgattttctttggccttttcaaattttaatctttctgaagaagttagtgtaggttagcagaatggcagagcagaggaatgttctagtagagcggaaattcagtaaaaaattcagttttgttgaatgtgactatcagattaaacatgtagccatcagtactgaggtaaaaaagttagctttagcctgcttcgattttctttagcctttgcaagttttaagctactgaagaagttagggcatgcatggttagcagaacggcagagcagagcagatgaatgcaggatgatgcagaggagagccagggccgaaatgtttcaaacttcttaatttattccataaccagatgctacatcggacggcagcgacccgcgaccgcg

SEQ ID NO: 49308 - DNA, 338 bp, Oryza sativa
taaagagtaaattgcaccatgcatgcactacaagaaatgacattctacgacgaaaatcccatatataaaaaaaatcatagattaatgatgagtttcatttgtcgataatgtcacaaagactagtacgtagcatcgtccagtcgttgttatgatgaatttaaaacgaaccataaaaaaatatatcatgacaccaaatcaaaatgtcacaaacaaggcatctttgtccaaaaaaaaacagtatgggtggtacgcaatgatgaagttgtacaactagggataaaaatgaagtggatatggatggataatactcataccatattttatttttctttgttaga

SEQ ID NO: 49309 - DNA, 1501 bp, Oryza sativa
atgtatgctactctacttgactcagctcacaacacataaacaacacgattacaaatttatttagtgaatattcagttgaacacactaagtagtgtcatgatatgtatagacaaatatgaataatggtttccatttcttctttataccatgctccacaaaaataaaaaatagtgatgtagaagatattgttgttaaataatagaattttcttaagcaattgcctcttctctaatctgatcttacgccaggaatctttgatgttggtgttgtggtcaagtaagggaaaagagtgtagtttgaaccttctgagctcagttgtgtctaacttctaaatttggtaaaggccaacggaatgaagcaacaggtggactacaaaatttttcaggtttgtcgttatttcagaaattatatattattcctataaccttggttctatactttcatgtgagaggcaagttgacatctcgaatcagatattatggagaagcagctctattgttcgaagtagacagcattgaacatggttaaaagttcaagttggtgtaatcaaatcctttggggcagaatggcaggacctggagcttatgagaacaatgaacatttggattatttatgcaaagaacaatggctttttatttctttattgttagatcctatggagttacaaaattatttatgcaaagttaattaattggagtatccaggattcaagtcttatgagattatgtgtaaattggtatgtaagagaaactggtgtccttatgacaatcacatatatatcagttggcaactacacatgaccaatatgatcaaattttggtgcacaggtttggtcttgtggcatttgccatctttccatatgatatgcatcttgccctcttttagttttgttatttgaacttttaggtttgaaaataaaattagttggttgggtcaatgatagagtataaagtatagaaaagaagctatagatctttcttatcttttcattttctaaagcaatagtaagcactatgttatgcgcaaacatagtagccttaaaataatttagagcaagtttaatagtatagcctactactagcttcaaatcatctatagcctttgtaatagctaattcatacaataattacttactatactattaatacatggtcccacctgtcatacacatattatatcttgtagtccgtgctacagctgactacagatatgtagaccgctgctcttctctctcttcctttatctctttaaattatatttattgctagcttatagactgctattgtacctgctcttaatatatatcaataaaaaaatctttaggtgcaatatgtttggtttagtttaaatattgaccacaacgtgcattgcacgtgcataattatcatgtactaatcccatagcccatactcgcttcacaattatcatgtactaatctcatagcccttactcgtctctcctctcccgagtcccgactcccgactcctctgattccttaaga

SEQ ID NO: 49310 - DNA, 285 bp, Oryza sativa
  unsure (1)..(285): unsure at all n locations
agggaagttngcctgatancnccttgnanncactgatatcngctnnnnnnnnnnnnnnnnnnnnnnnnnnnnnnnnnnnnnnnnnntattttcataaattatactatattttatatgttataatatcagttagatatgtattataccaacactgttgtacatgttgaacttaattagcaccgtctagtctatgataaaacttattatataacatgagctaattatgcgtgatgttatttgtttctattagaagtttagttagtggttttcgtgttccgagtaata

SEQ ID NO: 49311 - DNA, 1232 bp, Oryza sativa
cagttgaaaagaatttggaaaagctggatcttcatttctggctactggcttccggttcgttttttagattatatctttacctattaaaaaattaaaaatgattccgtactcatcgtatttttgtccgtcgtctcttcgttccagcaaaccgtcttgtcatatatgtgtttagcgttttgacgatatttccttttttttctccacctccaatacgttttctacacatatagacctaaaagtgtaaaagggcccaacgtctatcacaagctgtctctctattttgggctgtctcagggcccctttgaatcgtaggattgaaaaaacggaggaattggaaaaacacaggattttggtaggaatgcaagtgtaaaaacagaggattgcaaaacacaggaaaaatataggaatgaccgtttgattagaccacaggaaaaatgcaggaattggatgagagagatagactctgggaaagttttccaagaggttagagtggatgttaaatttcctacgtttttgctctagaattgtaggaataggaaagtttcctacgtttttctttttctcattcctacgaatcaaaggcatgaatagtgtaggatttcaattcctttgtttttcctccatttttcctccaattcaaagggggcctcagtgtaaaatatagcctatcttctgaattatttcagatttatttgtgtttatttcattaattttgtaacatgcaaatgcaaaacatactgaattttgtatgggcagcttggatgcatgttcatttattttgtgaaggattcatctacatataattctttttaacatcattttttaacatatgattttgttgggctatttaggattaggtgatttatatattactaaaaactgaagttgtttccgtcgatggttttgggatgtcatccggatttgagttaatttttaaattcattcgcttttaaaagtacaagggtttggaattggatatcatctcaaaataaaattcccatatactttttttaaaaaaatatatataataataatacgattaaaacattcttcacccgttacaacgcacggaattctttctagttactacataaattaaagcctactagatgagaagatgctaatataaatttaaaatgctgaagtttttcaattcggatcctctctgttgtggaggagaaaattcaaaggtttgctacagtacccagcatttggagtgctgtggatcattc

SEQ ID NO: 49312 - DNA, 316 bp, Oryza sativa
  unsure (1)..(316): unsure at all n locations
agatcgaccttacccgatgtagcattaagcgtgaagagaaatgaagtttctaataaanccgatgagagcttgttcgagatggtagatataccacataatctagcttaatatcaaagcctaagcctatcggccgctttcgatgatagaggttagctgatgaagctcagatgatgagatcgatctatatcatgcgatatatatgataactcagcgacttgcgtcgacaagattagagtgttatgaagatgtaagcactaatcccgagaacgcaagccgccatgacaagatttacctcttcgtcgaagatcgaacctga

SEQ ID NO: 49313 - DNA, 232 bp, Oryza sativa
tttagttccttcttatttatttatgactgtcgatcgatacatatatgacatcggcgcaaagataaatgatatgtcatcggcacctagccgatcggctatcgtttatagatttaaccacggtttctttgtctttatttcttgttgattgcatgatcaaatcaactggcacgctaacatatccgaaggcgagttttggacctgcactagagttaagcagatctcccaggcctca

SEQ ID NO: 49314 - DNA, 1501 bp, Oryza sativa
ctctattcccgcaaaaaaagaaaaaaaaaagaggtatagctatctgtgctcacagttgggaagcttcgcaaattcagggatgtaaaacaagctatttactgaacagaagtaatgctagccgtgcattcttaagtctgaacatgtcacacattttagttcaaagacttcaagctatttcttctgagactacaatctgcaggaaccaaagttgttatgaatctgcaggaactaaaatctcagatgataagatcagaaaggcacacagcaagctcaatcaccagcaaatcatcattcgggcatggagggctcaatattcccattttgcttttcgtgggcgactaaagtttcgccgaccaaattcattaaaatcttgagggagtttgatacaaattacaacaagtatggttgttgcatcagcatttaaacacataagaactagccccggggacccaatgagaacaaacaccacacagggattagtctctgcgtatagtaaacaaagttaaacaggataacatatgtactgcaactctgctagttctagaacaacaaaatgattcagatttctttcagcttgaagacaaattgtagctccatttatccagaaaatgatgcatagtcgtcacaaaaagttaaagcacaaacacagagagctactaggctcatgaattttctgaataccaagtgccaacatatgaatagaggcaaatactgcagtaatgaattgtctgcttcagcttaggggagaaccaaaacgcagacatactaatcagcagctatctcaaaagagaaatcatcagaaatggaacacaaatgcagatgaagaaaaaaaattagatagcaacatgaagacgagtaagaaccagttcgatgtccctttgattgacagaggtcgcagtcgtcagttcgatcggcttcccgtccggtccagtgctaggtgacgatgtagtaaatcgccacacccctaaaatgatggcgacagcaccgcccagaactctgtacgatgtctgcgcggagtcagtcgacgcgggagaaggatccgtgcccgctggtggtggtgagtcgacgagaggcgaagaggaagtcgctggcgcggtggaaggagaaagccttgccgtcgcaagcggtggcgtcgggggaggcggagaggtgatctcggtggcaggacttggcgtcgccgtcgacttcggggaaggagtcggagtagtcggtggcggcggcgcggcaactgtcgacgtgctcggactcggcagtgatggcccaaaaccgggagacgttggcccaaccgggagaaagcctttctacaccccaaaagctagctcatgaggtgagggacccctccccttttaagttggtgccactccccctaaactttcaatgtgggactattcccaacaatctcccccgtcacacattggtgccccttagccctgaccgggctccacacacgagcacatacaggcctcacacccgcggtccactgaccggcccaacacatagg

SEQ ID NO: 49315 - DNA, 482 bp, Oryza sativa
  unsure (1)..(482): unsure at all n locations
agtgggatcttaatgtctaaaagagagaggctcataaaaatttttaaaaaggcagaatgttaacaacagaaaaaaagagtagtatttaaaccagagaccccatatcttgagacgaccccataacagagaaatgggcaaggataggaagagtattatataactggggaggaacctagggtataggggggagggctttatacccaagaatatgctgattttaaggtgatagtttaaagaaatccaaacaatgggtcttataatggttttacaaaacaaacaagccccaaatggacaattaaaagggttaaaacnatctttggcaaggaatcttnnnngnctcaccaaacaccatcaacccatctatttctccacaccacactccaatcgtatcctctctctctctcccttatctctctccactacaacactacctcatcacgagcagcgacggggctcttgtcctcgatgataatctccttagc

SEQ ID NO: 49316 - DNA, 704 bp, Oryza sativa
tctttttatacctcataggggaaacaaaatcgttaggttgtatgctatgtctataaggatgaaaatcgaattcggtgtaaaattaagggacctcagatgaacttattcctcgtattttctctctcggcctattccgtcgtcttcagaatacgcgcgcggacttgggggagcctgaaaatttgccgttgcgtagtaccactccgcgtcgccggcgccggccaaggcagagatcttatttggaagtgaaacgaagtcaagccaactgtctgtctgtatgactaccgtattcatcttcgtgcttcctctccaaataaaacatcatttgaggcccgctggttggtgaatttattttattaaaaaaagataatggaaggtcaagactattcaagaggtaatctctctggcctctgcaactgtacgcatgactctggggcaatatattagttgcaaagttgcaaattactaaattctaaacactgagtatttctgaatagagtggtataacaatcatagaggaacagatagatatgcagccatgcaggtatcagaggtatagctatctgtgacaggttcggtggctttcctgcagaattatgcggaaatactgtcactcgtccgacaagccacagccgatcctaatggtaaatctggaaataccttggggggtgtgtccaagccctctgtgaaggagatacatacgaagt

SEQ ID NO: 49317 - DNA, 914 bp, Oryza sativa
cggtgtggtggtgcaagatgctgccgacgacaaggccaccgcacctgtaccggacgagcttcacctgcagcagcgcggcgccgacgttgtcctccggcaacgcggggtagaggtcggcgacgtcggtggccatggcgcggccgctgttggcgagcacgtcgtctaggtcggcgccgtcgacggtggcctcgacgacgagcacgccctggtcgttcacgtggaggaagcggcggccgtggtggtcgacggcgaggcggccggcgaggtgagggtacgccgcgacggccctgaggaggccctccttgatcgcctcgttcgacggcgccggcgcccggtacgcgagcacgctgggtacgtacaggtcgaacgccgcccggtcgaacacggtgagctggacctccgcgccggcgagcgggtgcggcgtgccgtacaccggcgccagcatcgccgtgcttgtaatcttcatcttaattacacctcgtcacctcgtcttaattactttggagtggcatgcatacaaccgcttatatagagctccgaactatatgtagaacagtgtgtgatcaaccacccccagtacatttattttgggctatttatttgtacacgtcaagaccaaaacgagagtaggtatcaaccactccgcttataaaaatgactaaattcaaatcaatttgggaaataattccatgttctaaatggggaaagtattctaaactcttgagaagacaccaattcttgtttgcatgccactcaaatagttatgcaaaaatttgaaaaaaagatcaacatgatagtttaatatgtgcttgatcattacacaagcatgcaaaaataaaatttaacttcaacatgttgcaacgaaaaatacactaaaattcaaatcggtttaggaaataattccatgttccaaa

SEQ ID NO: 49318 - DNA, 1501 bp, Oryza sativa
gagttagttgttttgcaatacagttcagttttatctgattacaaatgcaatgcaatgctatgttatggaaaccatttgtcattttgttagtatcagtctttcatgtaagaacatatcccttctttcatccatttcatatgatacaagttgggcatatgatctgcattgcctattttattccattagcttagagaagttttgtggatggtatgacttcctctctttttttttatgatcattgacctaataactttaatctactattagtttattatcttggatcacagtatatgagatctttacctttattctcagctgttgtttagcgtctcatgaatcacgatacatcattaatacggagtgtgaagtctgaatttttctgatcatatctagccatattctaactgctatacgtattcaactgggccatagatggttgttactccaatggatttgagaacattcctacattgtaatacttgtgaaaaggtccaattgacattagagtaatgcaattgttaccgcgtgccttgtcgaacagtgtgctaggttactagacttgattgatctctgaagggcccttggagggagtctaatgattttactcaatgttctgataaaattagagtctttgcctgttgattgtgtaatggaagtaatcttttgtgtgttgggtggtggggtcttcatccatcttaaaatgttgtaagcatgcagagtacatgttaaagtaatcatgaatgtgctgctgcagccacctattattttctcagaagaagattcaatttgtgttcaaaaataagcagtccttttgtatcatccagcttattgctatctagttttcacatcagttttctaattgaattttgtaggaaaaacataatgtacaaagtcttgagcttcctcttattaaacatgttgaagggccagatacagataggctttctgctgtcctgcgcggtaagtagttcagtctttatttttctagtaatataactttatgtgtttctgtcttgcgttgtatatccattgctccacatatagtatattctcattacacttgctttgcaaaatcataataaaagtattccatagtttagtcacttaatattttgtattttcagatgaaaagtttgactggatcactataacatctcctgaggcagctgctgtgttccttgagggatggaagtaagattcaaacatatttcaattatcgtgcgcaattgctacagaaatataaattgtgcatcatttcacacttcattcgtcctaagttctgggctttgtggcataggtttgtgcactctgtgatttgcttgttgtctaacccaatatatgatatgttcttcaatcaatccattattctgtgatgcaccagaacaatccaaaaccaccatattaacacaagttacataacgacctatcagggctgctggaaatcctaaggtacgaatagcggttgttggagcaggtactgaaagagtttttgacgaagtaa

SEQ ID NO: 49319 - DNA, 1501 bp, Oryza sativa
gcttaaacaaattaggaagaagattaaactttaaagcaagcagcagcgattagtggcgagcacgatgcatatggccatcggtatacagtggcatatcacaaaaagctcaataatactgtgtgtcggatcgtgatgcaaatgcttcttgggcccaaaaaagggggaaattaatcaatcgtggtttgacaaaatgatttaaatttctaacctgaaggccttaagcattattggtcttctacctgatgaccatgaacatgcatgacgattaattcttcgccgttgaaaaggccctaattaagcatatattgacgatttcaatataatcaggaacatgtattgaatatacatgtacacggccaattatttctgtataattatgttggataaatatttccaatcagaaaacatctctagttgttacaaagtactgcctctattgtttcacaaacaatttgtctattgtttcagacattgactactacattttttatacgattggacaaaccaaaacacctatggctttgcagcaataattggccttatatgtatacatggagaagacgatggagaaagtagtagtagagagtacgtttacatccaactacatggttctgggtcctgccagaatggacgcattggtccctgggctatatatctctctttcaaaggcatccaaatctatcaatttggatgatatgctgcatggagctaattaagctagcatgcaaacctgataagctagctatatatgcttctgctttgaggagagtgcatgaaatgcaactcatgctactgtttttttttttgtttctttggtttttttttaacagcattgctatacgaatgatagctactgtcgatggaatataggtctttagctagagtagatggttaattaggacaatatagtgtgattatatgtagttctagctactagcgtgggataatttattgtcaactagggacaagattaatgctcaatctattttgggcaccacattcagattccattaagaaaaaaaaaactacctgtattcaagcagaaactttttttttttacggtaagttccttttctagaaaacgtgtccatgacacatttaggcgtaatggctaacaaaaagtgtacagcaaatcaacaaaacactaagctaacaatagatggtcaaacttgtgtatgtaacatatttagtatataatcattttttccaactatatacaaattaaagtcctagggcttacgggaaaaaagtgcctgagatatatgtatgtatctctataagaaaaattgtgctcagttatgtttcaaattatactactaatatttctaaactccaaaatgtgtctcatatgaaaaaaaatgtgattccaacaacatccatatttctaaaaatcacataaaaatgtgatttcctatggaaaagaaaaatgtgattcctaacccgcatcacccgaatggtagaataataattttttaattatataaaaacccctcagatttct

SEQ ID NO: 49320 - DNA, 1501 bp, Oryza sativa
actgcaccaaccaatgcatggcgctcgccattgttgtcctcgccttccccgatcgcgcctcgttctcgcgctcctggatccaacctgatgaaagataaggctgtgaagagaaccgagggcgccgcgacgacgacaacaacgaggaagaaagacttcacatatgacatctggggggaccatttctccggccatctgctggggaaggcaagggaggtggcgccgccatgctacaagatgtttgctgcttctgaaggcgcctccaatagcttcttcgcgagggagccccaggccctggtgacgaagccgccatctccatctccatcttcatcttcatcttcttcgcctccggtgacccgcggtcgcgggtcgctgccgtccgatgtagcatctggttatggaataaattaagaagtttgaaacatttcggccctggctctcctctgcatcatcctgcattcatctgctctgctctgccgttctgctaaccatgcatgccctaacttcttcagtagcttaaaacttgcaaaggctaaagaaaatcgaagcaggctaaagctaacttttttacctcagtactgatggctacatgtttaatctgatagtcacattcaacaaaactgaattttttactgaatttccgctctactagaacattcctctgctctgccattctgctaacctacactaacttcttcagaaagattaaaatttgaaaaggccaaagaaaatcgaagcagggctaaagttaactttttttttcatctcagtactacttgcattgtttaatctgacagccagaatcaacaaaactgaaagctttactgattttccgatccagtgcacgctaaaggcttgtgcatcattgccctaaactaaaagtactttactagtgctaacttttaaccctggggataatttcgcaatctgaaatttttatgtacatgagcgagatctggacgcattttatcgtcttcccggtggacgagatgagtttgctccaacctttgcacattcaactgtcagataatgcgtttccagctcaagattctaaagctgacatctcacttttagtccaatccatatgacgcaatggaacatatcttgcccgcccaaagcatgcaggcctctattttaatggacgatgcatgtcaattcattagttcccaaaaaaatcgctctttgtataatgcatgcagattagcctgaaagttagatgcgatatgcttcgcttgtggattttcctcccttggtgacattcatcgtagtcttattttgcagactttgctttcaaaccggtaagaatggagatataaaagctttacctaaaaatgacttttgatatattgtcctatttgcctttgtttttctacggcttatgaactgtaccaagctagctagaactttaagaaaaaatagcttatttccctgtaatcggttgctttcagctggaattgcagacactcgattacagagccattgacaacatgtatgggagtagaat

SEQ ID NO: 49321 - DNA, 1501 bp, Oryza sativa
tttttcagataagggaaaggcaatcggcttgtcgtcaatcatctgaaacagcagctgtactggatttgcattgtcgtgccaggtcaggtcaacaacgtcaggatcgttggcagcattcgccaatcggatccggctcctctgactttggaagcgaacggaagataaacatagtaaaatgaatctggtgttacagtgcaaaacattgctctgcagtttttttactgtagacacagtaaaaaagtaaaaactactgctttgatttactattcaccagatactgtagatcggacgactgataatggatcaaagtcacggtcttctcagaggatctcggtccttcgcgatcaagttcttggactgcatcacagttatgtcaagcacgtactcaagttgcatacccatctttttactacctccgtcctaaaataagtgtagttttacattattcacgttcaacgtttaaccgttcgtcttatttaaaaaaattttatgattagtattttattgttactagatgataaaacatgaatagtattttatgtgtgattaaatatttttaaatttttcacaaattttttaaataagacggacggttaaatgttgggcacggatatctacggctgtacttattttgggacggatgtagtacgtagtagaaaaattcccttctcactgttaccgtacgcgaccacactttatatcggaccaaatatatcacatgggaccacctatacatttgtcgacaaattttctcctaaaaatttgacagatgtaattatagtacaatcgtagtgtaattacactgtaacttatatgtaattacattgtaacttgcatgtaactacagtgtaacttgtatataagtttcacgtaattttgaatcgttaaatctattacaagatttgttttggtaaggaagaaaaaaaaatcacagcacaaacatatgtgtaaggatttgttcccacaacctccattttaccgaaataacatattacaaagagatttttgaaagttacatataagttacactatagttacagtgtgattacatgcaagttacagtgtaattacactacgattgtactgtaattacatctgtcaaatttttaggagaaaatttgtcgacaaatatatagcaaaatcgtatcacatttagccccgtggaccaagtttctgggccggcccagaactcggataaaaaaaaatctaactacttttccggcccagctattcttttcgtgccctttcctttctcccgaaaatacgggcgcacacgtactccgcatcgcacgaagcacgaaacatctcggatgaatgtgcgggccccacctgtcagggacacacgtcccactgacctgaattcaccgttttacccctccccgttccaacggtcgattccctctgcctgccctctgctttacttgacccacgaggaccacgacgttgaaaaggacccaaaaccccattcctctctgcctcttctctctctctccctcgctta

SEQ ID NO: 49322 - DNA, 1501 bp, Oryza sativa
gttacatgcaagttacaatgtaattacatataagttacagtgtaattacactacgattgtactataattacatctgtcaaatttttaggagaaaatttgtcgacaaatgtataggtggtcccatgtgatatatttggtccgatataaagtgtggtcgcgtacggtaacagtgagaagggaatttttctactacgtactacatccgtcccaaaataagtacagccgtagatatccgtgcccaacatttaaccgtccgtcttatttaaaaaatttgtgaaaaatttaaaaatatttaatcacacataaaatactattcatgttttatcatctagtaacaataaaatactaatcataaaatttttttaaataagacgaacggttaaacgttgaacgtgaataatgtaaaactacacttattttaggacggaggtagtaaaaagatgggtatgcaacttgagtacgtgcttgacataactgtgatgcagtccaagaacttgatcgcgaaggaccgagatcctctgagaagaccgtgactttgatccattatcagtcgtccgatctacagtatctggtgaatagtaaatcaaagcagtagtttttacttttttactgtgtctacagtaaaaaaactgcagagcaatgttttgcactgtaacaccagattcattttactatgtttatcttccgttcgcttccaaagtcagaggagccggatccgattggcgaatgctgccaacgatcctgacgttgttgacctgacctggcacgacaatgcaaatccagtacagctgctgtttcagatgattgacgacaagccgattgcctttcccttatctgaaaaaatttggtcagatcagatgagtcatgaaatggatggatgcatagaggtcggaactgttggatttgtctgacgctgaacgcgatcgatcgatcgatcgagtgatctctcgaaaatgatgccccgtacacgtaggacttgtttactttgctactattttcaacattaacaagttttggcattgccaaattttagtaaggttgtcaaaattttagcaaggctaccaaattttagcaatattttatacgtacttactaaaatttgacaacaaactaaatgtagccactttttttaactttgccaaaaaaaaagtaaagttgaaaatggtagcaaagtgaacgagcccgtaaattactcatacgtaatattgtcaacctaggccttgtttagttacaaacttttaacttttcaatcacatcaaaacttttctacacacgtaaactttcattttttccatcacattgtttcaatttcaaccaaacttccaattttgacgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggcta

SEQ ID NO: 49323 - DNA, 1501 bp, Oryza sativa
tgagatggttggcaagcaatcagaaccagggataccatggcaagtataactgacaaagacgttactcacatgagaaaatagagcgccatcgacctcaagcgcttgaggtgccgttgccaaaggcacggctgcgtatgatgtcttggggaaagtagagtgtgtgcacccagtatcagagctaggcgccgccacctcagatctatgctttgctgcctcgctgcgctgggacagcagaacgacgacctcgctaagccaaaccgccggttccctccgaatcaagtgctagcaggccagttcaagcgatacgccgatacgctgtctcttgaacgacgacctcaccatcttccatcgcgccatcgccagcaacgaagggacaagagaacggtgggggtcgatggcagcgtgaggaatgaggatgtaaggggagaaagggagctggcgcgacctaggaaggaggaaggcggtcgcgatgggctagcgtttcccaaggggatgggaacagagagagagagagaggagaagggcggcggcgggctagggtttgctcaggctccttgcgaagctgcgatcagggttcactctatcggttgaggcatttgtatcgggggtcaccgaaatcccgaaatttcggtccaaaatttctgaaaatttgagcaaaatttagttgaatttgaacaaatattacccaaattcatgaaaaaattgaaaaattgaaaattttcggccaaaataatatcgtatctggggtgaccgaaaatttcggtctgaaatttccaacactggttgcgattggagagacagagaggagggtgtgggtgcggggaaatcgtgtgctgctgagctaacgatcccgacggtcagatatcaatcggatggccaagccagacgattaaagagagcgctccaaattcaccagccttccagcgcgggcggaccgacatgtggacccacatgaaagtatggcccagcgaacagagaaagaacggtaaattttttttgtgtaaaaatcccacgcgccatggcaaagccaccgtgcggggcgatgtggatagcttggggagcgagcacgtcgtgctgaaatccctccgaacgccctggtccgagcagatcgcccttacttttagggccccatcgtttcgctttttttctaataagccaaaacggcttattagaaaataaaaataaatttgtaggtaaaacttttatatatgtgttcttggtgacttaaaagtcaatactgaaatagaaactacgttgaaaatatctcaaaatcaatctcataattaagtttgaaaatttaaaatttagcttttttttctgcttaatgggcaatccgatgggagccttaattaccccgactagacccctatcaaggatccaaagaacttttaccaataaaggagctcgagcaccagccgctggtgtcaccattctcctcttgcaatttcaccaccaccgccacggcctctgcctctcgctctctctctctaggcggcgcaaa

SEQ ID NO: 49324 - DNA, 1501 bp, Oryza sativa
aaaataggtaatagccatcctacatttccttctcagacagatagcagaagagatttaatattagaattagcaccctcaggcagaggcaaccacaattcctacacgataagaattttcatccaaatgggataactgaaccttagatacatgataaatttggccaaaaccggccaagctataaactcaacatcagataccccccgcaaaagacatgatacctacaacctagctgtcacaattggtctgaactgtagataactcatctgtgcaacataaatcacctgagcaagttgtgaaactcccaatactaatgcacaaaactacaattctggaggtaaatgggcaatagagccgtcctacatttcctactcggataaatagtagacgggatttcatatcagaatcagcacactcaggtaagcacatattaaacacgataagcatttcatccaaaaggggtgattcaacctctgatactaaataaatttggctggtgttattcgtcggcccagctgaaaaactcaacctcggatacgcctcacaaaagacatggtatggtacctagcaatcacaattgtttgttgaagatcaaatgtgaagcacaaaacaatcaggaagcagtcattcacctattccattcctcatgatttataaacgatagctatggatgtctgaagctctcctcttaggtagtaataaggattgcattaggaacaagaagagcttgatggtttgtaccaaaaacaaggtacaaacaacgatggcttacagtgggggatgctacatgagggtggaggagagcttgaggcactcgctctggcacctcttgaggcagacgtcgttccagttggggacctggtgctggttgacgcagacggtccgggcgcatgcgtcggcgcaggcgtcgagctcggagacgccgcagacggtgacgcaggtctccgggatggggtccttggagaaggcccccaccttcttgagcatccgcttggaggtgcacacgcgctcgcagacgaacacctcgtcggagctcttctcgcgcccgcgcgccgccttgaggcgctgctcctcgtcccgccgccgcttcacgcggaaggcctgaccggccaccaccgccgggatcgccgcggcgagcagcggccaccacgcgtccaccatcctgggggaatacagacaaaatcgagggcccgcgattatcagatttcgcccaaatcctgaaatccctcacgggccacggggatctacgacgaaatcttgacgcaagtatcaattaggggaaattatggagaggattaggggagaatttggaggggcaccttgggtgtggtgtgggctgcccgcttgctccgttgctcgtcggcgtggaggggggaagcggcggaggaggaaggcgagggttttaggcgaggaagacgaagagatgggtgtcggcgtgtcgcttcttcttcttccactccaagttcattagttggaagtaaatgggctaaaagttgactcagtc

SEQ ID NO: 49325 - DNA, 167 bp, Oryza sativa
caaaatagctttgagcaactaagtgtctttaatgctgtttactgcaaaccctaaccctttatattataacccccttgtactcccttgcatttattctgcacttatgggtgtgtcttgttgagtatggtggttgtactcagtcttgctcaattttttccaaactcaga

SEQ ID NO: 49326 - DNA, 1501 bp, Oryza sativa
ggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtgtaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcgaggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgctatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagatt

SEQ ID NO: 49327 - DNA, 339 bp, Oryza sativa
  unsure (1)..(339): unsure at all n locations
cgcgcccttatttaattgtnnnnnnnnnnnnnnnnnnnnnnnnnnnnnnnnnnnnnnnnnnnnnnnnnnnaaaaaagtttctttatgttttgtgtagacacgattttgcttatggtattaattagtactgcttaatttttttattatacaaatacaatgtaatctttagaaatgagtgaggttgatcactaaaaatatatatagctaaacaaacatgtgatcatgacaatcttcagagtatcatttatatgtttgataaagatctatattttagcatctagtgtgtattcgtcacctattgttcataattgcacgagacacctttactaattttaaaaa

SEQ ID NO: 49328 - DNA, 324 bp, Oryza sativa
acttcggccaggcccgagaggaagaggggagaaaccttgggccagacttggcccaaagggaaggagagggttaattttaggtttttctttttaataaactctgataattgtttttgttgcttaataattatttccggtgctctgaaaattcgagtaaaatttgagggctccttttagaacaaggagaatttagcaaaaattctccgggccacatttgaatttttcttgtacgcattttagtgtttgccaatttcttttcgaattttaattaattctattattccttttagaaaatgatttttatttcgggatgaatttatcagg

SEQ ID NO: 49329 - DNA, 1501 bp, Oryza sativa; identical to SEQ ID NO: 31315

SEQ ID NO: 49330 - DNA, 730 bp, Oryza sativa
  unsure (1)..(730): unsure at all n locations
tggtgcgcgnnnnnnnnnnnnnnnnnnnnnnnnnnnnnnnnnnnnnnntacaagacgtgctcacctgcttacctgtgaaaactgggaggtgttgggccagacttggttcggccgaaccactctggtgcccaatacctctgcaattttctgcagagtttagtgcttccaggtgatcagatatttcaacaattttcagagcatatgcacgtcagaagctgggatatctcccccacacttattcaaaacctgaactttattaaacatagaacaaaaaaaacaaactttggcaaacattggggttaataccaatgagccacattatttatagcaagtgcttacatgattggaaaaaataaaagcaagcacctactactatattattcatgggaaaggaaacatctaattagcataatacatattttcctttcccatctctatgaatgcacgcttgatcttagtgcacaaaccgcgactaagtgtatcaaaattattcctaagctcagcaagttctacccctagctccgcattacgatccctaagctctatgttctccttgtggagtttcttcacttgagtagcgagcttgtggatctaacagttgggctgattaggagaagcattttcacagctatttctacagtggggtacatgagatgaaattgtctgatttaacagcaatcaagcaaagacatgatgagcctgtgcatgagtatattcagagattgagaga

SEQ ID NO: 49331 - DNA, 1501 bp, Oryza sativa
ttattccttgataccttgggttattataacttgactagttgagctttatatattggttcagctagatattagatataattgcttagccctgcttagaaacattagcacactattgggataacttaagatttactattatttaatgatggcttaatgatagttcacgttggtcaatcgtgattggttaattaattaatgtgccaactaaaacctgataatggtgggttgtgagcatatggttttgatggtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctagggagtccatgccttgtttataagggggtgattatgatccaggaaaggtgcgctgtaatggattgtgttgtgcaaggggtattgtcacaactcctttccgagataccgtggtggtattgaggcacatggtgacatgatgtggggttgtgtcttgtgggtacagtggtacacctctgatcggagtaaaactattcgaatagccgtgcccgcggttatgggcgggtctaacaatgtctttcgtgattagtctcacacctctcatcataataaaagatgctataattggtaataatttgattagctcctggtttggaatggtatattcctggtttggagataggactgtgcagccgggatggttgttcagaatggttgggcctatacaacagggtatgttgtatagcgttggattaattttgtttaattattacttaactgttttattaaattctgaaatgtttattaaaggctgtttatgcaaatggaaccctattatgccatcctttgttatcctgtgcacttgcatatttgctgcgtgacttgctgagtatgtcatatactcaccttgcaatcattcatcagaggaagagttctacagtgatgccgatggtgtggaggattaggtgtagccctggtcaagctgcctgtggaatggagtcgtctgcgccgtttatctttctttccgctgcttagatctttattgattgagaggaactatctacctctgtaatgacattttattcgcttattaattagagtaataattgtactctattatcaatttgttattgtgtgcctcggctgattcctagacgagggttcacacacatgtaagcgtttggaattttggatagaaattccgggcgtgacagcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctcttctctacgagctcaggtcttctcccccttcttcccctcttaagtgagcaaggtcctccttttatatctc

SEQ ID NO: 49332 - DNA, 1501 bp, Oryza sativa
acgtcccgttgatcgcccggctcgtcgtctggctgcgctgccaccgtcgtgggcatcgctgcggcgtgtcccacgccgtcctcacctccgtgcagctgctgccggctgccctcgtcgcctccctgtcgggcgtcgtcttcctccttcctcctcgttgtggcgttcgtccctccgtcaagccgatcgcgttcgccgcccgcgtttcgtcaagtgtgcagcagccccgtcgtcgtcctcgtcctcggctccacgtcgtcaagccttgtgccagccgcgtctcgccttcgtccaaggatcgccgctgaagtcgtcccctcgccgttcgtctccgtcgttcccggccgcctccgccgcgcccgttcgtcgttgtcgttcccacgcctcgtcgcgtggtggtaaggatctctctcctctcgctgccccgtcctcgtcctttcggtgtcgcccgtgcccgttgtgcggttgtcgaccccggtacccgtgtactggtgtcggtagtcgttcgcttgtgcgtgtggtgaccgtgttagtgtgcccgctcggtagccgcatggtttccacgtgtgcagcccgtgtggtgtctagtggagtccgtttgtcggccactcgcctcggttgacacacgggatctgcttccgtcgacccgtggaccgtatctgtgtactcggtctaccgcagtcctttaggttgacatgtggggtccgcatgtcaacggcgcagccttcctgtcttttccaggctagcgcttacacatgttttataattgcaaagcttaaattataataatccgcaaatctccatataacagcattaaacttcagatgatcatatcttggtcatacgagctccgaatcgacccgttcaagtctcttaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttatctctgagcaaggcaagtcacatcatccttgagcatattgaatcccagtttataaaattattttaatttaaattaatgcattaccgctttatttaaattcccgcgttatcactgttttatttagccatgcctatttacctttgttaagacattattattgttattgttattattaccttgttcaccctaggataaatcaaaccccaactagtgggtactctattcatggttccactagtatgaatttaggtagatgcttcgctgattaattaggcaacattaggtggttttataactttagactttgggaattctcatatcatttggacactatggaatggttggcttatgttggaattggacacacacctccccctctattcaaaacccccaaaatggctttaggctgggctcgaggtgcgtggttgggttttgttagtcgtacctcgggtactataaggattaa

SEQ ID NO: 49333 - DNA, 428 bp, Oryza sativa
tgaagagaagatctaattttaattaataaattccaatataaaatggggccagataaaattttattaaatactttgcttaattctataattcctagatttttctatgatttatttgagctaaggaagtatttttaataaatggaattgtatttcataaataatttaaattgaaaaaggttttaaaaagtcttcttttggctttgggccgaaagtcggcccaaatcctctctctctctctcctcggcccaagccggcccagtccgcagccgcgcgcgcgccctcgctatcgctgacaggtgggtcccgcctgtcggagtcgtcgtcttcgtcgcgccgccgccgcccgaaaccctagccgagccatgccgccgtctccttccaaatccggccgctcctttcccgatccggtgaaattgattgaggggaaa

SEQ ID NO: 49334 - DNA, 289 bp, Oryza sativa
  unsure (1)..(289): unsure at all n locations
atgactggagcttnnnnnnnnnnnnnnnnnnnnnnnnnnnntctcggcgaggaagagatggaatcaaaggcatgcacctattgtggagaaattggacacgttgctagcatgtgtctcacactctgccctcattgtgaagaagaccatccaccaggggagtgtcccacccgcaaggtcacatgttttctgtgcgaaggtacaaaccatgtgcccaaggattgccaacttagtgtgttgttgaccaagaccgcagaaatccaatgaaccaccctacgattgtctcatcagc

SEQ ID NO: 49335 - DNA, 1501 bp, Oryza sativa
cataatagggttccatttgcataaacagcctttaataaacatttcagaatttaataaaacagttaagtaataattaaacaaaattaatccaacgctatacaacataccctgttgtataggcccaaccattctgaacaaccatcccggctgcacagtcctatctccaaaccaggaatataccattccaaaccaggagctaatcaaattattaccaattatagcatcttttattatgatgagaggtgtgagactaatcacgaaagacattgttagacccgcccataaccgcgggcacggctattcgaatagttttactccgatcagaggtgtaccactgtacccacaagacacaaccccacatcatgtcaccatgtgcctcaataccaccacggtatctcggaaaggagttgtgacaataccccttgcacaacacaatccattacagcgcacctttcctggatcataatcacccccttataaacaaggcatggactccctagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatatgctcacaacccaccattatcaggttttagttggcacattaattaattaaccaatcacgattgaccaacgtgaactatcattaagccatcattaaataatagtaaatcttaagttatcccaatagtgtgctaatgtttctaagcagggctaagcaattatatctaatatctagctgaaccaatatataaagctcaactagtcaagttataataacccaaggtatcaaggaataaagtaatcaagaacaaaagggctttagcaaacaataggttaattccacccaatgacattcgaaaataaatgcaatagttgaatagaaacgatagctttaaacgggatcaacatgctcaaagggttgtttgggatctgtgtgacttgccttgctggccttggaactcttcaaactcttctcctgcgaaaacggactctccggaaacgacggaatctaagcagaaaagagcaaaatcaccaaaacagcacaaaaacaagcatgaacagtacatgtggatatttttaacatgtagatctcaaatttagaaaaatttaaagacttgaaccaactaaatccgagctaagatgaattagttatgaatttttaaagatttaatcggattaaaacacttatatagattttaatggaattatgacgcaataatgaattatttttgaaaaggaaaaagggatttattgcgtcagcggctagggtttcgcggtggaccgggcgcacggcgacggttcacgggaacggacggccgagatcgatccatccaaaacggacgaccgagatcgatcggtccacgaccggctcacgggagagggcgacga

SEQ ID NO: 49336 - DNA, 1501 bp, Oryza sativa
taataaaaaaataatttatgaatgagttggacttaaacctttttattttgaagttgcttaaaaataatggtcagtttaagcacgctcggttaaaactaacaactattcgtgacaaaagcaacagaattgaatatatatatatatatatatattactcatgcatgaagaatatgtaattgtcatgacaaatctgctgctgatctctgaaagctgtaataattaatttcagtatatatatgcatgtacaaactacatgccttcttattcctgctttaatgaagaaaataatatcgatgagattaactaaaaccagatggtttttacgagttaaaatttcaacaaaacactttgaacgatatatagtctgttatgcatgataagcgtccaaccaaaatcccttatatttagggacggagggagtatgtatagtagatgagctataaggttatctttatttttcttctcttctttatattcctcatctatgtatttaatgtatttatcttgaagtgtgtgaatagctaacttttgcataaaaatcgaccgcttcattttttagattctctcttctttacataagtggtttataacctactaatagtattaatcttgttctaacatgtaaaatgtaacctctacacaatcttaaaaaaaatggaaagagaaagtaaaatatatagtgtgagagtgagttagttaaagaagattttggagtttgtgtgctaattaagcggtaacatattatacaagttgccttttattgatttagagcaggtttaataatgtcgtaaacttgctaaccgtaaaacatccacatcatctatagcacattagtatagattgctcatataacaatggtctttattactatcatttacggtaacaactgatatattttttaattgatacatgtcccactaattactgcattcttcactattgttccaagcatgaaccaatctccaccaggtttacttctctttcttcattgtacagtgtgctgcagctgggtgataattgtatcgtcggctcgcgttctctctctaccattttctcctccagcacagcagtggggctgacttggttacgctatcactgatccaggttgacctattagacatgctcttatagatagcatagttaaaagaaaaaagtacgaattacaccccccgacccgaactatcgcgcttgaccgaattaccttcttgaacccgaaaaccatgcattgctcaccctgaactttcaataccggatgaattaccaatctagagcggttttatcctacgtggcatacgcgtggcagtccagtcagcattttttttaaaaaatggtggggtccacctgtcatgcctccacttcacctcttcctaatatctctctctctcttgcgcgcgggcgcaagtgcgcacggcggcgtggagccgcgaacgatggcggcgtacatgggcgggtggtgggcggcagccgcgaggcaaggaggtagcattgcccgcagtaggga

SEQ ID NO: 49337 - DNA, 1501 bp, Oryza sativa
ctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtattaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaaacacaagggggcaacggagaaattgggataataccatatccaatggtagacaccaaatgaactgttggtagtggatgcatgagtgttgctgcactctgaagcacggtagacaaatcatgatgactaaaagcaactgcgcacattgaaagttttattagcatgcaatttgtttattacccagttagaagagatgcaaatagaaagattgcgttgttatctttttaaaatgaagcgtagagaaaaaaatcacagtaactaaagaatgctgggcattcataacccattctgtgcagttacaaaacagaaggtaggttattggtcatagtctctgccatcttcgtaggaagaaataccagtacgaacaaaaggtacattattgtgaagaacaaaaacaacagaggccacagaggtggtgcatcttttgtagctatacaattacttgaaggatggtgcaacaagaaatcaagcttacagaaaagggtaggtcttacttaggcctaacagtctagcagccaggtatttacttgctgtcactgtacaatatatggacatagcaaatagagcataattaggcataattactgaaacaggggataaaaacatttaaacataaaagggggaaaggtctatacatccatggtggcaaaacctgggaggtaattagaaattctcacacggtacaggggaagtattaggtggatttgtagtgcaattgataaagtaggcaacccggctgttcagggggtgaaatggattttttttttctgtgacagtctaaaactgacgctctgtatagattgttcatggtgtaaagtaataactattctctactaacgagcatgtccaaattgatgatgggttagaaataagaaatattacactgcccagcacaaacaataagctatcattga

SEQ ID NO: 49338 - DNA, 1501 bp, Oryza sativa
gcaagttccggctgtggcagctcaccgactacgaccgcgtggtgttcgtcgacgccgacatcctcgtcctccgcgacctcgacgccctcttcggcttcccgcagctgacggcggtgggcaacgacggctcgctcttcaactccggggtgatggtgatcgagccgtcgcagtgcacgttccagtcgctgatccggcagcggcggaccatccggtcctacaacggcggcgatcaggggttcctgaacgaggtgttcgtctggtggcaccggctgccgcggcgggtgaactacctcaagaacttctgggcgaacactacggcggagcgggcgctcaaggagcggctgttccgggcggatcccgcggaggtgtggtcgatccactacctggggctgaagccgtggacgtgctaccgcgactacgactgcaactggaacatcggcgaccagcgggtgtacgccagcgacgccgcgcacgcgcggtggtggcaggtgtacgacgacatgggggaggccatgcgctcgccgtgccgcctgtcggagcggaggaagatcgagatcgcctgggaccgacacctcgccgaggaggccggcttctccgaccaccactggaagatcaacatcaccgacccccgcaagtgggagtagattgcctcgccggcgatcgccgccgtcccgtccccgtacgacgtggcagcttgctagcttagctgggctgggctgggatgggctggctggccgcatttagaattttgggcctccgttaattctctcttctttaacctctgttcatatatacacgcacagggactatagatttactaagccctcggtgaataattcaatcacaagtaaataattgagtaaaatgaagtcacctttttattgtcaaagttttactttggatcacacttaaaccaatcttttcattttagaccggataactttgcctatagtatttggcttggatcaccccactctctttactattcatgtatagatatgagcagcatataaaaggggaagttcaccattataccgaaaccgatttgattgaggttatttatgggtgtttgaagaagttaaggatgatccaaacttaaaaaaaattgataaaattttctgatcatccaaactaaaaaatatacaaaactatctgattctaaagtgaaaagattgatttgagggtggtccaaagtaaaacttaggcccaaatcacaatccactcgcaataatttgatccagtgatcacttgggcctcatttctctcatgggccgtgaaagaggtttcaaggcccatgacgcacacctaagattgaccagttcaactaacgtttgctaaatttaagcggaagccgttgaaaagccaaggaagcaaaaaccacccgtttgtggcgcgcggtgatccataaacagtagtggcctcccttcgtgagccccctttcctcgcgtcgtccccttcgcggagcctccccttcgtgggcgcgctccattgctctctcccc

SEQ ID NO: 49339 - DNA, 1501 bp, Oryza sativa
attgagaatgaaagatcaccaattttgcagaatgatatccaacatctgtaaaatgaccatatataattgtgttcatggtgtgtaaagtgcaaattttgagaagtactgaattactgatgatacatgttcttacttccctgtgcaaaccaacattcagcgctgtgtacaggtatgatggtacgcatatttgccactcctggccaccgtcctcgcaagagtttaccaaagaccccgactgaggggaaaccaaagaggcaaagaggaggaaaaccggagaaagaaaacgagagttgagtggaggttcgctatgaagagggggggccatcgccggtggcggcgagctcgtggtgctattcgtcacttgtagaagaggaggggaaggaactgctgcccgggaaggaagttagaggagaggaagacgaagaagaatggatgctgatatgtgggtctcgtatgaaacgagttacttcctccgtttcacaatgtaggtcattctagcatttttcacattcatatttatgtgaatgaatctagatagatatatatatctagactcattgacatcaatatgaatatggaaaatgctagaatgacttacattgtgaaacggagagagtacgttaggaaaccacatttaaaatcgctaagggagttaaattacaatggttttaacagttgagatgtcaaaatattacctggtattatgtggtattgttgttgaggaatatgaattagattgagcctatacataaagggagtcaaatcggacttattcctttgtagaaagcccttgattgggctgatcccctgggtcggcccagcatggcgccttgaactagcaccttctttgtctttacgggcataagcttctagcagctacagtttctcacataatctccaactctcttaagggtgtgttcgctgctgatggataggaacatatcacctaagcacgaaaaatgaagcagtccattagcgcgtgattaattagatactccctccgtataggaaaaaaacgtcgttctagccataacctcgtttgcgattttaacgacattctgaaccgcagcaggctatgtggacggaattacccttgtctgttcgatagccgctcccgcaattaatccgcagcacgcccgcgcttgcctcgtttaattccttaagcgtcgcatgcaggcatgcagcacgccgctcaacctcgccgctcacgctcgccgccgccgcttgcgtcgcgctcgccggccctgctcttgtcgctctcgccgctgccgccgccgcttgcgtcgcgctcgccggccgcgctctcgtcacgctcgccgccgctgctctcgtcgcactcgccaccgccgccgcttgcattgtgctcgccggccccgctctcgtcgcttgcgtcgcgctcaccggccgtgctctctcacgctcgacgccgccgccgccgctcgcattgtgctcaagatgcttgacgagaagcgcgaacgtgagctcactcccaggaaggatg

SEQ ID NO: 49340 - DNA, 1501 bp, Oryza sativa
tcagctctttccttttaccttttctctttgaagaaaaagaattcgtctccgaatctgatgttctcctattgaatgtgagcccttcgcggctgctgaattcacaagaaagcccctcgatgaaagcgacaaccttgcaattgatttgacctcatcgttcttgtccccgtcctggtgccagctgctgctccgctacttcccactgcgcgattcaagaacacggaggaaggttgaaactctgaaagcagcagcagatacaggaggagataagataagtaaattaattggaagaaagaaatcagtggggaggaggctatagaagggatctttcatgcgaggaaagcgcctttctttgcgtttttagtggggagagcgtgtgagcattggtgtggggggagaagaagaagatgggaagagcggatgcgccatggctgccgcttctgctcctgtgctcctcctgctgcttctgcatttggccccagaagcaaatcttggtcgctgcagacaccgaccctaatgatggtaagctagaatctggaatcttctcccctttttgcgcgattgttctttctttttttcttttctgtttttgtttcagagctgctggattaatcggtggagttcttcgctcgatgtctgtgtttgtgttttctgttgcggttcgtccggctggtttgctgattctggcgctgtttgtacggagttttctgtagattcggttttggaacggggaaatggatgtgaaagcttccgattaaccgaatctttcttcattttttacttgcgaaatctggtctttgcgcaagaatgctcttgatttacgtctgttcgacatagtgaacaagatggtgtgtgaatttcggcagcttataattctcatttttgggttgataaaaatggggtctttctgcccctggggtagttaagttgtgctaatccgagtaaggaaatacactggattcggttggaaatcttgcatgtccattctttttctgctgtttctactaaccaaatttggcctatgctatgtacctagctatctcagttatggttgcacttttgcttgctgaatctcaattgaggaggaatttcgtgcaaaacattgtctggattgcgaggggcaatttttgagaacaaattttagtttagcagttccaagaagaaaatgcagtcgttttccttacacctacctctagatttgaccctccttttctcttcttttttgccttattgttcgttggagcatggcaagaattggtcaaaaattgctatgagcatttcagctttcttttttttttctttcttttcttttttgcgattttcctcttaagatgtcatgctatttactcttgtaaatctgaatccatgcattggtgtctatgggcacttcaaatttcaagtttgctaatgtgtttgtttggtgacatactgacatgcattatacagtgttgcaattaggcccggcgaaaaacgtgtagtaattatttgctctttttcatgcagt

SEQ ID NO: 49341 - DNA, 1501 bp, Oryza sativa
accaactgttgtgagagggaagtagaatagaagaacataaatgtaggactcggtgatggtacttgtcgctggtgaccgtgcacgaccaattgggggagagaaggttgtagcggggaacatgatggaagctctggaggaggatagggcaaggaagaggcacactttgggatgatctgcattatacagcagcggtgttggttggctggttgcccgatgaggaggaggggagaggtgtaaggatcgaacatggacaagaacaagtctaccagaggaagctaggatggtgaacggtagcaaaaaccaaacaaccaaatcttttagcagaaataaaaagaacaccaaaacttaatggactaacctgttgatcacagtgtgatcgtccttctcctgctgatccgtctgcttacaaaataaggaaacataatttgactaaagttttgaaagtgcccacaaaaaaccctctctcatctattaaactcaagtcgttaccctagataaaccctagcttttctctattcctgtagttacttgctcttgggttgagcccttgtctatttataccgaacatctcttgccgtacggatccctgtttcgtcgcgcgcgccgatctcctgtcgactacgtacacgctccggccttttgtcagctgggcttgcagccatgggccgcctccagctgctgttgccttgcttccgataaaataagttcatttaaggtcccttctctgttgctgagtttgacattcttatggatcaagaaattgggtcttgaggagaaccgtttctacaagggacccacatcaacggccgataaaagctggcaagccgcaagtctagcctttcctcgtcgtcttcccgtctccttgcccgaaatcccaaaatcccccaaccgcccacctcgccatccacgactatcaccatggatgtgtctccggcgccgccatgggcggagctcccggacgccgtcctgctcggcatcgtccgccgcatcccatgcgcgttcgaccgcgcccacgtgggagaaatctgccgctcatggcgcaggacgctgctacagatcccgccaccgcggccgctcccggggatcctcctcctgacaccccacgggcctaccctgtccttcgtcgtcgccggcgacgcctggtgcacccaccccgccttcgtccccgaggccttccgccgcgcgcgctacttcggctcgtacgacgactcgtggctcttcctcgccgttggccaagacaacggccacgcgctcttcaacctcaccgactcccaggaggaggaactgcccaactggggcaccttccaactccacgaccgcgagcttggggccgagattctcctcgtcgccgccaccctctcgtcgagtccaaatgtacacggatccgtcgccggcggcatcctcacggctgaccttccgcccgccaactccatggagcacatcgcgttctggcgcacgggttctgatgtgatgtcaaaggccatcagggcaagcggggttg

SEQ ID NO: 49342 - DNA, 1501 bp, Oryza sativa
tcagtgtgtagttcagttcctgtactttacatcccttccaccattctggaaccttttctgatgataaccatgagcccgtacatctttgcattttcattgataactgatgtctttttttgaacggaactgataactgatctctgaacatctgcagttgtgcatgtttgtgctcgtttttggggtggatggagttttacttagcttttcttgaaattgcaatgaatctgacttagttttctgttgcactcattctgtatgctttagctttctaaaatttatttagtctcatgagagctctctgataagtaactttttttttatagactctgataagtaactgaagaaagtgagaacattgatgttctagctgaatttcagtctgatcaatggccattgtaaactactctgatcttaattactttctccccttattgtttcttggcttggtttggccgttgtaaatgactccgaccttaattactttctcccctttcttttggtttatccactgtgaattactctgatcttaatagtaattgtacaaagatacacaaagtgtattcccggaaaagtatcagactcatcaatggccgaatgatgacttattttataatcccttttccatacattgctagtagaattttaatgtcaagcttggtcatgtgttcagagctttgtgcacatctcacctgagtgtgtataggctcaaattattttatgtttggtgcctgcagattattctgattctttcagtgttgtggagttggtagcactaatagtccttttctagcagagaaaacttgaaactaaaagatgtctggttcagtaatcgttcttacaactttctggttctattgttcttgatgaaattgtatgcagaaataactgggctggcgttacatgatctttgtgttgaaatggataattcagtgtgagaatgtgatgttaattacgtaaaaaaaaaaggaatgtgatgttaatagtgtttagacattcctgatagttgagggtttcacttgtgaaccgggtttacatgcacggattgtgaagtgtgattacgttataagctttctaaatgataaggcattgctgcatggaatattgttctatttattatattattaaaacagttttgaaagtagacatcacatttattctggatgctaaaaattatcacattaatcgaagaaaaaattcaagtaaaaatacaatttaaaaataactgaaattcaaatggtctccctacaccgccacatgagctaagcggggacaacgatcgacggtagtggcgcgacgacggctccatggcctcgtccaatgggcaggatgaattggatcatcgtgacaccggcctcccttctcaacattgccatccttgttcgcacttcctccttccccaaaggcggctgacgtggagcataggagggtggtcgtgcaagggtggcgggggtcggagtggcctgactccatctccctcatctagtcaggtgtgtgtacaagc

SEQ ID NO: 49343 - DNA, 1014 bp, Oryza sativa
cagctaagctagggcattggaaaaacactgctccgtgcatcataaaatagttcaaactttatcccaaataaagcaacccagtattataaaatgtgacttttaccactaaatcaaccatattaattatcccaagaagaggcaaccatgcattattcttttacctctctccctaatagccacttattatattttgggacagagggagtataaaataaccttacattattattatttttgaacatttgtttactaactaattaatcccaaagtccatacaaacaatatatgtttctaataggctttaataatccttaatttgtgagaacagtggtggactagatgacgataagataggtggctcgtaataaagagtaagaaaaaaagtaactatttcatcatagcacttaaccacctaaacttttttttttctcattttacacctcgaaccccctagcagtattttttattctctctatctaagtcaattttgctctggaaatttggtagaacatagatgcgttcacaatttaggtttcaacatttttttttaaaaaagaattatcactgtttacttaggttgaaagcacataaaacagattcaaacatcaaaattaagttcaagcaaaaatcggttgaaaaaaatttgaaaatacttttgaacttcgttaatggtgccatctatggcttctaacaaatttcagcttaaaatactgcttgtaaattttagcttaaaatacaacttgtatgacgggtaagaaaatgtatatgttattaagcactaaagtgaaacatttttaacggtttaggggtaaactaccaatctaacttcactttttcaagtttgcatttgatcctatttttcaaaattgacgttgttgtttggccgtgtttccattacacattaaggttttgtcttaaaaaaaagcatgcatttattagccaaaagtaccaaaatgcccatgagtacacaacaatcctatctctaactttcttctcatcccctttcatatcagg

SEQ ID NO: 49344 - DNA, 373 bp, Oryza sativa
ttcctgtggcacagaacgagaagcccacaaatccaccatgtacgcaagccatggcctcaacccaactggagtagaacggaatatggcacacgcattttcgtattcattctgcgatcgattctagcacatgcaaaaaaaaatgagggtaaagagagctttattaatgcttaaataagggattacactcctgatttaataagtctagaattcttgcgggagcacacaacctccactccgcgtaggacctacaactcattgtcatttgtgctaaaacatgtgctaccctatttgcttctctctttatcttgtgtacttgcactttgcatcactcatttaatctcttcaatcatcgtcgcccaggccgatttcagct

SEQ ID NO: 49345 - DNA, 1501 bp, Oryza sativa
gatagtattgttctgcttatctaaacgacaagtttgcagcgcaaatgttacaatatggctaaattttatactcccattctctaacgattttccataggaggacgcaatttggagcaattcaagaagtcctgataggaaaaaggactcccattatcttaacgattttctataggagggcgcaatttggagcaattcaagaagtcctgataggaaaaggaagggaataaaaagagtccaggttcctcttgctcgtaccagggccatcgcaatcctttttatgcctagtcgaattttccgaaattgaggtcaaaattcaagtacaaaaacagatagtagtagataggagagaaatagtgatctgaaggaggggaaacggaagtgatttctcggtgagatctgacgaagaagagtcgtcgtcgacctactagttccacatgcctgcgaaacgcaaccagaagcggcgccgccgccaaatcagagcccagagtaagccaccttactcttactctgaactcaagagattgggccttcgtttcttccttttttctgcattcatgtatgagcaacctgcaaccatagccatccttatcctctttttttttgtgtcgcagatgaactgattaggtggtgtaaaagaaagggatcaccttgtcagcatggtgattctcgagctgtcaaaacaatgagacgttctaccccatacccatgccttcctgaggtactgctgtatgaaattctgatgatgcaggcttagattccaagcatgatattaccatgagtgatctgatagggctaattcttgggactatacttgaatacctgaatattacagtattgtttatataaacagaagtcagatatagtattttagtactgcaatgtggccacagtcctacactcgtactgaactagcagattctcttcgttctagttaccacttttctctctgcaaaggctggcagtattactaacaaatctcttcagaattttacctaagtgcgatgctttacatatttagtaccatgttcataaattggcataactggggtgctttagtgctatgctgcacttattagcattaagaaaaattggaaaaatattttttctttccacctgcttcacatttcgtacaagagtattggttttgctatgttgctaccttaatccagaacaaatggctagatttgctacagcaagtaaaagtattcttttaatccaagtcaaaagtatttttcatggtagttaattcgtgctagccattagcaactttatttcttctccttggaaaacccactaatgacactggtagcaaaaattctctatatgccatgtttacatttcactgcaccatctttctacgtaacgctgcatgccatgatgttctaccgtttttcgttctctaatggaagtaaccatttggatttacgactgcaatgttgatcttccatcccatgcttgtgtacgcaggacatctggcatcatatacattccctaatgccaa

SEQ ID NO: 49346 - DNA, 322 bp, Oryza sativa
  unsure (1)..(322): unsure at all n locations
gggagttgaactgaaccgcactganatcgtgtnnnnnnnnnnnnnnnnnnnnnnnnnnnnnnnnnnnnnnnnnncttgtaggacatgtatttctgaaaatggtaactatctatctttgaagagcccaacaaagcatttagagttttattggcaaacaataggttgagctcgcaggcttatgcaatggtggccaaacagttcaattcctaccatatatttccttctgaaacttttaccggaactgaactgttttagctgaaagcaacaacatgggacgtctgcaatgcagacaatcaactaatcaactaattaagcgaatttt

SEQ ID NO: 49347 - DNA, 470 bp, Oryza sativa
  unsure (1)..(470): unsure at all n locations
gcgtccatgannatgaaaacccatatccaacgcccaggagctgtgggattcaggttatcgattttgaacccggggatacccctcgcttagctgcgggattcactgatgagtatatgataaatattgtcgagaatgatgaaagctgtaatgttgtgaagaaaaatgcgagaaagatgatttgacacatacttgtggatctttataatataatattggagatgatatgtaatgcttgtatgggatttaaaataggctagaatagtaattgctagtgagtgaagatatggcatggttgcatgggattctaaatgggctagcatagtaaatggatgggattgtaaatggactcgaatataaattgctagtgggtgatgatgtgacatgcttgcatattgagttttagttttaatgggtactaactataaagaaagtccagaatttttttcaattgtatactaaacggatgtcga

SEQ ID NO: 49348 - DNA, 1197 bp, Oryza sativa
tattcagttaaggaaagagaaattagaagagaaaaataattttggaaatatgggattaccattgtacccttaagtaatatatgtgggggtgcatcagtacatgttcgatatcctccttcccccagatccattcccatcccgaagtccttggcgcggcggcgccagaagcaggcggtggagcagctcttcagcgcggccgggagcaggtggcggcgcagctcctcggcgtggccaggagcaagctgcggctccaactcctcggcgaggccggaaggcggcggtgatggctcctcaacacggcgtcgcgagcagcaggaggcggcaggagtacctggcagcgacggcgatcctcagcgctatggcaggagcagcaggcgatggcagcgactcctcggagcggcaaaccattggtgatgaatcctgctcttgacgggttcatcagatcgaaaggacttgaccaacatgaagatacctgatgtggctgatactatgcacttatgcagtaagacacaggatgttaatgaacttaccattcatagacatcattcatgttcatgcaatgtggcgccattagattttcatacggattttgaatcatttcacgaaagctcagtacaaaataagggtaaaaatacaagtgttgtttaaaaagtaggggcaaatatgcaatagctagcaagggcataaaagtcttttcgtgctcgacttaaccccgttaaattgaccatccaaaccaggggcaaatctctacttcgtttcaaaaaagtaggagtaaaaacgcaaaccctaaaaagcgagggcaaaatcacaattgaacttcaaaataggggtaagaatgcaatagccccttttttttactatagttgaatcaaattcaaagtaaactcaaacttgttcaacacgaagttcaaaattatttaaaattttacataccctgcacatctcgtaccccaaatttcacatcgatcaagcacgtcctcaagacggttgcaggtaagaccgtaagagtgcctagcagcggccatgctagatcatcaaatggccgttttgcatcaccaaacggctgtttgaaacgagaccaggagatcttcagatgcatagaaacaaatgcatatatttaggaatttaggaacagaggtagtagagacagacaaatgaacatcatgaatatgcatgaatgatgattgaataatgatg

SEQ ID NO: 49349 - DNA, 1501 bp, Oryza sativa
attttgtttataatttggttttagctataaaagattgccagatttatttattattttacagtgccgattagcgctacaacaccaggaaatttactacagtgtgctgcatatcagcatatatatgtgtacattaaggacttaggaaaagttttgggtttggctatcacatcggatatacggacacacatttaaagtattaaacgtagtctaataacaaaataaattacagattctgccaggaaactgtgagatgaatttactaagcctaattaatccgttattagcaaatgtttactgtagcaccatattgtcaaatcatgacgcaattaggcttaaaagattcgtctcgcaatttacatgcaatatgtgtaattggtttttttttcttacatttaatactccatacatgtgtcgtaacattcgatgtgacagcatgaaaatttttgttttggaaactaaacagggcctaaggttaccctttctctctccctttatggaaactaccaagaacgaagagctagctagatatctcactaatagctagctatatcatacctatagttcttgacccaattattgctcaaaagaaaatattatctctatgttttattgaccataatctccaccattgctaaaattttagtccaattattaaagttacaaaagaaggcactgatgcttctcaaatcaacgcggataacattgtctgagaagcgaagttggaacctatccaaggttttccatatgagtttaggcaccgatctataaccgctaaccgctagtctatgattttgtttttcattatctgaaaaaatgattttaaaatgattttgctgttgattgtcataacctagtggttttttttatagaagtaataaccgatcattttattttgaaaactagtaagtctcaaaccattttgtccaaaaaattttagtacaattaagaaaaccttgtttgaactattgagcggtttctaaatgcaatgccccttgtatgactggttattgtgataaatgactggttatgtcgatactgtaagagaaaatccaaaatatactattgacaaacaaccaattataaaaaatactatcgataagtgtgagttttataaaatgtcattgcctaagtgactttgtaatagaaatgtcatcgtcgttaaggttatgtcccgctccattaaatgtattgtttatcctatagcacttgacaggggttgctaacggaacattaacgacgatgatatttctgagataaagttacttgtataatggtatacattaaacacatatttaatgtaactcgtactttttgaaattaggcgcttgtaaatgccatttatcggattttctatattataaaccctgatcctaactctagtggattcctgattagtggactgtggcacacaccctttcaaaacttttggtttgaactctttcctcgcttggtcgtatcctgcagatttgagcccacgtcaaaagctagatcaccaacttga

SEQ ID NO: 49350 - DNA, 1397 bp, Oryza sativa
tataataaatttggataaaatgcatgattaagttattttgtgatagagaaaatacgtcggaatatatattaacactatacaaccattttgtcaattgaccacgtttgtaccggtgaaatgggatcaactttttgctggtgatgggcaacagtagccattcaagaaagctgcaactttactgctccacattcatgggcagggcgcattcatggtgcgtggtaaaatgcctcacaaatatgaatgcacgaacaaccgaaccacttaggtcgtgtgtagttgttttggtaaaaaaaaaaaattaacgtacagggacacacatttgaagttacatatttcgtctgtaaactgcgaaatgaatctattaaacctaattaatctatcattagcaaatatttactgtagcaccacattgttaaattattatgtaattaggctcaaaagatttgtctcgcaatttgcatataaactatacaatttattttcttttccaaatatatggtgtgatcgaaaagttggaagtttgaaaggaaactaaacacacagccttagtcgcatgtaatgtcacctagagagagagagacccccgggggggacgctgttatcagtgcagaaagtcagcaatgcaacctgcgcttttgttttgctagattttcacatactcctggccgatgatactactgctagatcgctcagccggtcactcgtccagctacccagtcactgtgccatgataactctgtccctggatgccctacatgtcctctcccaacagataagggtggaagcattaggccaagcacagccatcctggggcccagacttgatgccctccttttgaacacaagcacaaattgagaaatacaaatggtgatacacaaccatacacgcatcgcgccgacaacaatgctagattgctaggtactcctacacttcgaaacaattaaagtgccatgcatgctgatgcacgacaaatctttaagcatagttctaaacgcagtgcaaaaataggccgaggaacatggcgcattttggggctcctaggaattaaataattcagcaaaaataagtgaccacacagtattggtttgttgttgtttacgtgtagaaatgctaccaatttgttcgcgtcagaagtgcattccccacatctaaccaatttcaagcattaccatccaattcatagtatagtgctataatctagtctttttggtctttcaaaattcggtcctttaaattggaagaccgaacttgtcaatggaagtatttaaactggccatttggttaaccgatagttttggtctaaccaaacattcatcttccttgtaggattgtaggtgagcaagccgcacacttgcagatgacttagacgcaaatgtggtacttgcctttaacatagg

SEQ ID NO: 49351 - DNA, 610 bp, Oryza sativa
cttcagactgccctaccataatgaccatttgttcaagtccctcttctggatttagaaagatgttgagacgtatgaacttaccaagttaataggttataacataacttagcaggttgatggcagcgaaacagtgatcggtgataggttcatgtcagaagagtgcacatcttcatcatggtcaatgatcaaaattgtttaaactaacaatggtttcagaaatcagaagttgttgaattgttcagacatcagcaagtttcaaatttgttcattgtgattcaggcttcgtgtagggattattgtttcggaatatcagtttatgtttggaagatgcagtgatgcactcagccagacacaagcataacaaatgaagcatgcaatcagtagttatttagtagtgcataatccccatatacatccaacaaaatcttcagttaactcggaattacatatccctacttccagttgaagtactgcagaagattttatacggggtaccttttaggataactttgtggagttccaaaatgaagaaaagagtcaccacttgtgttttcccatcctctctctttttgccagggatttttttgaaattacaggggtgggggtattg

SEQ ID NO: 49352 - DNA, 416 bp, Oryza sativa
cctagtcatataaaaaatgaccaaaacgaaagttgtagatgttaatgcgttatacaactttgttgttgacaattttttcatttgaaatcatttactatccgaaaaattatttgaatttcttatattttaatatttaaattttatatagtttaatcaaactcggatggagaaatgaccaaaagaaaaatggtagatctcaataagttatacaactttaattttgacaactttttcatatacgttgatttagttccttaaaatgagttttaaacagacacatacaaaaaaaatcgatttttacattgaaaaaaaaatccacaattttttttcaccccaaccttatcttctcttcctctcctctctctcacacactttctactctctctctctctctctcacttcgtctcatccacagc

SEQ ID NO: 49353 - DNA, 1501 bp, Oryza sativa
  unsure (1)..(1501): unsure at all n locations
gaaacattagcacactattgggataacttatgactcactattatttaatgatggcttaatgatagctcacgatggccaatcgtgattggttaattaattacttgccaactaaaatttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagtatggttcattgcggagcaccagactgagaagtggcggagataagcccacgggggtcgctgtgggtacagtggtacacgtctggccagagtaaaactattcgaatagccgtgcccgcggttatgggcgggtctaacaatgtctttcgtgattagtttcacacttctcaccgtaataaaagatgctataactggtaataatttgtttagctcctggtttggaatggtatattcctggtttggagatagatctgtacagcccggtatggttgttcaggatggttgggcctgagcagcatgggtgtgctgtttagtgttgattaaaattgatgattaattactctactgttttataattctcaaatgtttgctaaatgctgcttttgcnaatgagtcctatattatgccattctttggtatccttgtgcacttgcatatttgctgcatggcttgctgagtatgtcatatactcaccttgcaatcattcatcaaaggaagagttctacggtgatgctgatggtgtggaggattaggtgtagccctggtcaagctgcctgtggagtggagtcgtctgcgccgtttatcttatttttccgctgcttagatctttattgattgagaggaactatctacctctgtaatgaaattttattcacttattaattagagtaataattgtactctattatcaatttgttattgtgtgcctcggctgattcttggacgagggttcacacacatataagagtttggaattttggatagaaattccgggcgtggcaagttggtatcagagccccttgaccctaggttatgccaaatggttacccatagaagccctctaaaactattggaaaagtagaactgttctcctccctttctttttttttaattaaaccaaactaatagcacatgcacttcataatctcttttagtggttctcattcaaaagttattccagtgttgttagtactgtacatctattacggtactaatggctcatttaccagcaaatgttttacaacattgttttatcttgctgcaatgaaataaatttagcatgttgattttataactttcttttattttcttttggaatctgttgttcaaaagtacaaaatttgtgaccttgtttcaacttatcttgcaagcttggtttactttatttacttaccttttacttaatccaaaaacttgtgctattaattggataaatgtcataactccctcctttcacttgtctttaga

SEQ ID NO: 49354 - DNA, 403 bp, Oryza sativa
tactcgagtcatctcatcacctgcgaacggaaaatccaatccggaaacgcacgtgagtgccaatgtgccatatctcgagaggagcactcgaccacctcaaaaaaaaaaaaaaaaactcgcatcgcgaatcggatccccaattctagccaaaccaagcacaatgcaaaggatctagtagatccgagaggcttcctgtggcacgctactgaacctagactaaagataagctcaaacagagtcgcaaaacgatacgcatgacgaattgaggacacgccggaatccattggagactagtagcagatccgtgtagggaggggaaaatgggagagggatcagactgaccgtccatctcgacaatggggttggcgaccttgatcttggtggatgccatggccgcgacagg

SEQ ID NO: 49355 - DNA, 302 bp, Oryza sativa
cgcccccccccccccgaatttttttatttttgttttatttgtttgatatttttttcacgcttagggacacacaagaaccaaccatagaaaaattgaactcaaatggacgtaatatgtgacatgtataatttttcctctcctctcctctctccgaactagtgcagaggagagagatgtgcaacttttttatttttattttatttttttgatatttttttcacacttaggaactcacaggaaccaaccacgtaaaaaataaactcaaacggacgaaatatgtggcatatggaattttccaaagc

SEQ ID NO: 49356 - DNA, 689 bp, Oryza sativa
actatcttttaggtttaataaaattttgagtaatcttagatctgttaattcttcttatgatgctaattatccacaatctgagatttctcgtcactttttaaatggtcttgatatgtctatttgggatatgaaagttatatctattcaggagtctgttgacatgtctactttgactttggattcactttatataaaattgaaaacacatgagatgaatgttctttctcgaaaagttgattctaagtcgagtgctttggtttcttcttcttcctctttggatgctgatgcttcttcatctaagtcttcttttcttgctgtttttaatgccacatccgatgatcaactcgaacaaatcgaggaggaggatttggctttggttgctaacagaattgctcgagctatgaataatgccaggaacaggaaaagaggtggtccaaatcgttgctttgaatgtggttcaattgatcatcttcgttcgtattgtcctaagcttgggagaggcaaaagagaagacaaagatggtgagaagaccaacaacaacaagccgaagggttcatcccaagggaggaagctggagaatctcaggaaggcttttcaacaagtttgcgccgccttcgagccactaagtgatagagatggtgaaagtggagatgatgataagggaaagaacatctccgatgtttgcttca

SEQ ID NO: 49357 - DNA, 988 bp, Oryza sativa
cttattaggcgaaacgatgggtcattaatatgcgcacttgcaagttgcaactgcatgtatcatctggagtttattttgccgggatgtgattgaagtttcagttttttagtttgaacctcattactactcagtgcttaatactcttttcattctaggctattacaatctaatataggatataatacaattcataatactataagtattatagtgtgtgtttgattgctttattttaaaacggaggtagtactccctccgttttttaataaatgacgccgttgtcttttgaacatatatttgatcattcgtcttattaaaaaaatatgtaaatgtatagatataaatcatgcttaaagtagtttgagtgataaaataactcataacaaataaattataattacgtaaattttttgaataagacgaatggtcatatgtgtgataaaaagtcaacagcgtcatctattttaaaaacggaggtagtaccattttatcatggaccctaatctcttactactcgtttcactactagtatttgtcagtttcaggtgctttggtttgattgctacgtcgtcttaatctacacatgcgtacgacaaatgttgtgggccattttctattcatcgtgggctacacaaactaaccgttcatttaaccggagaaacgatgcctcccgggcctatcatttcggccaacgcccacccgtgcaaacccgcctattcaggacgatccagacacatcacatgtggccccatgcttccatcccccacgcttccgggcgcgcctcctttttgtcttaaccaagcttccccccgcgccattaattaacgggcaagtaatttaattattaccatctctcacagcctaaatcgggggccgcgtcctcttcgggatcccgaaatagtaatttactttcccccccccccccccttcccgatccatcgcacgctacagcaagaaaacccccccaccgggccttcgctgtcgtcga

SEQ ID NO: 49358 - DNA, 1501 bp, Oryza sativa
gccgccatggcaagcgggcgaggaggggcactagtggggatcgccgggaccgatgggttagtgctgtggactggagtggagtggagtgtgtgtcgggagcggagatggtggcaaagggagagcggcggttgacgccgccgcggcctgcgtctcctctcctgcggcggcggcggcggccggggaaggcggaggcggaggcgggtgcgcgcgggagaggagaaggcgtacgaaacggcggaggccgcggcggggtcagaaactcagcggcgcaagacaacagtatcgggaccggcccactctgactttggcacgtgacggcgtgacctatcatccatacccagttagagcaaatattagctccgttttttaatagccgttgactttttctcacatgtttaaccattcgtcttatttaaaaattttatgcaaatgtataagatataaatcacaattaaagtactatgagtgataaaacaactcataataaaataaattataattacgtaaagtttttaataagacgaatggccaaacatgtgagaaaaagttaacggcgtcatctattaaaaaacggagggattacaatagcaggctgtaaatatattttaagaagataaatgagaagagagaatagcagcgggttatagatttatagtcagctgtagcacagacttcaagacacaatgtgtgtatgacaggttggaccatatattaatagtgtagtatataactattgtataaatatgctgttagattggttatagataatttggaatgagtagttggctatactatgactcttatcgatgcactctccccgtcgggccgtcccgtgcacgttaatccaacggttatatggaacatttggatgctttcacggtttcacaaccaaataattgctcgtgtaatcgtgtgattttcgtccatcgatggcaacaatattgcgatcagatcgtattcaaccaaccaagtacgaccagcttagcgtcgcgtactcgcgtcagcgcaggtatctccggctcgatcaaccggcgccttctggctagaggtggtcaggtggatcacgacgtggacgtgcacaaactcgacaccgcctgccgccacccgcggttatccgcgtggatccagttcgctcgatccggtgtttgtgcagggccgagctaggccacgaaacgtgggccaggcccgtcgccgctcgatccgccttggcgcttgcccacgcgtccacggcgcgccaactcgggctcgtgctcatcgtgtgtaccagcttaactccgggcccacgcagagataaagtttacctgttttcgattggttggctgacgtgtccccactcggcacacgcctatttattcgctctcgcctcggcacgggccacacgccttcctcgccgccgaccgccacatatccacacacctcgacacgacggcgacggcgacggcgacgatgactgcgggccagcctctccgggacgatccccagccacgccggcacagcccgc

SEQ ID NO: 49359 - DNA, 1501 bp, Oryza sativa
ggccgggctgcgtgatgggcccaaacccaacaatagcccgttccattgtgggcttatctctcgacgaggcccatcgtttgatgggccgttgcaaagacgaagacgacgtgggctgaagctggccgtcgcggcccactcaccgggaggtcgccgtcgtcgagggtcggaatcgagtaatgggagggtggcacgtgtgtgaacggcgagctgtgggagccagtggctgcagttcaatggcgtccactgcacctttctcgtggatcgacgaggagcgcaacagagaggggagcagaaacgatgcccagcatatgcctagaatatgtgcctaaaatttggtgagaagctgaatccggtggcgaacctgccggggaatatctctttcaatcagtgtccaaactttcaggttcacgagtaccggatacgcgaagatatcatcgtatcttctcgctcggtgaaagcgcaggagatggcggttccgccgcccgtgtggcgctttccgaattgctagatgaattttctcgcgccacatctttgctaaacattcgaaatacgaatatcgagctgtggaacatctcaaaatttcggtaagaatatggaaatattggacctacatgttaggacggtaactgtgcggttgggcatccgcaggcagctaaactgatctagtctattaagctaaaaatatgagatgaacttatgggttggagtacggtatccagcttgcaaataataagcctgctcggtacgtttgagcttgtcatcttaacaagccatcttatctcggctcggctcggctctttatcctcaacgagctaaaaatctatctcggcttggctcataagctgacctattaagcttttttaacatattatttcaccttcataatttcaaatttactattttatcataaataaataataaatactactacctaataaataatttattaaatacagttattttgaatgtaattaagtgactaaacattagttgataagcactaaaaactatggtgatctattgtactaacaagttaaactagcggctcgcaagctagcttgtttgattcacaaactgaaagcctagcttgcttaacttttttaagactgcaagttcgagttgatccgagccacaagctttttttccacacaaaagacaaaagctgagtgaccgagaattgtattatgcgcatgtttttatttatagctcttcgtaggcttctactttattccactgttatcggaaccatctctttccttgcatataagtatatgagacgaagattctactaatagtatacaataatcacaaattaaccaaaccgactttgggtgagcacgttcttttgacgaaatgggtaaaacattttaggcgacagacaattaattatcaccaaaattcagactagtcaattcactgtcaggaatgttttactttttttctgaatgttttactttttttcttttaagataatagaaatggattacatctcatagagaga

SEQ ID NO: 49360 - DNA, 1501 bp, Oryza sativa
tagtagtaggtttcggttgtaactatacaatctgtaatcgcaccaattaattaattaatatgttcatctaccaaaaaaaagttcagttggcatcaaagaagctaatcaacgtacgtcaatggagcgcaaaagaaaaaaaagatcgatcgagctaaccaaaatcaatcaaaatcaatgctgatcgatctatcactctatagggattagggaggggacctggcgaggcgggtgtagaagagctgcttggagagctcctggcacgtctggatggtgggcgggtcgatgacgtagcgcttgttccgctccatgagctcctcgtggaacgcgcgcccgtgcttggccgcgctcctcgtcgcctcgcacgccctcgactgcagctgcctgctcccctccaccaccgccttgttgtacgcgcacccctgcctcgccgccaccctcgccgcctcccgcgccgccgaccccagcgtcgccagcttcgaccccagcgccgccatggccgccggattcatctcgctcgaacaatcctgctactaccaccatgcacgaagccggatcattattagatcgcaattataattagagattataaataacaaaaacaccggcggtacagagattcgaagctatcactggttattattaccttctttcgctttgatcaccgggaatccgggattggaggaaggaggcgacgtacgagatggcagaagaggacggtttaatttgcgtctttgcggcaatgtggcggctatggcagagggggtgtgtgttcttgtagcggcgctcttggcttggaggagaggttagggcccgctttgccaagggaactccattaagcctacgataacaaaacgggatgtatctctttttgagagttgtcaataataatctcttttacagtacccctgccatagcacgattcccacttccaagttctaacacgaagaacttcggtgaccacctgaagagtcccttggtgtcacgtgcattctctgccgatccctctccggtctccaccgatcgatgagcgaggctgcggcggtggaagctcgagcacaaggttactccataggatgcaaatgctttatgactggcctgacgatgcatgggtcttcaactcagggttgtcttcagcagaagtgataattctacgacacagaagttgagtaggatgcctgctgaaatgacacaaacgtcgttgttcgagtaagccatcaccttttccgtgttaaaacatccgcagatgaaatttccacactctctctaaaaggtgatgatcagtccactttgtcttcagaaaatctaaacataaacgcatgtgcaaggggcctaaacaatatctaaatcaggtgactttttggacagttgtattactgccatttctagttctgttgaattgaaatatgcaatgggactatgaacattatgacagcacagggaacacggcgcgccaggaagctccaataatggacacaataaaatgtttagtgaagggtaaaga

SEQ ID NO: 49361 - DNA, 1501 bp, Oryza sativa
ttgctgtcacagtagttctacagttttttaagatgtgaacagtattttatagattttgaacccttaaatttacatcaaaaggtactaggtgactgcttatgttgcagtcacactaggtactgcaccggatctaaatccgtctgcatgtgtccaaagggaaaaaggcaccaaattacttgcagttgcaggcttgctgtattttcttaatcactggttgattcagtgtaaggaataaacatggtgactgtttggagtactaacaccgtgtttagttctaaaccttttttcaaactccatcacatcaaaacttttctacacacataaacttctaattttttcatcacatcgttccaatttcaaccaaacttctaatcttaacataaactaaacacggccttaagttaataatcaccgaaaaggacatcattagaccagagtttttggacttggtgatttactctagtggctctcctttgattttttttagagaaggttattttctacccgacctccatatccaaccggatatatacagccattgagatagggaacttagccccgtaaacaacctaatctgaaattcactccatagaagattttaactcagaacctcgtactacttttgtactactcaggctctcctttgatggggcagtatattactctctccgtttcattttaagtgtaaccatgagtttacatgtccaactttgatcgtccgtcttatttgaaattttttataattagtatttgtgttgttatgagatgataaaacatgaatagtattacttgtgacttatgtttttatatttttttaaaaaaaatttaaataagacagatgattaaagttaggcgcgtaaaatcatggctgtaataagacggagggagtatcactgtatcgtatatttggacacaatcaagcaagtcagtactgagaaataaaaatgatctgtactgtaaatgccaagttaagtacatcagcacgatgtagcacgttgtacttttgtaccgcggatcaggtgcagattcagggaatgattgagtagtctgctctacagccattcactggtgggctgggccgtgggcttcccaacggtccaaggtcgtgcactgcaggaaatggggcccagcccgaagcataagtgcaaacaacagcccaggtaggtggcacacccgcgccactggactgacagcaagtgtgggtgaaacggaagaggaataagttcactttaggttcctctatctgtcggccagtccaattttcgtccctgaacctcagaaccgggtacgacccgtcccccaacttatgaaaaccgggcacataaggtcctaaggcggtttggatagcggttttggctgacgtagcgcctacgtggctggtttgactaggtctccatctcacgtggtactgacgtggtgcttacttggcaattcaatttggaaaaatataatacccatgagacccacatgtcaattacataaaaaaataattaataaaaat

SEQ ID NO: 49362 - DNA, 1501 bp, Oryza sativa
cggcaagtgcccgggctccgctggatgtagccgtatgtgcagtaatttttagtttatgttaattaacatgcttagatacaagctcagacgttcagccacatacaattgagtaaaatactactaatagcaaatatacatgcttaatcaactagttctaatggatgtgagatcagtggatcagcacatatactagcaaagtgactagctatatacatataactagcatggtggcccatacagattacgcgctagcatcattatattttctctcatataatagcatatatgttttctcattatattattcaaatatattaaaattttatatttaaacataattttaaattttgcaataactttacaaaactattaatgtgtaatattcatactgtattttatatacgtgttagttattaattatttttaatatcaaattttagttatttgtaaattatatatattcctatatggactctagactcgtcttttaatatttcttttttttaattccaaattttctgtaaattgtatttctatatagactctatactcttcttccaatattatttatttttatttataaatttttattatttctaattatatttctatatggactctaaactcatctttcaatattctttaatttttagtttcgaatttcagttacttctattcctatattgactttaaactcttcttcccatgtttttcttaattttgaattttagttatttgtaaattgtatttttatacggactctaaactctacttttaattttattatgtttattttaaattttagttagttttaaattcctatatggactctatacttacttctaatattccttatttttaattccgaatttctatttttttcttaattttatttctatatggattctatactctacttctaatattccttatttctatactctacttctaatattccttatttttaattctgaatttctatttttttttcttaattgtatttctatatggactctatactctacttctaatattccttatttttaatttcgaatttcagttatttcctaattgtatttctatatggactctagtctcctattctaatattccttatttttaattccgaatttcagttatttcctaattgtattcctatacggactctgtttttttcttcgattaacgtgggaatttctaggtcatgagagcgaacgtggagtctcttttttctattcctttaataatataatagattttctttaattaacgtgggaatttctaggccatgagagcgaacgtggagcattctttttctattcctttaataatataatagatgtctagtattcaacattaacaattaacgagtttcatttcatcaatataatttcacacattggttctcttctttataaattagaactcgatctatgctaaatcgtgcacgtggttatatgaatttaattttagttcttctcgattattaggtttgcccaag

SEQ ID NO: 49363 - DNA, 1300 bp, Oryza sativa
cattgccgtcaaggcgatgctacacaaatttgcgaggccatgcttatggcggccgcgcgcggaatcttgtccgctttgcattgcatcagatcagacctaacaagttgagcttagctcgctaagagtttaatagtatagtcaactattagcttcaaatcatttatagccaatgtaatagctaatttatataatatttacttactatactattaatatctgatcccacctgtcatacacatattacgtcttagagttcgtgctgcagctggctatagatctgtagtccgctgctcttctctctcttgttttatctttttaaaatatatttatagctggtttatagcttgctattgtaactgctctaagtgcttaaaaatcttaaaaaagctaagccatgcatgaattaatcatgatgcattgatgcatgcgttgttctccgaaagcgacaacacaacgctagcttagagagataccagtattagagcaagtttaatggtatagccagctattagctttaaatcatttatagtcaatttaataaccgattcatacaatagttacctataaacgtatactatacaaattataattggtactacaagtggctataaatctatagcccgctgctgttctctctcctattttatattcttgaaatatgtttatatctggcttatagtctgttattgtactgagagtagtactgagaaagtgagatgatattttctgctcctttttatgttcgaatttcttaaatatgctaagctcggaattagcaacaattatttttaatacatcactctacagtagtgtgatcatgatagtatccaaggggcacattgttagcattcagtattgttttagctagcgtgcaggtgacattaagtttcaaacgggaaagcatctctgctcccgcttaacctcatgtccagtactgtgtgatcatgatgctatcaaatggctcgagtacagatgaagtgattgtgaaggacgtgtaatgcctattactagtagcaacgaacattaatttgctgatcaggagctacgtacgggtttcaagttaatgcagtgacgtactgggagtgctaccacacctgtccagatcctgagagctggaacaaaacagttgctggttccgaactgatcatggagcgagcgagcatgcatgtgcgcgccctcgtttggaagtcgagatcagaaacgaccggacaaaagcgccatccaacgcatcaccatgaatgaacaagctttgccgtaaaagttgaaagctagcaacggcatggccctcccatggttgctg

SEQ ID NO: 49364 - DNA, 1501 bp, Oryza sativa
tcgtagtgcagctcgcttggaccgtatttaattatttacaccaccacttggctctctcgatcgcatctcgtcgtcaaggggctctggtgatgtgacgagacaccgggcggcacaccaggtgtcaggcgcgcggccatcggggcggctcctggtcgaggaaacggaggcgtcgagcactgtgattcattcgcgggcggtgtcgatcgatctcacctcgccatttttgtcaaaagagggggaaaatgtttgcagctgggtattgatctgcttaattaagatttaaggggagttcgttgagaggctccagttactagtagtttttggactcgtatctagtgtatttctgaactttccattttttttcttcttttcttttcgtttcttgcaaggatgcgtggcgcgtcgtcacaggggagcggaaagctcaatgattgagccgtttgtgtatttcgtgacgaagacttgacgtaagcacacgtaatcccctcaaaaaaaaagaaaaagaagaagaagaagaaaagaaaactaaaataactgcctagtgcaatacaaatggctcgggcgggcataggcccggtgaccacgcgcgggcgactcaggagaaacctagcgccaccgccggagcgcgtcaccggagcaccgtgcggccatccgggatggcgacggcaaggccaagcctcgatggcgccctgtcactgtgcgtggaaggcgggccggcgtgtgaagggtggccagtggcggatctaggaatttttctaagcttgggcaaacctaataatcgagaagaactaaaattaaattcatataaccacgtgcacgatttagcatagatcgagttctaatttataaagaagagaaccaatgtgtgaaattatattgatgaaatgaaactcgttaattgttaatgttgaatactagacatctattatattattaaaggaatagaaaaagaatgctccacgttcgctctcatggcctagaaattcccacgttaattaaagaaaatctattatattattaaaggaatagaaaaaagagactccacgttcgctctcatgacctagaaattcccacgttaatcgaagaaaaaaacagagtccgtataggaatacaattaggaaataactgaaattcggaattaaaaataaggaatattagaataggagactagagtccatatagaaatacaattaggaaataactgaaattcgaaattaaaaataaggaatattagaagtagagtatagagtccatatagaaatacaattaagaaaaaaaaatagaaattcagaattaaaaataaggaatattagaagtagagtatagaaataaggaatattagaagtagagtatagaatccatatagaaataaaattaagaaaaaaatagaaattcggaattaaaaataaggaatattagaagtaagtatagagtccatataggaatttaaaactaactaaaatttaaaataaacataataaaattaaaagtagagtttaga

SEQ ID NO: 49365 - DNA, 1501 bp, Oryza sativa
ctctctcccggcggcagcgccctcgacaccgtgttctcccacctcccgccgcccgtcaccatcccgccgctcggctccagcgtctactaccgccagagcgagctcctgcgccacttcgccgcgtcgcaggcggcgcaggcgcagagcgccaccgccgccgccagctcttcgtcggccgccgcggcgggtctcgacgatggcgcgccgcggaagctgtaccgcggcgtgcggcagcggcagtgggggaagtgggtggccgagatcaggctgccgcagaaccgggtgcgcgtgtggctcggcacctacgactcgccggagaccgccgcgcacgcctacgaccgcgccgcgttcaagctccgcggcgagtacgcgcgcctcaacttccccggcgtcatggacggccgcgactgccccgacaacctgcgccaactccgcgacgccgtcgacgccaagatccaggccatccgcgtccgcatggcgcgcaagcgcgcgcgcgcgcgccgccagcgcgaggagagcaagaagagccaacgcgccgaggacgcgaaggcggcgacgccgtctcgccccgtggcctccgagcgcgccgcgtccgagacgacgacgacgacaaccacgacgtcgtcgtcgtacgggtcaccggacggcgtgctctccatgagcgcggcgtccgtcgacggcgactgcccgctcgagcggatgccgtcgttcgatcccgagttgatctgggagatgcttaacttctagctgcgtagatggagtacgaaccatggacacgaaccaaccgacaccaaggtccatggatggccatgattggttgcagagtttgagctcttagaaattcttcgctgttaggtgatgatggattattggttatttgtgaaggttataacctagaaatattagaaggatatcagcaataaatcgtcccgagaaaattgggctttgttagaaatgactaattagtaacaacatgtatactcgaatactcgatctgtcgtgggtttttgcatcgacaaagttgtaaaaactaatcactgaatttctagctctacaaaaatgttgctcgtactctgtttcttgttctgatttgtttgcatagctagagagcatccatgagaattttagagaggattatttgcacagataatttctttatgttctttccctagtggttgatatttcatacacatcacacatatgtgcagttttgcacatttttagatgaatgaacagatgtggtgcagagcagaggattgattgcaagaggatagagaaactatgagacacgcaacagaagggaaggatttcagcatgccactatattttgtattcctatctaaccagtacaaatcttgtagagcttgttcacttgattttctgaaagaaacctttcagttgtggtccgtggagattagtactgactaaggcatctgcaccaatttttctctgttcgcatgtgcatcaaacagtggttagttgagctgggctccacctccac

SEQ ID NO: 49366 - DNA, 1501 bp, Oryza sativa
gggagtaagcagcaagcatgcatgataaaaacgatatgcatttgatcctgatcgaagcggcgcggaaacttgtacaaccgcacggaattgtgtcacatgccaccgttcatcttacgtgcattgtatatggatcgatcgagagaaccaccgaactactcgcagccgcgcgcgcccctgccgggccggcccgggcccgtacgtccccacgtcgccaccgtcgtcattttctttcgcctaacgcgtaaaagcttttacatgtcgatataattaagtcatcgtcatcttcccgatgatcgattaatttaattccttcctaccacgcgtccataagcctacatcccttttatgggttactttggatgattagccgtacgtgaaacgaactataaacgtaattaggctcagatctaaactcctacttcctacgtgtttttcattagcacgtttccaaactgttaaaccatgtttttttaaaaaaatattatgtaaaagctcctttaaaaattcaaatgaacctaattttcaagtttataataattaataattaattaattatgtgttaattgcttgctccagtttccgtgcctcttgaaagttcaattcctatgcaaacaaacgaatgcttaggcccaaactacaactttctcgttttctattagtatgttttccaaacagtaaaatggtacttttaaaaaaaattctatataaaagttatttaaaaatatttaaataaatctattttaatttttataataattaatatttaattaattatatgctaatgagccttctcgttttaagtgcgttgaaaatttttctctcaccaaggagatcgaacggtgccttaggatatgagtaattgaatatttataattaaaaaaaatatgaaaatagatttctttagtttttctaaaataaattatatatagaaaagttttcgtacaaaatataatataatgtttagcagtttaaaatatgctaacaaaaatcaagaaatgagccaatccaaaacgtaatttagaatggcccgtagcctctccttgttgatcgcctatataaaccgcgccatgcgccccgcttctgagcacacgctgcacgtaatcgcgaacgcgcgacatgtacgcacagccaccgccattcggtgctcgcgcgtaatacttaattaaccctcacactactgtagccactgctcgctctgcactctctctctgtctgcatgcaaagccataattaggagccaatgaaatagcagtcaccgagtcgatcagagcaaaacgctctcgactcgatcgcgcgcgcgcggttggcggttcccttcctccgctccgctcctctccatcatcgtcgtctctgtgtgtgtctgtgtgtgtgtgtgtgtgtggcagtagcagccagatctcggccccggccccggcggatcgagagaccgatcgcgtaccccacccatccacatggggacggaggccggcgacgtcgacggccgcaaccaccggcccggccg

SEQ ID NO: 49367 - DNA, 1501 bp, Oryza sativa
ctacctccagctgccaacagcttcatcttcaacaaaagaaacttctccattcttttaattaaaatccatagcacatccatataaaaaacttattcctttgcttctccaatcagggaacttcttgagcctctcacatccatcatactaagacttttttacttcattggtttgtacctgaaatttaacctatctacaaaacttctctactgaatacagtcatctcaatgactggtacaatactctgacagaacctgcataagagaattcactttcccaattctctggcaaggagtggtggaaattagtagccaatacatggtaagtagtccactgctttcccaattccattgatatagatgaggcaaattgaaggatttgtccagaaaagtaataagttccccatcgcctcgtcgctctcttgcctgacaaaatttattttcttccctgtatttggtctagaatttttctattctattatttttatttttatttttttaacaggagagatggaccatgggagaggcacaaacatagggtactgggtgtggtacaaggagaggaagcaaaatgcagagtccatatgcagaaaacattggttaggaaatagataacgtggtgctgatagcaatacaagactatcggtttagagtgaatacgcacaaagaatcctaataaccccttgcacagagattgctttccacgcttatgaatcgtcattcatcaatatgcctttgcaaccatgatcccacctttgcacacaaacaactctagctaataaaccaaccaaacaaccagcgccagcgaatcaatatcaaacaggaactcgaactatcccgtgtgctcgcacatgaaccaatactggtagacggagttttggggatggacatcatctatcagtttgcactaaaccttgtaaaaatcgagcatgacagtatgacacctaggaaaaaccgcaacaatacaattaatcagactcatggcaaacgcttatatataaacaacataaaaccacggtaaatcatacaataataatccacaacagatcagacaaatcagacacacacacacacacaccaccaccacaatcagatattcagatcaagcaaattagtcataatcacaatccacgcgcaatcacgggagaccagaaacatacaacatacctataatcagatcgagcaaagctatacctaagatcaagagaggctttaaacgaagcacaggtaaaaatttaaaagaaaaacacacgaagtgaaaaccgcgaggcgtatgacgaacttcctagcgcacacgcgaccgaatcgagtgggctgggcgtgacggcggcgcggcgcggccgcctcgaccggcgccggatttcctctggcgcgcgctgtggattagggaggtggagtggatcaggacggggatgaggaaggctgcgcgcgatgcgagagagagagagagagagagagcgctttgcagtggcgagtggcttcggaagaggaagcttaaggaggag

SEQ ID NO: 49368 - DNA, 1501 bp, Oryza sativa
tcatgtgggcctatcactcgccgccgtttcgccgtctcctgccgcgctcgaccgcccggcaacctcaggtgagtgcctgaccaatctgctgcttcctgcttgctgggagtagctgggggacacgcgatgtgttcgagaaagtgtccatgagcgaacgcatttgggattgcgcggtcgttgcgtgcaaacgaggccgtttgtgccaaacgttctctcactgttccacccgctcgtgcaaaatggatgtcgccgagcatcgatcgtggcatgttgtcgtgtctcaacccattagtcgagtaggaatatctgttaatactctgtccagtggtgaacgaatctaagctgacttagaggctgctctgcacggttaatctgcagtgctcgagctaatgaaatttcacattaatcttctgaaaaagcagtgtgtttcagtgtgctaagtcattttgcaaaacatggtaaagtcgctctattccatattggtctagaaatccctgggtttgcgcattctagttggtagagttcacatgaaggtttttgcgcttgactcatgactgacagcttctgtgtggtagtgcacagcagaagaagaagcgagggaaaaacattgctccaaaacagcgctcttcaaatgcaaaactcttgcttactactgaggaaaatggacagcttccaagtaccagtttgaggacttctatggaacgtcctcagaagagtacatccagtgaggacgataccaatggggctattagccagatagatgaaaaaattgcagccattggtaatgaacagcaagaggtactgccttactggggtggtcatatacttatatcagcctatcagggtatcctggtgcacttccacacctccttcaaacaagctagctaatttaaagagatatgcttctacattcatagatcaaggattattgaacttttgtttatgtgacttctgtgcagtatgtcagaaaaaaacattaaaaagaaaaggcacagtcatattgcagaaccatgataacataggattaaaacatttaaattgctattcatttcctttggactgattatgcattgtcgcttcctaggagggcaaccttgttataaatgtttttccctatttggaatagagttcatccttatgtagtattatgcagaaattcgtctgataaaggattgtaatgtttattttcactcctcagtttgccatgttcatccttatttagtaccaataccaatatgctaaattgcctctcaatatcttagcagttatcaccaggccatccacaataaccttagagctcgcatcgtctccaccagaactagaatgatactgctttgagcgagacactgctacctagttgtactatgcaagcgtgtagtctttcttatgtccttcagaaattgtttcatttttcataagaatttctcctcttatatattaacacagaggtcaaaggataaacatttcgaatcagactttcaacttgaagattttggggaaa

SEQ ID NO: 49369 - DNA, 1501 bp, Oryza sativa
ttggagctaatcaatgtgaagccttctagcctttgttatttttggcgtggttttgcaagtgtctgatctcataatttccaagtgatggataattttaaaattttcccgaatcttcatccatttatttatgtatttattttgttatggatctttttacgtgtcaacacatgagcttgggacttgggagcctggccaagtggtgctagatactaggaatagtgtacaatgtatacagaattataagaggtgagccacgcaagctgccactaactacgcgggttaaacggaatattccttgctagtaagatacaggagaacttgttctttttcttaacctgataatgtagaataaggtagcagcaactaggagccttcccaagtgactaggagtaggcttctctcacatgaccgatgtctcgatacacacatggcacatggaaatgaaacactgcttcttgaccaaaaatctgggattggacctctgtttatatttcagcctgctggattagaagggaaggaaaaaaaattggatggaaattgacagatagaccagccaaacgatccagaaaccaactccctcacgttgtaccagtggttcaaaatcaaaagaggcaggcagaaaggaccaacgaggcaacgatcgaatcgtgtccatggtctccacctcacgggagattctccgcatccaccgaatatccactaggcgacgcccccggcaaatgctcccaatttttttctcacatgcactttgtcacctgtcagaaacgtgacccctgttatcctgtaccataaactacagtatttgtacttagctcctggcatccaaaaattatcattttctctgcactatacccttatatacctcgtgcgtaagaatatctcaattccttttttttcccaataagtactccaattcagccgcgtataaactcagaaacacgtagagattgtttctcaccgcagcagattgtggcaacccaactgcggatcaaaaaccaattgttccacacatataccactcgcctgggaaaccggcagagccacccaaaagatagatgcgccgaaagcgaccgccaccaccggtccaccgcggcacacgcgacgcgagaagcagagaaggatattcccctcgcggctcccctccggatccttcccccacacaccgcaagtccgcaacgcgagccgcaagcgcgcaggcgcgcaaccgcgcaacggccgcacgaaaagcgaaaccgaaagacacaaccccgcatcccattcccgcgggcctctcggctgcttccggaaactcgtgttttctctcacaatccctactcccacccgcgcatcttcgtaatattcgctcggcatctcccccctcgccctcccgcgctcccggtatataagccgacccccccgcggcctcccattctcctcatcagatcaaagcaagcaaacaacaacaaaaaccacttctcgtgggtagaagagagagagagcgaggcgatttcgaccaagaaga

SEQ ID NO: 49370 - DNA, 1501 bp, Oryza sativa
ttgactagtctgaattttggtgataattaattgtctgtcgcctaaaatgttttacccatttcgtcaaaagaacgtgctcacccaaagtcggtttggttaatttgtgattattgtatactattagtagaatcttcgtctcatatacttatatgcaaggaaagagatggttccgataacagtggaataaagtagaagcctacgaagagctataaataaaaacatgcgcataatacaattctcggtcactcagcttttgtcttttgtgtggaaaaaaagcttgtggctcggatcaactcgaacttgcagtcttaaaaaagttaagcaagctaggctttcagtttgtgaatcaaacaagctagcttgcgagccgctagtttaacttgttagtacaatagatcaccatagtttttagtgcttatcaactaatgtttagtcacttaattacattcaaaataactgtatttaataaattatttattaggtagtagtatttattatttatttatgataaaatagtaaatttgaaattatgaaggtgaaataatatgttaaaaaagcttaataggtcagcttatgagccaagccgagatagatttttagctcgttgaggataaagagccgagccgagccgagataagatggcttgttaagatgacaagctcaaacgtaccgagcaggcttattatttgcaagctggataccgtactccaacccataagttcatctcatatttttagcttaatagactagatcagtttagctgcctgcggatgcccaaccgcacagttaccgtcctaacatgtaggtccaatatttccatattcttaccgaaattttgagatgttccacagctcgatattcgtatttcgaatgtttagcaaagatgtggcgcgagaaaattcatctagcaattcggaaagcgccacacgggcggcggaaccgccatctcctgcgctttcaccgagcgagaagatacgatgatatcttcgcgtatccggtactcgtgaacctgaaagtttggacactgattgaaagagatattccccggcaggttcgccaccggattcagcttctcaccaaattttaggcacatattctaggcatatgctgggcatcgtttctgctcccctctctgttgcgctcctcgtcgatccacgagaaaggtgcagtggacgccattgaactgcagccactggctcccacagctcgccgttcacacacgtgccaccctcccattactcgattccgaccctcgacgacggcgacctcccggtgagtgggccgcgacggccagcttcagcccacgtcgtcttcgtctttgcaacggcccatcaaacgatgggcctcgtcgagagataagcccacaatggaacgggctattgttgggtttgggcccatcacgcagcccggcctctctctcgcgtcgtgacgcacaccacccatcgcctctcctctcctacgcttcctctctctctccgacctcctcggatccgcctcgatc

SEQ ID NO: 49371 - DNA, 1501 bp, Oryza sativa
agagagacgaatccgattcgagatcgaatccgatgatttccaaacgaaattagccgatgtttccaaaagagaaaaggaagaggagatctcgaggatcatttcccctcaaacaattcagccggaggaggaaaggggcgggcgaatttggaaggagatcggcggcggcttgcgcggctaggagcggctggaggaagaagacgactgacatgtgggtcccacctgtcagcggcaccgagagagagagaggagggagggcgtggcagactgggccgaacgggccggcgcaagcaggccgaggagagggagagagagagacttgggctgacttttggcccaaagctaaaaggagaattttaaaacatttttcaatttaaattattcatgaaatgcaattccatttattaaaaatacttccttggctcaaataaatcccagaaaaatctaggaactatagaaacaagagaagtatttaacaaaattttatctagcccacttttatattgagatttaacaaattaaaattagatcttctcttttaggcttttaagattatttctaataattccttttaaacaacaatttataatttaaggatttttaaatgagaaaagcacttaacataattataactagatcattaatgattattgattaactaattattgaactgttctttgtatcatttaggaattgagctctgaaaaaaccgagaaaatttcagagagtataattaatcatggagaatttaataaaaattaaatcctgccatgctttaaatttaggaaattttatttcccacatttaacttcacttgtaaattaaagaacatttaatataaattctattaataatttattaaataatttataaatcctaaaacgaaaatcaggctgtgacacggtttgaccggccgacgctgtgtcggtttcagtttcgggttgtttgtttggatatccgtgattatttcatgattatggcttctagatgaatactatacgtatgtaatactgttgtttgctactaatgagtcaagttggagatagcttggtctcagaatatggtttctttgtttatttcatgtgtaggtgactcgatgtcttgggacagtatttgcggtgatggaccgggagtcggcttggggataagacgatgtccgtggtggtcagagatcatgcgggatactaattctagagttgatgtacttggttgatggagattccatatggcatacaatggaggtattgtgtgcgtgtgggatgcggagtcgaatttggaaagagtccaaatttggtatgattggttatgtaaagtttctttcttgtactagagggtttcctaaggtgtttaggactcctaatatgagtttggttcgtggctttaggctgcctacctcatgtataaatagagggggagcgtgaggcttcccggtatcgctttagagagcaattgagttgagttttgagttagggtttcaagtttagtcgaaatttttgtaaggagt

SEQ ID NO: 49372 - DNA, 1501 bp, Oryza sativa
tccaaaccaggaatataccattccaaaccaggagctaaattaattaccatcaattaccacattattattaatgagtagcgtgtgactaatcacgaaagacattgttcgacccgcccataaccgcgggcacggctattcgaatagttttactctggccagaggtgtaccactgtactcacaagacacaacccaccgtcatgtcaccgtgtctgcgcagacatgtcaccatgacgaatgattgtgacaagacccttcgcataactcaacccaaagcagtgcaccgttcctggatcgtagtcaccccctaaaaaaccagaggcatggactccccagctacccccgtgggcttatctccgccacttctcagtctggtgctccgcaatgagccttgttatacaaagtgtccagctgttgcccattctggcttgtggttggcacggttaatgtttcacaaccgaaactcgtgaaccggtccttaattgtcatgagcacgaccatcaaaaccatgtgctcacaacccaccattatcaagttttagttggcacattaattaattaaccaatcacgattagccatcgtgagctaccattatcatgtccatcattaagtaacagtgaaacattagttatcctaattgtgtgctaatgtttctaagcatggctaagcaattatgtctaacatctagctgaaccaatatataaagctcaactagtcaaattataataacccaaggtatcaaggaatagagtaatcaatgcaaacaggccataacaaaggaataagttcacaccacctagtgacattcgaaaataaatgcacaattgaaataaatagagaatttaaatgtaggatcaacatgctcaaaggaattgtgtttgcgatctgtgtgacttgccttgcaataacgggtcttcaattaatcttcttgaatacttccggcgcactcgcgaaccttcgaaacgacggaaacgacaagctaaaacgcaaaacaaggaaaaagactaagaaactccaaacaaacaatacataaaaagtaaacaaacacgtaaatcataattttagatgaattatgagacttgaacggccccattctgacttcatatgaattaattatgaattttacaagatttaatctaattaaagcccatttaaaaagaactaaataaatttaattcaatttatggataattttaatatgtagatctttattttatacaactttagaaacttgaaccaactaaatccgagctaagatgaattagttatgaatttttaaagattaaaccggattaaaacatttatatagattttaattgaattatgacacaataaagaattatttttgaaaaggaaaagggaattattgcatcagcgggctcggctcatggtggaccgggtgcatggcggcggtttacggaaacgaacgaccgggatctaatcgattcaaaacgaacggccgagatcatcttgatctatcgcgggtctacggggacatcgacga

SEQ ID NO: 49373 - DNA, 1501 bp, Oryza sativa
ccgcacctgcgctatcactaccgcctttggcccctgctacctctgtgcaggtgccgaacgcggctgacatggcgaaggcggctgtggcggcgagggcactccagaccagggcggagatcctttcgacaaaccaactgctggtgccctaagccgctccgtcacagccggcagtggccctaactgcgctcgccgctgtgcaagcctaagtcaaccctgacaccgagacacaaaccgaagccgacatggaagccatgcgacagaacatgacacgactctaagacatgcttcaccaaatgcaagaacagcagcaagcgtacgaggcggtccaaggtcgcttcggcaccaatcctccagtattcggcaggttatgtcccaccccaagtctatccacaagtgccgacccagccccttctgccataagttgtgcaagcgccaatgtacttcgccgggcagccatcgaccgcagcagtgcatccggcccctcacgtgcaactgcaagctcaaccggtcgctgcccaagtacatccttaaccgcctggccaagtgccacaaacaatggcagaaggggcttcagctctgcaggcgcagctccaagctttccttcagcagctcagccaaccccacaacatttcaagtacaaccccttcggcccgcccggaggggaatacaagtcaaggtgcgcctcgttggttgccttcgaatcagctaggtctggggacttcgccttggagtcaaggaccacagttcgactccatcaatgctgcttaggcgccaaccgttcggccgcaagcaccaacgccaggtttcggagcaaaccaagcaccaaaccaggtcgtcatgacatggtcacagccaactttcgacccattcatggcggtacagcaagcatcaccaatcgggccgggcagccgaatgccatggcccaacctcacgcgcaagccgtgatttcgcccttcgccacgccatacccgcagcaaggtgccatgaacagggcagggggcgaaaaggggctaccattgagtgggggaatcaagacccgtccaatcccaccccagttcaacttcccacccgtcccacgctactcaggcgaaactgacccaaaggaattcctctccatttatgaatccgcgatcgaagcggctcatggcgacgaaaataccaaggcaaaggtaatacatctcgccctagacggcatcgcccgctcttggtatttcaatttgccagccaatagcatttactcatgggagcaattacgcgatgtctttgtccttaactttcgaggcacctatgaggagccgaagacgtagcagcatctactcggcattcgccagaggccgggggagtcgataagggagtacatgtgtcgcttctcgcaagcccggtgccaagttcaagacataactgaggcatcagtcataaacgccgcttcggctggtttactcgagggcgaactcacaagaaaaatcgccaacaaggagccgcagacgcttgaacacctatt

SEQ ID NO: 49374 - DNA, 1501 bp, Oryza sativa
gcagtagtaggaggaggaaacctcgcgctgtgtcgtgcggctcgtttaaaaaagaaaaacgagatagtaataagtactttcttcgtttcaggtacgagatgtttttgactttggtcaaatttaaactactctaagtttaactaattttataaaaagatagtaatattttaaataaattttcataatatatttattttgggttaaaaatattactacttttttctataaaattagtcaaacttagaatagttggactttaactaaaggtaacctgaaacagaggaaatacatagcagtaagaatattacgtagagcatgaacaagcatgtatatatgctgcatgcatatggctactggccggcggcgaaggcttcaacagggaaggtcttggtgacgccggcgaggctcttgaagtggatcttgccggtggtggagggttcgtcgacggcgatctcgttgacggggggccagagcatgagctccttggccttgacgcccttgagcttcttgatgcacctgggcttgacgtagccggtgatgtcggcgtcgtagctgacgtgcttgcccaccatcctgaagtggtgctccaccttcctccgctgcgcgatccacatgtagcccgtggcccgcgcgaagccgacctccaccacgtcgcccagcggcagcagccccagcgggaggccgaactcctccagcagcgacgccgccatcttcatcccctcctcgtggcccttcgccaccacggctccctccctctccgccgccatggctagctgatggcctcgatcgatgtagctaactagctcgccgatcttggtggtgtgtgggctgtgaacaatgtgttggggtggtttaagtaggtgagggcaagcgctgtttttcttgttttttttttcatcggatttgccgttggttttgggagtttagcgcggtgtttgcatgcgcatcggcgtcgcagactcgcagatgttgtggttgacaataccgatggccggcagcgagccggctgggagcgtcggcgtcgagatttcggcggaatcacacgttcttttcactgctcactcctacctccgtattaaaatatattaggagtttaaattgttggaatagaaaacgatagaaaagaaaaaaaaacagaattctgagatgaatgtaaatgtaggtgaaattataaacgcgtgaaaaacacaaaaataaccatttgattgggccatagaaaatacgcataaatcaattgagagaaatatagacctttttttttcaaaatgactaaagctcttaatgagttttctttcttaatgggtttcccttgcaatctctatggaattgtatattgcgtagaaattttaaggatagaatatgattcaatcgtttgtttcgaagaaattcattaaagttttcctataggattaaaattaatttctatgtttttcatataaatcaaaagagcctagtctagtactcgactagacacaccgtggtgtctattattacgaatctg

SEQ ID NO: 49375 - DNA, 1501 bp, Oryza sativa
cggcgatggaatatcgatatatccggccacgcacgttgggacaagacaggagtctcagggcagggggccccgggccatgagacacgccggccaaccagggagggcgtcatgtggctgccaggcgcggcgccacctcgcgcccatgccacgctgcagttggctcacgcgtagctgtctgccgtgagtacgcgtgggcgattctctccggttccatatgtcacccgtcctacggtccatttcgtatcgccggtgagaagaataatccgtgcatcgcgactagacgttgttgtttctgaactggaagtagcctggttttgtttaattgggctcggtgtctggctttaggccactgaccaaagcaaacattttggagatcacaacctgtgacgtctgatacgaccacatgtcgggtgagtgtctatgaatgtctgcatcagctagcgtggtcggtacaaacaggatcatgttgttttggatagaacaacaaaaagaaatccatggattagtagagcaatgccacaattttgtttgtgatcatgcatgatttatcgatggtcatagagacataaaagtggtgatggaaatgataaaagtagtgccggcaagatctcttttgcacacgcaagcgcaggcggtgtataagaaaaggcttcgttgatcataatcccgtgtttaaaaattgttaggctgttccctttagttagtacgtaggtttcagttaacatctttgtgacaaatgtggaatatacaggtctgtttcctgagagaaactctgttgtgatttgttctgctagggggaagtcggttaagtaaaggatgtcatgtcgtacgtcagctcacctgatcttaatcctagtcgactagtcgtcgatgttgttgcgtcacatgagagagggctcaaattaggcgatcacccaggagtaccaaccataccaaatccatcatgccagcattaacatattaattaattaaggtgctggttggagccgacttaccgcaagctgtgtaacgcgttgatagagtagaaaaatgttactttcattgttttatctggtggagccagcgatatcgtcaaacctaaaagataaatagtaacgtttattaatgatcgatgttttatactgtaaatgttactaccaaagaaaaggacagtaaaaaattgatggcggagcccaaatgtcttgctggttacgcaccaccgtgtaacgaaattaggacatgtttgaacctccatattgaagagcatattagcagcacgcaaaacgaaatagcttactagcacataataattaattactaactaatataaagtaaaaatatatttatttaattatttaaaaaaattctatatataaataaaatatactcgctttaacttccatcctagtaaaaaataaaaatatttaagtttgtccaagtttataaaaaatataacaatatttttaacacaaaataagcatactactaaaatatattaatattaatcttaattaaattaatt

SEQ ID NO: 49376 - DNA, 785 bp, Oryza sativa
attcctgcagccctacaagaataaatattaataattagtagacgataaattcttgttaagtttaaatttactcttagaaaaataggtataattagcagggtatctatgctcatagaagcatataatactcaagtggtcctgaaataccgacagttgcatgatagcaaacagctgcagcttgacattcaaactgctcacggtgaatctaccctatgacaggttcaatatcgacatgtctatcaccagcctttagactacagaaccaggatattgtccacatgtataaacggaatagaaaaagatctgtggtgtgagatataaaccactaactttggactagaaagcaagtcatactgaaagtcttgtgcgcactcagatagagactctttattccaattacctgatagatctttcccgtggttatattgttgtcacgagtcaacttgatgtccagaaatcgctcataatttccaaggtccaagtccaccttagacaaaaagagagaacgaaatgaagttcagtttagtcaaagaaagaaaattttgtagttatcacaaaaacacacactctacaatggaacctcctttctacaaacaagtggacaacaggacaagtgcatggaatgctgctagtgaccaactgctagtccatgataattcaagccaagcatgaggagaatatgctcgagtcagtgcagtgcagtttctggcgtgcattttgtaacctatggtgcactctctgcgactatctcataatgaaatagctaagtgaaagccgaaaggaga

SEQ ID NO: 49377 - DNA, 1501 bp, Oryza sativa
ccacagttgtctgcacgtaaatggcatcgatgcaacgttgcagttgcaaagttttcaagttttggtttcactttcagatgctgccatgagcggattggctggccggcctttctctgtgttctcagcgaggaggttgaagactgatctgatctgtgtcctcgtgttttgtttgcacttagcacgatggcgttgtaggggtactcctacgtcgaagtgattgggcagcgctgatcgagaagtcttggtggtttgactagtagcgtcttgggctcgcacacaacgcgatgctgctctctggttgctggaggaggacatggctgtgtggtgtgtagtgcagccatggcaaaaaacaacaactttaatcaaagcaataacagaagtgcagtactttctctgtttcacaatataagtcattataacatttttcacatttatattgatatctatctagattcatcaacatcaatataaatatgaaaaatactaaaatgacttacattgtgaaacggagggagtagtaggagtataggtataaaaacagctttgcagattgccgaaacaaattgccaagctgctgcaggaatgattggaaccgcataaatataaatagttcagctcgatctgcaagtgtgcaagaaaactgcccttggtttacgggtgatgtctacaagtaactgaagaaacaagtggacgatatgtactcctaccattacatggcttaacttgtgagtgcttccaaaaatccaaagctagatagctacacgcttgcttttgcatatcaagaagctgtgctgatgcatgcttggtcgcttggagcaggggaaaacacgccacatcgtcatcgcatggaaaagttcagtaattcagtggctgaagaatcacaggtggctctctttgtcatgcggtttcaggtcgtttttctgaggatcattttggctacgaagaaccaggttcgtagcccatcagtagtactgaagtaccaataatctaccattacagtaactattaatacttcccgaaagacgaattaacataactttaggtataagcaacgggtcaaagacgaattaacatcacttatgaatttctgatgctctgaattaacatcattgcctcccggtgaaaccgcttattttcgtcttaaagtgaaaagcgaagagtaatatggtaggaggggttaagcactaatgcaactactgcacttgcatgccttggtctccaagaagaagcatctgaaactcgcatatgcagatatgctagctgctctgccttggtctccaagaagaagcatatgcaacttaatgccagcacactactgcatgatttattttcctgaacacctttccattttgttttcatgtggtccgtaagtggaaccgcacgaaaaaataggggaccggtaccgggatatcacctgcacgggaaaacacattatcccgtgcgggcggcttaagccaaccgcacgcgaaaatcagctcgcgcattttataaccgtgcacgc

SEQ ID NO: 49378 - DNA, 1501 bp, Oryza sativa
cgtcacttttgatggatttgacccttgtcagatattagtggttaacgatgactcctctcaccttttacgagtggagactcttacgtggtgaccataatatgtgacgggccacaaaatttcacctgttacacaggagattgttctctaacgggcaatatattatcacccctgtcactgagctacttaatgggggcaaaaagagattcaattcacatgttagcacagtgtcactgatatatattaaccgtgagaaatggttaattcttgttcatcgttgtcatattaacacaatgtcaagaaaaactacaaacctatagctgattgattgagatcctatcgatattggctggccttgctacatcgcatcagcctgttgaccaatcggctccttgatcttatatgatctatctatttatcttgttagttgcaggatcaaactaattagcacaccgtaaacccgattgataggaccagcattggaactaattaaatagtcctcctaggccttcgtgtgtgacgaatttcacgtaacaaccaacgcaagctcgagccaccattaggtcatgactagtcagatccggcgtctcccgacctcggggatactcgtgggcgacgacggcggtggcttggggattgaagttgcagcgacagacagtgctcagggatgcaggaggtgggtgcttggggacgaaggcaaagcccacgacggcgagtgctttggactcggcggctggtgcactcgatgagggtgaggaggtgtgagagagagagattgtggcctctggtctcaagttgttggtgggggatagaaaagaagagagagagagagatgagagattgtggcctctggtctcaagttgttgatgggggatagaaaagaatatggttcctctggttttgtgtgatgggacttatctttgatgggtgcatattctgtacccgtcacagatgaagagtcgcctctaacgggtctatgtttgaatctgttaaatgtgagttgtgccgagtatgtacaagaggcatgtcacagatgtctacgtgtgatgagccatgtctcatagccttatttacaacggaatttatttggatccgttagagataaaggtcgtttgggacgagacattttggacggtaagatatagatcatcagtgatgtgctattctgttgtagtgttattcagaactgtcagtttgattatattggactgatgtggaccaacgcttcaaagtgatttctattgctccagctagcataagagtagtactacactatccctctgtctcataatataagggattttaagtttttacttgcactgtttgatcactcgttttattaaaaaaaatcgtacaaatataaaaaacgaaaagttgtgcttaaagtactttggataataaagtaagtcaaaaaaaaataaataataattataattttttttaataagacgagtgatcaaacagtgcaaacaaaaactcaaaatctcttatattatagaacgga

SEQ ID NO: 49379 - DNA, 1501 bp, Oryza sativa
attttgtttataatttggttttagctataaaagattgccagatttatttattattttacagtgccgattagcgctacaacaccaggaaatttactacagtgtgctgcatatcagcatatatatgtgtacattaaggacttaggaaaagttttgggtttggctatcacatcggatatacggacacacatttaaagtattaaacgtagtctaataacaaaataaattacagattctgccaggaaactgtgagatgaatttactaagcctaattaatccgttattagcaaatgtttactgtagcaccatattgtcaaatcatgacgcaattaggcttaaaagattcgtctcgcaatttacatgcaatatgtgtaattggtttttttttcttacatttaatactccatacatgtgtcgtaacatttgatgtgacagcatgaaaatttttgttttggaaaacaaacagggccttagggtaccctttctctctccctttatggaaactaccaagaacgaagagctagctagatatttcactaatagctagctatatcatacctatagttcttgacccaattattgctcaaaagaaaatattatctctatgttttattgaccataatctccaccattgctaaaattttagtccaattattaaagttacaaaagaaggcactgatgcttctcaaatcaacgcggataacattgtctgagaagcgaagttggaacctatccaaggttttccatatgagtttaggcaccgatctataaccgctaaccgctagtctatgattttgtttttcattatctgaaaaaatgattttaaaatgattttgctgttgattgtcataacctagtggttttttttatagaagtaataaccgatcattttattttgaaaactagtaagtctcaaaccattttgtccaaaaaattttagtacaattaagaaaaccttgtttgaactattgagcggtttctaaatgcaatgccccttgtatgactggttattgtgataaatgactggttatgtcgatactgtaagagaaaatccaaaatatactattgacaaacaaccaattataaaaaatactatcgataagtgtgagttttataaaatgtcattgcctaagtgactttgtaatagaaatgtcatcgtcgttaaggttatgtcccgctccattaaatgtattgtttatcctatagcacttgacaggggttgctaacggaacattaacgacgatgatatttctgagataaagttacttgtataatggtatacattaaacacatatttaatgtaactcgtactttttgaaattaggcgcttgtaaatgccatttatcggattttctatattataaaccctgatcctaactctagtggattcctgattagtggactgtggcacacaccctttcaaaacttttggtttgaactctttcctcgcttggtcgtatcctgcagatttgagcccacgtcaaaagctagatcaccaacttga

SEQ ID NO: 49380 - DNA, 331 bp, Oryza sativa
tttaaattttaaaaataaattaatatgattttttaaagtaacttttctataaaatatttttgcaaaaaatacaccgtttactagtttgggaaacgtgcgcgcggaaaacgaaaccaacaaactcactcccttaccctctcaaacgctgcctaagtatgtagagtaccatcaagcgcgtgtaaaaacgtcgctttatatatacatcgcgttagttataccaactcgatcgtaaatagagtacgtgtttgtgcgctaataaaattccgtgtgggtcgcgtcatatgcatcacagtcgtcatgatatcacccgggtggccggctgccacgcagg

SEQ ID NO: 49381 - DNA, 1501 bp, Oryza sativa
ccatcggagtgcagtagtttggtggaaaccacctgaactctcccgggagtaaaaaggttctccttttgttaacaaggactttaatttgatgcagtcctgtcattttaaaaactcaacgcttctgaaaccagttcagactaatcaactacagtcccaacttgagggtagtgcgacgggtattgtggctgctggtactcccgcagcagtaacgcagaagatctgcgttcaggaaactcatgatttttttttcaggagttttatattagatcaattcctcttaaaaccttatgaaattctccccctcgaaactagcactaacgtatgaaacgtacaaatgcattgtcaatgtatattcttgttgggtgggtatccaacacataagaatttagcttgtagctactaatttaggcccccgtcgtatggctaaatacgaataagcatatgacgtattaacaaaacaataataacttatactaaaacttatatatatatatatatatatatatatatatatatattctcagcgatttaaacgtcaatgctgaaaaataaacttcaaaattaagttttgaaatttatattttggtattggctgatgcttaatagaggaaacgattagtgtattattaatttttagattagattttgtagacaatccaggccttgcttgaggaagtttcgaatcttcagttctcacaaagattatgagaatcatctctagttctcacccaaattataaaaatttataactataggacctgttcggttgtccagcgatcaccaataattacgcgcatacataaggtagcaacatgtttcaattgtagctattgtagccgatcgccgaataagggcatagaattcagaaaaaaaatatataacccaaaagctagaaaaccaaccattctaaattccaattcgttctttctcgggaccctagactcccataaatgatgattgacatgtggggccccaccactctcgggtccacctgtcagtgaccacgtcagaggatccctttcccctaaataggtcttatactgtttgagtagctgaagattttagcgatagctgttctgcaaaagaagggagaaaaaaacatacaaaatcaggtgtggtcctccctgatgctagattttcacagtgaataaattatgaatgacaagattaagagtaaattatgaatgagaagacagagagaaaggggtctctgatagtctgatttttttgtcctttctcatcaaatgagtccaaactccaaacaaaggccaaagccgcctatttaacccctctcctcctccctccaaacctcctcacacacatcccaaaaaccaaaaaccaaaaaccaaaaaccaaaacctctcctcttccctctccttctctaccctcttcttcgtcctcctccatccgagaggcagcaagccagcaactgcacgagcaaccacccgtagtcagtgacctaggcggcggagggagatcggccggcggcgagcgacgacga

SEQ ID NO: 49382 - DNA, 445 bp, Oryza sativa
ccgtgcattaaaacagagtaaattgccctttgccctttgaaccgggagacggcagtaatatagctggtttcattttactaggtttgcatcatattacattattattgaacacgaggattgtaaaatatgagtaaaacatactgagcttcttaaatttagaccatatttcacaacatgtttttctttgattttatgaaattttataggcttgatgatgcatcccgatgttaagtgaaatttattttaaaataacttggtgtaaagtgaaagtataagcaaccccctgcaatattacttttgacatgtcgatggtgccacttgctcaagggcctacatgtcagtgattcctaccgcaggagcggtgccacatagcaattgagtccatgtaaaaacaagtgaaacacgatgcaatttacatagtgcaaagtacaatttactcttaaga

SEQ ID NO: 49383 - DNA, 346 bp, Oryza sativa
ggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagcacttaacttgcttggcctcggtttgcg

SEQ ID NO: 49384 - DNA, 393 bp, Oryza sativa
cataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgctgatgaatcccctaatgattttggtaaaaatcattaagttaaggtggatacacatcttgtcatatgatcaaatggtttcgcgaaaaatcaataatcagacaacaaga

SEQ ID NO: 49385 - DNA, 182 bp, Oryza sativa
ctagattacaaacgatacgtcatcggcacatgtacgatcggctatcgtttatgaatttaactgtgtgtctttctttgtttattgttggttgcaggatcaaaccaactagcatgcctttgaactcgaaaccaagatttggacctgcactagagttaagcagatatctcaggccagtgtgtgtt

SEQ ID NO: 49386 - DNA, 371 bp, Oryza sativa
gagtctaccatgtattccgaaagaaaacaatatttaccaaaaaatatttatttttgttttacatgttttcttgttgcacaaaaaatacgggcgtaaaggttttgcgcgcgtataaaatttccacgatcccaggaaggcccttggagcacagaaaaaatacgggtgcggaagtttggcgagtgtataatgtttccaggtccaagcaagcacttagatcggctgaatttacgtggatgagctaattaggtccaggatattaaacgggttgattacgtcacccccataaaaatgccgattccgaatccgcagattaatggtctaattacgtcgaccgcattaatcttgctaactccgagtcggccggcttcagt

SEQ ID NO: 49387 - DNA, 614 bp, Oryza sativa
aaatttttcaaatctggacttgaaagtttcgaatctcgagttaaaagttttcgatctaagttgaaagttttcaaatttaagttgaaagttttcaaaatttgactttaaaatttaaatcgaaagttttttaatctaatttaaaatttaaatcgaaagttttcaaatttaacttaaaattttttcaatttgttagtaaaaaaatctccacaatctttcctaattactatcattactaaatactaataaaggtagttaagtatattaactaatagttttaatagaggtagttaatatgggaggagtgctcgatagcagcgagcagccgagcacgcgctagctaggagcccccggttttataggctagctttgcagacgggataagtccattttacacccccgaattcttatattcgtctaaaataaaccctcgaactacaaaaccggatataatacaccccctaactatcaataccggacattttatcccctcaagctgttttaccgtggttttgctacacgaggacgtatcgtaggatgacacctgtcaaataattccacgtcatcttcttcttcctcctctcttcctctcctccttctctcttaccccacacagt

SEQ ID NO: 49388 - DNA, 237 bp, Oryza sativa
aaatttttcaaatctggacttgaaagtttcgaatctcgagttaaaagttttcgatctaagttgaaagttttcaaatttaagttgaaagttttcaaaatttgactttaaaatttaaatcgaaagttttttaatctaatttaaaatttaaatcgaaagttttcaaatttaacttaaaattttttcaatttgttagtaaaaaaatctccacaatctttcctaattactatcattactaaa

SEQ ID NO: 49389 - DNA, 806 bp, Oryza sativa
gcctccctttatttattatccttatcggtaatctatcctttttatcgatctctctcaccgtctctctctctctctctcgcacgcgcgcggcggcagctcgaaagagggatcagcggcgcaagaggggaggcggcgggtgacgggcggcggcggcgcacctcgccgacgggtggctgcagcaccctcccctccgcgggatccggcgggaggggaggcggcgctctcccctccaccggatctggcgagaggggaggcggcgggcggcggcggcaccctcccctccgccggatctggcgggaggggaggcaacgagtggcgacagaagaggggctcgccagcgacgaagcggatggtggagcatgaagagggctctcctccctcgtctcttgtagatttattttagatgttttggtcgatttgtggattagagtatgttcattctgtgatgtcaattgattttggtagcgatttgtggatgatttggggatttggggattttaaattgatttcggagcaactcgggcgatgacgcagtaacagtgctcagttgagtttggctcaattcgagctgagccggtcccttttttttttttggcttgagcaaagctaaaggtgtcggttttattttcttcataggtgccggttgctactattggtgccgaccaataggtgtcggttgggaaaccggcacctatagccgattcccaaccggcacctatggccctttctgtagtagtgcctgcttcttcagccagtctctaaggtaagaaatcgaagtagcgcaccatcatcgatgtcggtaagga

SEQ ID NO: 49390 - DNA, 224 bp, Oryza sativa
gagcgagcgagcaatcagtattcggcttggtaggttggaggtgggggtggggaccagaggggattatataggagggcgcggccaatgagacgcgagtacgcggatcggtaacgtggcgttggagggcgtgggggctggggatccatcctggccgtcggatcgggagagaaccgtgcagcggttgggtttttggtttttttttttttttttttgccgcgcacagc

SEQ ID NO: 49391 - DNA, 611 bp, Oryza sativa
catataaagcagggatcatatgctgagtcagtaacccctgtttactggcagcagcagcagtgtatggtaagctggagtctaatactatcagcatgtgggtgttgtaagcagttgctgaacaaaatcagttaggtggaaattttgtacacttactgaatactcgtgtcagagttcagataactttcttgtagaattttgtatcttctactactgcccattcaacttaaacgttgaaataatctatgcttgccaggatacgtggtaatgtgctacggagctatgccgtttttatgctgatttctgtttcgctgctatattttgttaccaattcaggctacaattcttacaaccaagaagaatgcttgacaagttacagatggcaacaccccaattaaattgttagtttggaccagcgatgtgcatatgcaagcgaatgctgctgggctagcatcgccccgatgaaattgtttctttggtttgacagtttttccttctctaaacttgtgatgtgaaatgatgcttctgaatatgaatgaattatgcgatgattttgttcagaacttttggatttctcccttgttttctgataatcgcgcctgcttggagattta

SEQ ID NO: 49392 - DNA, 444 bp, Oryza sativa
cgataaagctaagtcatcatttattttattctttatatgatatttttccttttcctctgcctcactacaccaattggccttccattgagtagtgagtcgggggctacagatgttatatcatatttttcataacatttatcttgattgcttgcgacataatctgagtacaaaagtacctatcgagttatggagttctatcttcctatgctttccgtttggtttgccaatggatggttgcctttgggtcgattcctagcacccgggggttcgttggatggaccgagtaacgcaaggtgctaagtattattcggaataaatcaaaagcatagagatgagataaatttattttctgctcttaataattgcaaaagtacctaagtagtaaattctgatccgtgaaactttgttccgtgatactactcatcctatatgtttgttctgcag

SEQ ID NO: 49393 - DNA, 263 bp, Oryza sativa
gaagttcaagaatatcggcatatttgtaggaaaatgatgtcttcagtccaaactgagaaaatattatggaagtctttttttaattgctgccccaggcagcaaggcatatgaatatgccattaaccaactcaagaattgcactgtaaaatgtcaaaaactaaatggaaagtatttgtgttcttatcaaggtctttctgttgagttttaaggttcagagttatgatcccttgatggtccatttgtgttggtttggatcaacaaca

SEQ ID NO: 49394 - DNA, 204 bp, Oryza sativa
cccctgacttcgttttatccattaaaaatttgaatttcaaaacttcaaataatattgtgaagcagtaaataatttcagttgaaaaagtcatcaccaacaaaagttgtataacttatcaagatctataacttttattttggtcatttcttcatccgacaaagtgatagtaacattttcacaaaatttacatatctctcttatagt

SEQ ID NO: 49395 - DNA, 1501 bp, Oryza sativa
aaattgggtttgaccctaagtcaaccgggaccggttccacatgtcaaccacagtgggttttggataatgtttccgattaaaaataaatcatttatgaacagtgcattttcacaatattctcggattaattcgaaattgaatctttaaactagcataactcgctcattttaactccgatttgagtgaaactcgaacctaaattcatctaaattcataagctttccaatggtatataatttactattaaataaaatatatttataattattaaataattaatatcatatgattaggttatggtcaacttaaaaatatgctaataaatagaattagtattgtacagtagagtagatgtaataacatttgtctctaacatgtcttgccactgtaacaaccacacaaactaattttaagtgatgtctcaaatgaatggatgtataggaaaatactactacttatttaatattcgacggccatataattaaacctatggcttataggttatttaaatcaagtgtagccttgtgattatgtaactaaaatataaacacacatagatgaatctttaacctgtttaggagaataataacagagctagatgtggaggaatcactaagtaaattaatcgatgcaataccatatagaatagcatatatatgcctaaattgattaccacttattagaaacccaatagaaccagtgcttaaacttgtcgcatcacatatacaatatcactcatagaaactagctaatgtataattaaactataatatattcaggaatcacttggagcattgagtaatacactttctaaataagctcatgtacagtaggcgaccaaaaccttatacgttgttgcacacatatattgtatatcccattatagttatacaattaatttatctttttcatatattaaactggggagtatataacaaacatgaatagtagataaatagtagttataaatcttgacctcatataattataattatagttcaactgtaaattaggattattcattgtaaaattatgtgatgggataatctgtaatcataatatgattaacctaaacaactctaacatacaaagcatggataattattaaccttttataatttattgtgacaagtaaaatatgttcataattaaagtaaagcctccatcaattaaataataatacaaatgattcgttatttgattgatcctaaatccatctaacaacagaacctctggtatgtaaccgtgctatttagatagatgcatatatagccataatccttccatagccatttgatagactaaaccaccgattagccaaatatatatgtataccataaatgctatgttggttaactcctaaatagaccacgatgacaatagaaagattaagaaactttagcccttagcatgattggaatccattagcaaacacgaatagtacattttgttgtgcatatttgattgttgttgaatattggtttttctcgcgtattataga

SEQ ID NO: 49396 - DNA, 230 bp, Oryza sativa
tagttcttccattaatctatttctattgcttacagatcactcgcgctccctcggctgctgcggccgttttttaaatcgattggcgacggcacggcatggcggcgtgctaacagatccacccacgtatcagatcaaagcagagatgatcgcggcgtttcttcatccaagcgcagccgagtagccaatccgttgcactagtcagcgtgcttcgtcccttggtcgtttccagg

SEQ ID NO: 49397 - DNA, 1501 bp, Oryza sativa; identical to SEQ ID NO: 39284

SEQ ID NO: 49398 - DNA, 1501 bp, Oryza sativa; identical to SEQ ID NO: 39282

SEQ ID NO: 49399 - DNA, 1501 bp, Oryza sativa; identical to SEQ ID NO: 39280

SEQ ID NO: 49400 - DNA, 1501 bp, Oryza sativa
aaggtcctgaacatggtgaaattgatggtttactctctgttgtgctcaggaaaatggtatgtgaatatttttttgttgagttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttcttgttgcttataatcttgtgttaacttatcaatgaaacggagaattaattcggtcaaaggaaatgtagtactaatgaagtggatagttattttcagattggaattgttctgttttttttttttgcaaaataaaattttatatttgttctgtttggtccatgtgtacaatgcggtactctgaaccttgctaccatgctattataggctactattagttatgttgaagatgtgagtatttttcaggttgtagttgtgactatacagattcgtatctattctctcaacacagttcagtgcagccaacgttgttgagttttttgttttttcttctctcgttgtttggcactaataccttctttgttttctttcacatatcctgcacctaagtatccttggtagctttcatgcatgcgacgtcatattcatgtttcccatgtaactaattcaatctagtattatgcaaacatagccaccataacacgtgttatggatatgtttttttttgtgtgtcatcgtgtctaattttttctcaagtatatctgttttgatgtgtgatttgtgttagtttgcttggattagttttctcaagtgttttttttagttctacacgcagcagattttaatatgatatgagcttaaactttttttcggggctgtgcaggtttgtaaggttgcaaaataatagtcagtagtgatggtttctgcacttatagcttagtttaggtttccaaaattttacagacaatttctactaaaattacagtacacttacatgctatatgcattgaatttacaattgtaattttaatttcaaatcactgtaatttctacttctagtgtttgattttgcatatgtatggcagcatggatggtgctattaagattgggtgctatctcaagtatatctgttttgatgtgtgattttgtgttagtttgcttggattagtttcctactagtaaggtttcagatatattatgattttaaatgttaggctatacagccgggaccaaattttatatgtttctgttcatgagtgtatatggttgcctcttaggctttatatggttaccccctcactccctacctccctatgatttttttttgtttttattcatgctaatgtactgttctggtatatgtaattgtaattattatttctttctcttttagcttttaaatattctaatttagtaaataagtttttaacacacttctacacttgttttttagg

SEQ ID NO: 49401 - DNA, 1501 bp, Oryza sativa
actcgatccggagcgaggaggtgtcgtcgctgctgctactgcctaccatggagggctcgagtaagcttcccaccgattgttcatctctgctgcattaggctagtgttccggccggtcgccggcacctgtaacttgttcttgatatcacttttccatccgttgtctcatgccacaagaactcccataattttagagttgatttgggggttttctattttccagtatatttttaaattgctaaaataatgtatatatatttttaaaaaaattgcttatattttttttggcaaaattccgcttataacaagtataagcaataccatgaggctcaaaagttatttgaccgtaagatcttcttcactttggtggatagcaaagtgtgctcattctttctgtatgatttgagcaggctagtgtagtgctccagcaatattccttcttgttccaatgtggattatatttgattatatcagaacatttaagattaagaattcagtgatcaatcaacggtactagccaatctgctcatgagtcgccatgtttagagaaaccaataaccatactccgcaagaaaaagttccaggtgtaaaataaaagggaaaaatgttaagctcgtgtgctttagagcaagtattaagtaaagccaactatgcgcttatagctcatattagagttaacatacatggtagatgagctttaagcttatttttatttttcttcttctctctctatctctcatctatgcatttaatgtatttatcttgaattacgtgaatagttagctcttacatgggagctagctctctttattttttaaactattatacttgctcttagtttcttatttttcttctgttattatctgcagtattgatgaccatatatgacatgctgcagatgaaaaggtgcacactaagccaaggagatgataattttcaggttgataaaacattaagatattcagggccagacctcccagaggtatgtggctttatatatttcttatggaagacttatataacaagtaaattatcactatccctactctaactgggcatgtgaagttgtgaactatgcttgctaaatataaattgcgtgaacagatagtcaagtactttattgcttttttttttactgacattcatagtatgctctagtttcctcataactaatacacgatcacttatgtggcaaccataaacagaacctcttttgtttttatggggattaaaatgtaaagtttccaaaaaaaaagaaagaaaaataacatggaccaaccacttcctaggaagagttaacaaatcattgtctatcagtttggtgcagcttatttatccaagcaatgttactcagagcacctagggtagaatgttattatactccatatgttcatattgttacttagttggtgtaatggtttgtctttagagtccctaacattcaacaattatttccgtgcttgtgcaggacatttggcatcatatccattccctaatgccat

SEQ ID NO: 49402 - DNA, 1501 bp, Oryza sativa
ccccttctcctggaagagacatgaattctcatcaaatataacgatgcacttgaattgatcaatgatagaactaacagagaggaggttgactagaaaggaagggacatgcaaaacagatgacaagctaatagatggagtgcactctactgaccctataccatgaatgagttgagatgaaccatcagcaatttggatagtttcagagggagcaataggggagtatgaggagaaattattaggcaagcctgtgacatgttttgatgcacctgaatctattatccagtctacatgatgtctatatgtggatgcaagtgcatgtgcctgagtaccttcgcccgtgtgggcgtagttggcaaagttaccgaagtggctggttgttgctttagcagaattttgttgattggagtccacggggcccttattcttttgcattcctcccattgtgcagcttgttcacctgttagagtgatagatgagctctcccccatgacaacattggccctaggaccacctaggcctctacctcgacttccaccacggcctccacgttcacctcctcggccacctcggtctcctacatagccaccatagccaccacggctcccattgaagccaccatagccaccacgtgctcctccacgagctacaccccgaccattattgttcctaggagaaggacaattgtagctcacatgcccctttaacccacaattataacactccctgtcattaattgtgatgtatgcagacctcacaggattacttcctttcatcactttctgcctcatctcctcctgaaccatggctgaaatagcttcctccatattaggtaatgtagcttggtgaaacatagctgctcttctatcctcaaactccttgttcaacccctttaaaaaatgaatgactcttctcctttgcagccatttatttccaatcacaatatcatcatcatgctttaattgtaggggattataatgatcaagatctgcccataaatgttgcaactcgctggcatactcttgaactgttctcccttcttgcttcagattatctaccttgtcttgagcctcaaccatcatcataacatttccctctcctgaatacatgttgctcaatgtcttccatataattgttgcattctgaatagcttctatcatcctagcaatagatggggacaccgaagtcatcagccatgctaccactgtagaattagtggcattccacatcttccattccacactagatttatcaataggttcaacacaagtttcctccaaataatgttctacaccttttgctctcagcatcaaccttgcccttctagaccagctcaagtagtttttggtcccctccaacctcacttcatttggcattacttccaattttatctcagatggtcctatcccactcctaagacccatcatacctgtagctatgaggtcctacaacagacttttcatctcacctttagtgaaaaaagaagattctcctgccacacttt

SEQ ID NO: 49403 - DNA, 1501 bp, Oryza sativa
tggcatactcttgaactgttctcccttcttgcttcagattatctaccttgtcttgagcctcaaccatcatcataacatttccctctcctgaatacatgttgctcaatgtcttccatataattgttgcattctgaatagcttctatcatcctagcaatagatggggacaccgaagtcatcagccatgctaccactgtagaattagtggcattccacatcttccattccacactagatttatcaataggttcaacacaagtttcctccaaataatgttctacaccttttgctctcagcatcaaccttgcccttctagaccagctcaagtagtttttggtcccctccaacctcacttcatttggcattacttccaattttatctcagatggtcctatcccactcctaagacccatcatacctgtagctatgaggtcctacaacagacttttcatctcacctttagtgaaaaaagaagattctcctgccacactttccttcttcccagcctgcagtgcagcatcctcctcagcctttctttgttcttcagtaccctcggtgttcaccatcttctctgcactccaaaaaccactctcaatagatcactggtaccccacttcccttgcttccccttatcaacaatggtaggaaaaactctcctctaatcttggataaaagaaaaaaggaccaggcttcttcccctcacagaccacaagtcaaatgctcctccatccaggcagtagccaaaaaacaagcaaaaacaagagacgtaccacctccttcctagttcctgcagcaaacaatcctcctatgtcaccaagtctgcagccaagccaccatcctccttttcccttagctgagctcctcacatttcctgtgtgagcagcaggttacaacacacgcgctgcgcccgcgcggccgcgcgcagcgcgcgctcaccagcccctcaacgtggctgtgtgtagaggctggtcaggccggatgagagcaggggcgacgtgcgacgacggcagcggcgacggcggcggcgatggacggcggcggcggcgacagcaagctagggttagggctctgataccataaagttcagttttggggatttttttctggtgtgttgttcacagccacacacacactatttcacttagctacatatgcaagaaggtccccaatacaagagcatattacatcaacacaattattcaagtgccattatttttttattttatgcaggtacaacaacatgacatgaagcatgagtgtgtttctgaagatgcctcacatacgaggcaaatgcctgaacacaagcattccaaccttaagaatgtgatgatccttggcttctgcactgcaaagagcatggttgaactaacatgccatgtcctggagaatgcaacagcctggttgtttagttccagtccattagtgcagcaagcgggagcagcttgagttaccataatcgtgctggtggaactgaaaaactgaaagtgtttgatgtgtccatc

SEQ ID NO: 49404 - DNA, 1501 bp, Oryza sativa
gatctgcttcaacaatcctgcttgctgtgttgttatcacgagcaagtttgctcaagtggctcaactttgagacctgaacatattagatatcaaccattagttttgcaacaatacaatctattttctctgtacacaatgctatgacgtatttcactaaatatattgccaattgtcacaaattcatcatatgagaaataatgctacagagaaagtgaccttttaatgcactagacttagtacctaagctacttaaatcatatcatagaagtcgtacattgaccccaaatggaggaacctttattagtgagggatgtaaaatatagttgtcttacattagaaaaaatgcagacacatgataattgactttaagtatataaagggataaaccatggtaattcagatcaaataattcaagttggtcctgtcagcagcgtgataatccaaaataagttcaatgttcatattataaaactcattaaccgatccactgggaacaattatcaaaatccaaggaaactggaacacgtaccccctcaacgagatcggccacgccggctccgaacatgtgaaagatgtgatcataatcaatgaatgaatcgtcaatggtgtcgtgcagaagcccggcggagacgaccgtcgaattcccccaatattggccagaagcacggctgtctctacacaatgttgcaagtatggatcgccactcgcccgggtctaatcacaaatcacaaactgaacaagataagagactgatgcagaagcaattcaagtgttccaagaaccaatagctaaagattgtgtagctcgcggttttgacctggccacggtgagccttctcggcctcgaagaaggtcttcacgacgagctcctcgtggaagatgcggtggcgagcctgggcgccggcgaggagcttccgggcgcacggctcgcaggcggggctcgcctccgcgaggttctcgtcgagctcgaacgcgagctcgccgccgccgacctccgaccgcgggctgagtgccggggcgtagtcaacgcaggagcccagcgcgttgcgcacgaagccggcgaagaggcgctcgcggtcgcggtcgcggccggcgagccacgacgccggcgggctgcgggaggccgccggagaggacgacgggccctggaacaccgacacggggctgtggtgatggtggtggtggaggtcacgccacttgagcggcgaggacgagtagccgccgccgccgccggcgaaggcgggctcgtcggatctatcttgccacagcgcaccgagctcgtcgtgcggcggggcacgaggcggcgaggccgccgcggccggggaggagaagaggcaggacagcccgcccgcggcggcgggcgggcggtgagaggtggacggcggcgcggtggagcagggcggcgacgagccgcgggagctcggatcgaactccgacgagtagacggcgcccggtggtgggctggtgtacagggaaatcgccggcaacgacatggccgcctg

SEQ ID NO: 49405 - DNA, 1501 bp, Oryza sativa
aaagttctgccctatccaaaacttgatgctccattggccaaagataattgtggttgatgcgatgccagttgcccaactgataaaccaagggaacacaaatatcatctcaaagtcctatctggaatgtactaatccactaagcccgggaggagctagtggtggtcattttctaatccatccagtatttttctccagtggcacttatatgcatgaaccttttattcgacaagaacattggcaaatgctttttatttcgtatgataaaattctccactaagtaacatattgggaaaaagattatacctaacactgtaatctttgtatagccttgtttaatgattgccactggaaataaagagcagttcgcggctcaaactgaacccaatcatcagaggccactatatatatatattccaaattatgtaatgctgttttagtattatttagtttgagctttcaaacatgtgcagaaccaatcgaacagcaggtgcggcactgtttgtaaaacgggcaacgcgggtcgcttacatacatagaattaattataacaggtacagctactgatagtgattagtacgatatttaagcgccgctgaaacggtgaccttctcatggcctttcaatagaagcttcttgcatgatcgtttctgctttctacaattctacgactagtccactttctagagcatggacttcagactcccaagaaagggaaaatcactataaacatctttccatgtagtagcacatttttttttctcacttattttaaactataaagtgggatagaaacggtaacataaaatttttaaccaatcgagtactctctcccgtaataggttgattattttttaacggagggagtattgttttataaattaatacttcctccatttcatagtatatcgtttttacgttttctctaatcaaacttttttatgtttgacaaaatatatagaaaaattagtgaacatctatattactaaattatcatatattttttttctacaaacgactaagaaaaaatcaaaacaacttataatataaaattggggaagtattttttttacctttttgattttatctgtatgtaaaattttaatttcttaaattcctttcgacgtactacagtcgatgataaatagttaaattagcaggtatagaaattccggaccgactagagtagtttccgacaaatatttttccgacgggttttcatccttagatgtaataaatgagatttgaaattgggtgatgcttcgtgtgcattaaccagtttttttctccaataaaagttagatgaagattaagatcacgtttttcaaattgctaaacggtgtgtttcgtccgaactttctatatgaaagttgctctaaaatatcatattaatctattttttaagtttgtaataattaaaactcaatcaatcatacattaataccacctcgttttgcataaaaaacttaatcttcattttcatttttaggaaaaaagaacatgt

SEQ ID NO: 49406 - DNA, 1501 bp, Oryza sativa
gcgtggagcgggcctcgttgcctccggcggaacgatccgccggggcacgcgtcgcgcgcgctccgccccgccaggagcacgtggctgcagaggcgaaccgttctgcggttgagccgaggtggcggcttacggctgccgctggccgatggcctacccgtacatgcgcgcgccggtatttcggacgcatacgccgcgccgtcgctggcgggcgggattttacaggtgaaaacgtgtgggaaatgtgcgtacgacgactgggtgtgcgtatacgtacgtactagccgtttactttggcctggttactcacttgctccggtggaaggacggaaggtacgccacgctcggcgcgggggcgagagggacggatactcgatcgcggatagtgatacggtgggagctcgggccgtgcacgtactgcgtttctggtagatgcgtgcccccgtgcccggtttctggtttggtctcttgacccgtgaaatggattttaccgggggctttggttggtgccggtggcaagcgtacgactgttcgtctgttcctactccacgggcagagcatacgtgcacgataggatcaagtttaaaaaaaaaggtgagaggtgcaagaagaagaaacatgattaaatggttagtcttcaaaaatgaaataaaaaaggtcaactatgaaatagaaaaatgaattaaaaaatcttcagaaaatgaaataaaaaacagtatagtttttgggtttatgttgccgtactgccagaatgtcaactactccgtattttctatagcaaaaggtctcacaatgtttcccctgttgcacagggaaaataaaagtagtcaaatggttggtaggatacagaaaattaaacaatccacagtttgctgagtattttttccttgtataataaataaataaacaatagaaaaagaaaaaggaagcgtcaaagggagttgagggacgcaggcaggatactgtcgtgggccgcaaacttgctccaaaaactgtgttcgtttgcagccttgtagcatactcccccgttcaaaaaaaaaaattaacttgtgttgtttcagggcttgtttggtttggagccaattttttccctactaaaatttaggtagtactaaaacattggcaaattttggtactaccaaattaggtagtattcaatttaaactatggtgggtaaaatttggtagcaaaccaaacatccacttgctactattgaagttgccaaaattttggtagggtagtaaattggtatcaaaccaaataagccctcaattttatcccataaaaaattaatttatactattctacctatcctcaacatataaacaggaagttttatcccttaaatgtcctctatctatcaccattactactttttctaataataaaaaacattgatcatttttactcttcactaatttcactttgaaatgctaagaatggtcttattagggactctgcatatagggtatgtttggttcctagccacacttatagatggcca

SEQ ID NO: 49407 - DNA, 1501 bp, Oryza sativa
taaatttattttgggatggagctgcaatcttggacacttgcagatcgaagtgaagtgcccgagacggatctccatgactccatgcatactgctgtcgtatcggggactgccagccattcttcttcttccaaccgcatctgcatctcatctgctcagccaatcacgacgcgatgggttcccgtctcgctctggcatcggctactcactcagctcagcttcagaacgaaaatatcagagcagagagcactgcattggtgcatggtctgcgccgtgtttgtctgaagcttccgctggacgctggaggccaatcagcgagcgccggcggagcgtgcgtctcgatcgatcgatcggcgtcacccgtggcgtcatggcccatgggtacctttcctttcctccgctgcagatttggatgttcacctatacagatgcagaacgctagcagtagtattgcagtttaatacttctaattagtgtccaaacatctaatgtgatatagactaaaattttagtccctgatccaaacagcccttaattttttaagaggagatggaaacttgaaaagcaaacaagtttctggccgagttcgggagcctccctgcacggaaaatagcgttacctattaatacgtgattaattaaatattagtctaaaagttttaaaaataaattattatgattttctaaaacaacttttctatagaaaactttttttttgtaaaaaacaaattgtttaacagcgtgaaaagcatacacgtaagaaaagatgaagatgagttagaaaagaaagggaataacacaaccttgctccctccgtcctacaaaaatctgaatctggattggatatgatttgttgtactatgatatgtcgcatttaattttaagtttgttttttcgatggaggtagtatgcatgaacatgactttccaacaccaattttatttgccttttttatatatcagagaggattttcagttccaaagttgttggatcatttttttcgacagatgcgtacttccttcctctcattctctgtttcaaaaattgattttactggtgggtcactcttacttacttacagtggcgaacacgacaatactccctccatccaaaaaaacgaatgtgtcacatccagtactagaatgtgtcacattcagtactaggttggtttttttatgggacggatggagtatttattaggtgggtatagaggtatctggtacactagtgttaggagatttgagacagttggttactagaagtgcaggagtgaatttgttgaggaaaaagaagtattaggcacattcgaatataaatatatacagtataatatacttacatatattatgttttttcatgaaaattttggggaatatccacgggttcccccattgcttacttagcacgtgcctgttgcatacttgtgcactgtatatttttctatcgcagtcatgtgatatacccttccgtaaaaaaaaaatcaatcctaactacgaatctggaca

SEQ ID NO: 49408 - DNA, 1501 bp, Oryza sativa
caccatatgttaaaattaccttgggatgaaaaagaaaaaggaaaccagcattgaagtcttgtttgaaatgcatatgtacttgtaccattacagaaattcttaaaactgctgtcttgacagctacttatcaaacagccccacctgcatcataacgttcctagtggtgcctataactctgcctcagttattattttgtggcccactggtccaacaatttgaaaaaaattatattgaactaaatatattgaacagtagtatgacgtcctctttgcttgagttccatattacagctcacagtcctgagatttgtttcaccgattctttccatgcgatgtgcacatattcttattcaatttaaaaaatgaaagcagattatttttaacaagtaacctatcacgttagcttaacattgtatatttgtggtggaattatgtaatattccgatatcgcatttgaagttttgaacatgtgtgctcaaattgagggacacatgactgtagtgaaagcaaatataaatgtctgagcaatggactatactttgtattcattactacaagttatgtccttttgcaggttgctaatgtcctcttacattacttgtcaggataaatgagtttgttggtacaaaacatgacccactaataccaacgtatggcctctaaactttcagttcccccattttaagcatgttcgctgtttatttacgagttttgacattgttttttccttttccagaaagagaaggaggcacagatcttgccgtctttttcggtggatcgggtatgttttgatccaatatagtttgctcgcaggttctgaggggcaagaacattcaaatatctataatgttttctgttggattcaacattcatcactatttccctcgaaaaaaaagcattcgtcactattggaattgaaagtctgaaagtgcctctagtccctttgtatgttaaaagtcaataaacaagcagtagttttctatatgccacattaatattattgacgcattttaaaaagcaaactagtccagggatgtaatcatctttgttatctaaaactaaaaaaggaaaaactagtgcttttttacattaacattgatttttttgcggctgaaattacatgtagaaactttggcataataatctgtactactgccaaactgagcttttacatggtgaaaatattttccctgcagatcaaaattgtgtatctgcatttcatgtctttgctactgttgcaagtgctcacccaagtgcaaaagaccaaggtgcctcaattgttcttgcagctcatgctgcgacgagccatgctgtaagccaaactgcagtgcgtgctgcgctgggtcatgctgtagtccagactgctgctcatgctgtaaacctaactgcagttgctgcaagaccccttcttgctgcaaaccgaactgctcgtgctcctgtccaagctgcagctcatgctgcgatacatcgtgctgcaaaccgagctgcacctgcttcaacat

SEQ ID NO: 49409 - DNA, 1501 bp, Oryza sativa
tcaataggtgtgtccgtccctcctgtatccttcttgagaagtctgcccctgcagctgtttccttcttgagaggacaggacgagagattcagattctttcggtgaatattcacatgacaagtgcctcaagagatctttacttatatactgcctccgtttgaaaagataggaaatttctagctatatgtttagataagttacttacaaagacgctggaacaaatgaattgatcagcttaagttttgaataagttagttggcataactcaaataataaaatggattcatcagcacagagatatttatcgtgtagcaactggcagcacaccatcactcagcatctggagacgatggctgcaataacaaatagacagcgaaacggagagagactttcaaggcaaaatattgttgccttcggagtgtcaagtgtcaacatcaacctattattccccgaaaaaaaaatcagcctattatttatttgccagaaaagaaaattcaatgtgtgttttcttgagaaggaaaaacacctaaagtatcacatgcgggaccaaaaaaaaaaagataatgttgtgtgcttacgcacgagatgtgggcaggctaatgccttatgacattgatcacagctaccggatttgatttgatttgcaatagcaaaccttcttagaatatgtattcacgtgtgtcgacaaatgtaggagattccatctcggttggtactggtacatcaagaaaatgtcagatatcaatagagaacactattttactttctccagtaaacctgcatgacattagccctactagctaattcatcattcttctaattttgtaaaatattattgctacagctacgaatgatgaattataatatcatttatctgaaatgacatatttatggcatgatcgaattaaccctaaattttgtaggttaacccatgcagctttgggcttttgccccatactttgtcggctgggtcggttggtcggcctagcctacccacatcccaattcacggcccatgtaagactaactgcaggattgggcccacaaaagaacggaaatcctctctcagttccttgtgctgcggcccacctattataccgaacgaaggcgacagggccgtagccatcggccgagcagagcgggctagcgaggaagcctatgtgggccagtgaatttcggcccaactactgttgcgacctgtatggcccaggcccgtttgatgcatcgcaaccatcggttgcgaactcgcgatcctgtaagtcaaccccctgtgctggatcgtgtaccgtacttgcggtccatgtccttgcagataggttacgctgtcagtttagtcactgcaggccatgcttaccttgtggttcagatacgcccgtgtccgtgcgtgtgttaactgtcggtcactcgtttcttccgttcatccataagcatcatgtaagcaagcgtgtcacattctccaaattgagcttaatgatttcattaatcgcaagaaaaaactcgccc

SEQ ID NO: 49410 - DNA, 1501 bp, Oryza sativa
gaaagatcctggaagcaaccaaagcagaagcatcaggttctagtagcaagtagcaagcagacgacacagagtcacagattgactgatagtatactgcacgtggacgatatacttctgtacttgcaaatgcaactcttctgtacttgatagttttggctgaagcccatgggaaaggagccaaagatctgctggaatcaaattcctctgcgctgcaactagtattaagcagcaaactagagcttctttttttttacacccaaactagagctattagtagtacttgtcctagcttctagtaatctaattagcctcctaaattcacctagggattagccttggaccattttgcaactgaagggcgtggatgactgagattgcttgtgagattattgtgatgttaacactacatcgccacgtgtcatcgtcttgttggatggggccccacctctctcgttttaacttataagccacctcggttagtatccacaaagtcaagttggagagtatcatatgcggttgtgcacaccaagcagcaagcaccaaaagttggagtctcgtaggacgtatggatggttaaccataaagctacttgaataaccaaataaaggtgcctttactaaggagagatcaaatccacggctgatgtcgtcgtgaaaaccacctgtaacaaaataagaacaatcctttttaatatttaagttattatcggtgccattcatcatcaactgtcatcagtccattcacatagaagggctcgttttaaccataatatttctcctaccgactaccagccactcatcgaacaaatccacaacacatactacgcgcgaccgctgataagatatcacggcgcggcggtttttatggagcggctcaactaactatcaaatatttatatatttttatattaagtgaagtaccaatattttctctttcttcttcttgctctcaactattgttttgaagtatgtgtagacaagttacaataaatattgattccacatacaaataaagaaaaaactaggttcaacaagtaataacgtaatagtataatagtggatagattcattcaagttcggataagcccctcacagtcctaattccatagttttaaaaatttgggtcaatttgatcagaaatgtaaacaaacaaccctggtttgaggattgccaccccaccaacaaccctctatcgtactagtctaatagaccagtattgtcttgttccatgtcccccctacttcccctgtttgcggctatcacatcaacccgcggtttttgccgcgaaccgcaatccgcccgtgcggcagccatggcgtcgcccacacttataaaagggccctgcctctccagctttccctcctcaaggctcacctcctcctcttccctctccggcatctccatctctcagctcctctgctagctcgagctgctcttcccggatcctagccacatttcttggttctgatctctctcgggttgttttgaaattttctttggtt

SEQ ID NO: 49411 - DNA, 1501 bp, Oryza sativa
tcgtttgcttttggaactacatatccgtatttgagtcggtttttaagataattcacttttagtaatacagaaggaatcatataagaaatatgtttaaaaaaactcacatgctaacttgagacgatcatccgtgtttgtgttggttacaaaatatgaaaatgtttccacggttcgtcatccgtgtttgagtcggttttaattttatgttttggttttaatctatatcttttctctactattataaaaattaaagatatttttaccggtattttggtatgtcatctgtctatgagtcggtttttaagttcatttgattttggaaatatatatccgtatttgagttggttcttaagatcgttcacttttgataatacagaaggaatcatataagaaatctgtttaaaaaaactcgcatgctaacttgagacgatcgggctcctaactgcgctcccacaatgaatttatcttaactaaaccatttaacaataataaaattaaaatatacttcacccgttgcaacgtacggatattttttctagtattattaaaaatgaatatttaaagaagggttcaaaaaaatataatttaaaaataattaaaattttaattaaataataattaataactatcacgtatatataatataatatgaatattacacattgtgattagtttggtcaagttagtatataatttaaaattatgatgctatttaatatattttaataataaaatgtgaacacatatatgctgtcatgtgagaaaaaaaatataatgatgtaagctgcccaatctacactggtcaccatactagttagcgaaaaacaaaaatttaccttcatctgctcgattccattccgaaaacagcccagacaccgttgaggtgctcgtcctggatcagggctatgtttagttcagcgcaaagtttgtattttggttgaaattggagatgatgtgattgaaaagttgtgtgtgtatgacaagttgatatgatggaaaaggactaaagtttggatcaaactttcgatctaaacacaagtcctgaacggaggcggagaagcacgactccagtggatcgcccgcgaggggcacgccgccgcgatctcccgctcctctccggcgcgatcgccggttcgccgttgcagatcgaggaggagagagaaacccaccgcgtttcgagtttcgactggggtcggagactcggagaaaagcgtggggagggtcggagggacgcacgtgacgaacattgcaggatgtagaggcccagtagagaagagcagcccaactgcccaagcgatattttaggcccattactgacggcccatactggatccaattcccgtcggcctcgttgtcgtgggccggtgtcgccgctggacttccctccgggaaagggacaacggagtccggttggaatcggatacggtttcccagtcagatcagataaaaggcagcaacaggctaatcccagggatgattagtcgatcgacagatccatcca

SEQ ID NO: 49412 - DNA, 1501 bp, Oryza sativa
aataagaatatgtgcacatcgcatggaaagaatcggtgaaacaaatctcaggactgtgagctgtaatatggaactcaagcaaagaggacgtcatactactgttcaatatatttagttcaatataatttttttcaaattgttggaccagtgggccacaaaataataactgaggcagagttataggcaccactaggaacgttatgatgcaggtggggctgtttgataagtagctgtcaagacagcagttttaagaatttctgtaatggtacaagtacatatgcatttcaaacaagacttcaatgctggtttcctttttctttttcatcccaaggtaattttaacatatggtgatttgctaaggccctgtttagatccatttgaaatagcaaatggcaaatggcaaaagttttggtggcaaaagttttagtattgtaaaagtactagttggtgtttagatgcatcctaaacttttaccattctagcactaaagtgagagagagaaagaaagagagagtggttccaaagcactttttggcacaatttgctactatagactagcaaatgccaaatgccaaattgccaagttttgttactagtgtttagatccaaaatggcaaaaggttcttcaaaatggcaaactgccattttggaggatctaaacagggcctaagtgtgacatacaagtgcaacaagattttatacacataagtacataacacacttatacaagatttttccctgggggagaaaatgcaaccaaattttataaaacagagcataagacattagataaggacagcaataaaattaagctgacatttcatacttgacataagctcttcaaatttctaaaaacttaaaaacaaaatatctgtaatgcatgaagggcagtagtacatactctttaatgcatccagaacgagaaacgggctgagctccttcaaggaagtgaagctcatcctacaaaaggagctttgtgttagaccaatattgttctctcatgtgctagatgcaaacccatgaatttcctccttgagctagaaacaaacccacaaaagtttttctacctgttgaagtaaaatagactatgcacttaacatgagagaaatgacaaaagaaaattttgataattcagtactgcaggctgagtgaccatgcaccacaatggaaaataaaaactaaacttttgaatggagctggattctttcatgttaaaagacacagttgcagaaataaaaagtaaataaaggttgttacttgtaccaaatctgcggttaaaacttaaaacccattaatcaaagcctggagtaattgaccagtacgaacggtcccataaagattcctgctttactgtgtaagtgtaactttgatgttgcacaaaagcgagatcgggtaccaaagcagggactgaccttgcaagaaacgataaaaagatgtctaaagcgcatttgattactactacaaagaagttctctgatatctgaagagcttctgaaatctc

SEQ ID NO: 49413 - DNA, 1501 bp, Oryza sativa
cagtagtacatactctttaatgcatccagaacgagaaacgggctgagctccttcaaggaagtgaagctcatcctacaaaaggagctttgtgttagaccaatattgttctctcatgtgctagatgcaaacccatgaatttcctccttgagctagaaacaaacccacaaaagtttttctacctgttgaagtaaaatagactatgcacttaacatgagagaaatgacaaaagaaaattttgataattcagtactgcaggctgagtgaccatgcaccacaatggaaaataaaaactaaacttttgaatggagctggattctttcatgttaaaagacacagttgcagaaataaaaagtaaataaaggttgttacttgtaccaaatctgcggttaaaacttaaaacccattaatcaaagcctggagtaattgaccagtacgaacggtcccataaagattcctgctttactgtgtaagtgtaactttgatgttgcacaaaagcgagatcgggtaccaaagcagggactgaccttgcaagaaacgataaaaagatgtctaaagcgcatttgattactactacaaagaagttctctgatatctgaagagcttctgaaatctctgctccttaaaagcacagcacagtgtcaagaacaacacattcttccctccctcgttaaacacaaaatctagcaacatcaaaagcctcaaaccatggtggcagcccataacaccaacacggcaccacccatcgtgcaaagccctcatggccatgccgtctgcacgtccagtgtcgacgaagcaatggcggagatagacacgtccactgctatggctctccctgacaaggccactcaggtcagttgtccatgcccacgctcttcttttctccaacgaggagcccaaccaaacaacgacaaaggtagtacagccatggcgccacgcccaaagagggccaagcttgtctcgccagcctcggattgatggcgccgtgattcacctccgcctagaaacagtactacaagtactagaatagcactagctaccgcaattaacaacgccattactgtacacttcacagcatcctacttgcagtagcgggtagctccgtactcggccgcttgggttttgaaaaatgcgcggcgaatcggatctccttttttttaaaattaatcggtaaagtcaaaggaagacgaagcaagtagagctcgggccccgagaatttcgagcgagcgagtgtgaaagagaaacctatagagaaaaacgcagccgccgccgccgcggggcgctcaccttgaggaacgtgatctcgcggctcaggatctgcacctccagctgcatccgccgccggccgcacaggtccgggtacctcggcggcgacttgggcctcggcgcctccatcaccaccgcctcctcccccatctccacacgcagcacgccaacggccaactcagaaccacccctcgccgccttcactcatgggcattatagcagcagcagggggcgtggt

SEQ ID NO: 49414 - DNA, 1501 bp, Oryza sativa
ttagcgtggcggattcacgtggactcgtgggcctcgccggtcgacgacgcccagtcacccgctaatcaccagcgcaggttttgtactagtgtacagtctcttctcttttttttttcttttcgaacggctaatttgctgtcatgcgttaggtctcctctcacaatcaccatttgatagagacggactgatcgataaatgaattgcaggactagttcagcacgctcctcatcgctcaaacagtcaaactccccgcggatttgctcgatctgttgtttcctttccatcgatggaaagctcgccgccgtgcgtctagggatctcacaccccgagagatgatggtagtagcaacatacgaggttcagccggccgggcaggcgatgggaccgggaacacacgttgtcaccagtatatgtcgctgcttttgttacccactttagtaccaagcttttccctctgcctgcgcagcggcagcgcgccggaggccggaccggcctactccagctagcaacggtgggggggcactgggtttggggctagctgtgttgtgtgtgggcgcgcgcacggtgcgacgttcacggtcggcagcggtgccgcgcttgccgtgggccgccgccgcgtgctggctagctgggctcgcagcggagcctgcctgatctagtggcagacgatgacggcagatgaaacgaagcgagaacaagtccactttgattccttctaatatgagtccacggataggatagtcccttaaaagcaatctaaactatagatctagtagtatttaaggatctctcaactgcaataacacatcaactattaaaatcattataatttaatttcctcggttgttttaaatgtggttttcgcttatgtggctagataaattggtctagccagctgagccagcttatggagcccacatgttagcagatctatatcaataggctgggtataatagctcagcaaggtcatcgaacttgttagggatgaatcggctctgcgcccttgtcagctagagactcttatcttgattatgtttctcaatacgtaggatgaatttgaacttgttttttatagtattagatgtcaacatactttatattgctaatttcccataactatttatattgaatttagaaaaaaaaaagtacacgaaggatattcccttatcatattagaacccattccccatcttattggagtggtggagttttcacagggaccatactatattggtttccatgaagaggtcaattataaagtcactaacaatgttctcagctcaattaattaaaccttcacccacactctttgactcttctaggcttactctaagaaaaagagaaagagaaagaaaagaatcagaaaagctttgccacacctcacaccttgtgtccttgtgcctcctacaaatagctcttgccattcagtttcctctcagcagcccaacagtcgtcttaaaccatccagctagaagacaacatcctcttaattccggccttaa

SEQ ID NO: 49415 - DNA, 420 bp, Oryza sativa
tgcactacgcgtcgtcgtctggcggccgactagctaggttaattacagactacctgtggccgagatgctcccatcctatatttctagttgtcatgcttaacaatatttcactagcatactttcgggctagtatatatgaaaattaaactggaaatcaagatactaccactactggagaaaccatctttcgtgggttggtaaaaaaccacaatagtcccgattcaactaaaaaccgggactaaaaatcatttttagtcccgatttaaaagtgcaacgagtctatatgatatttagtcccggttggtgtatctgcctcccatgtcctaactcggccacgatcttatctctctcgagaccaagcgtcttcatcttctctctcgcctctctctctctctctctctgtcctctcctctctcgcaa

SEQ ID NO: 49416 - DNA, 1501 bp, Oryza sativa
tgttaggtacgccgtcggccttgcgtcgatgccgtcgcgggaaaccgccgtctcagaaaaagccctaaacccatgtcgccattgccgccggagttaatgccgaagcgaggcgccgccgccgttgacctcccatcgacgctgtcgtcgagctgtggcgggaggatgatgggtcgtcggctgcctgctaccagattaacctccgccgagacgatatggccagatgcaatttggttgctgttgttggggtctcagttgccgtcgttgagttcgcctcgctgccgtcatgaggatgcgcaggtcgacgtggagctccatcgtgtgccaccgagccgtcgccacaccaaattgcaacaagggagtgatgtcgtcgccaccgtcctgccaatcggggtagtggatgggtcgtcgatgacctcctcgccgtgtgccaccctaactcccttcaaagtcgacagttgacggcctccaacgccgccgccgtgcccgaggggccggtgtgccgagcggtggacgccgttgcggacaatgaatgggaaaggggaaaccctaattccccttcctctttctcggtcatttaggcgaaccggctggaccggtctgcctccgcccgaccgaataaagcccaacagtaacgagacagcccaaacaaattaataaaaataataaacctggaaatccgaaatcctcatgggtctagagtttcagaaattcgacctattaggcattttgggctacactgtgcttgatagcccaaataagatcgtactctgaacggtaattcggccggattaatttcggtttattgacaacttgtgtttaagcccccggagtgttgggtttttacgctatagttcaccgttcaatgcaattttacagtttgaaccttgtaattaacaagagattatattaattttgtttgtgtggctatgtcttgttgcttaggccctgtatagtttggttttgcatgtgggtctccggactcgtaaataactatgtaatggtgttttttaagcattgctttgcttttaaaattgatgcaattccaacaacataatctagagatggttttctaggttatgatgcttccataaattgtgttcacatagtgtagaatcccccctggaagcattatgatgggtttattttcctgcatttatgtgtgacggttttctgtgtggcataaatattgggaatataatgccaaataagaccaagtaaataacaaaaaatcacataacgcatggaaattctgggaaattaaatatccatggctatggataagaccactctttactgatacactcctccatacataaatggtaatatcgatgtgtctacaagatggagtcacgtatacttgttgtacgagatccatgcttttgccgaattcactgcacatatcgtccatttgcgtgttgcgttctctgagaaccgcatgaaacgattcggatgatagtgtgggtgatttcacgtaaaggccttcaatgactattgtatggct

SEQ ID NO: 49417 - DNA, 813 bp, Oryza sativa
atatatattttcacacacacacacacacacacacacacacacacggaaaccttcagtgaacaaggtaaaagtaaagccctggcatgcagccgtttcagactagtgaagatgtggtcatgcaaattcgttgtattatgtgtatgcattgtgtaatttgacccatatatcaagtcaattactcaagagtggtttcgcagtctttaagaaaatattaagagatgttagatgccattgagaaatgttggttgatttcaggcaaattaggaagtaagctgagaggaaattcatgaaatgcgagtagtctagctgcttgttttctccgggaaaagcacatcatatagttctggaggacttaaattttattcatcatgtgtttgcttgtattgaataatgtgggtcgtatgacgaaaaatatttttactatggttatttggtctatttattgtatagaggtttaaagccaaccttgaccaatacagtgaggatctggtattacgctaagtaaaaggccgagatttggcacacgggcattgcatgaaagaattaatgtgatgggtacgtaaatccatatatgtataagtgctaaaaatcacaaaaaaaaaaagaagtggagagaacatccaatcgaaatcatagatgataccgtgaaatttttttttttgtcacacacgcatgatgaagttgcatgattcagggcaatagtcccatccagcgaagctgcgaaggtggccccgtagacatgacgagcgagacaatcggtgcctaactgaatgaagacacgtggacaggggcagattcacaatgggggcacgt

SEQ ID NO: 49418 - DNA, 1501 bp, Oryza sativa
atgcaggttatcttcatatattccagttagttccattcttagtccttactgatactatatgttgtgaagctacaccgttggaatcagcagggatcttttgttctactttggatggtatagctcctatataatatagttagtatagattatatgtgttttctagttgatatttcagttgggtgttatcaggagggagatgcggtttattccataaacttagggcccctttgtgaagcaaaggtttaagaaaatagaggaatatgaaaaacatgattctgatatgaattctactacaaaacagatgattgtaaaatataggaaaaatatataaatgattgtttgattgaatcacggaaaaaatgtaggaattagatgagagggatagactcataggaaactttccatgaggttagacctcatgttaaaaatccttcaaaacttatatggattaagacatttcttattagaaagttttcaatccatggtttcaaagggctgtatagaaaaaaaaacctacaaaataaaaatgctacaaaattccaataatacttttccttcaaatcaaaggaggtcataagtttcttatttattgtatgcctatggcagagatcgtagagataaacaattttcattattggaaagaaaatgcttaattagttgagctgctaccttcgacttcgcgcggctttatccggtgcggattcgatcctcgttcacgcaaacaaatatcccgtcccggttcatccgcacacgctctatcagcgacttgcactacactactcatctgccgacacaagacaaaaaaacccatgtggggcccacatcaacccaagtagtgtagtggtcggtgggcctgcacaccgtccattgtccgctcgcggcgtacgtgtacgtggatcggtggtactacgtctccatcgatacattttttatttttgcccaatgcccatctctctctctcaggacgaattaatcaataataataatgcagatggccatttcctttcatgattatatatattgttctctccgttctaaaatataagcatttttagtatagtaccaaatcaatcatttttaacattaattattaatagaaaaaaataaaaaaagatcaaccatgtaaaattaatattattagattttatcattaattaaactattataatatgtaactctttttatttaaaacattttatttttatagatatggttagttaaagtagcatcttaaagactacgtgaaaatctaaaaatgattatattttggaacgaagagattattaattaatccaagttaacaccggattagttactactccagtaagctagctttacgcctacggttactttagctctttaacggtggcctccgcctataaaagcaggccagtaggacgccaataagcaagcaagcaaagccacatcttattgtcacttccatctcattctcctaattgtcatcactagcttctagctagcttaattaattaattagcca

SEQ ID NO: 49419 - DNA, 1501 bp, Oryza sativa
cacctcattatctcaataatgacccataaaaatccgaacaacattcgcgacttttacttagcgattcggttcagcctcaattgcatttccatttgacccgatttgagcatcgcatgctcatgccatggactttttccggatccgggttctctctaagagaatcattagcaagaggcgacatagtgtcaacacatttattcccactcacacatttaaccagatcttcatcatttcccaaaacgatcgatccatggttgttccgtattcctagcaccataatatgcgtgcattgctaggaatgtcgtctccatgacgaacatcattatgaggcatatcaccttccaaaggtgaattctccaccaggagaatcagaggagtatactcacatccagtgagaactcttatgctctgactaaggcctacggatcgtgttagcaggcgtccccgcacaacatgatcaaatgccataagtcttatgtggatacgatattattcccgggtctatccacatttaccacaattgggagcattactctttttaacaactatctagttgttcctcatatgattttgttggcaaaaactccgtgcaccaagcaataggagtatgaactaaacatacaagttcagctcatttagtgagttcactcaaagaaatctacaggcattccaaaatgggcaattctctccccctaatgccgagatatcttacaatagcatactaccaatccccatatcgtggcataggattaaggaatttcacctcgatcacaaatgttctcccacgaatgtatgctacggtggtgatatatttgggaaatatttacgcactttaataggagagatttttccattatatgcagtgagcctggacatatactaatacagtgccatgaatactgtattcttccttccttcgaagggttatcctcaacctcctagttaggatatacaggtctgcaaaaaccaccattgctaccaaatgtatatgcaaccaacatgcaaatactttagccaaatgcactctccatggattaatgctcacctagtgccattcaaactcataatcgattccggatcgacgtgcattagacattgcatgttatatgcttaagaaggcaacctatggtggcaaaacgcattccaatgcgctcaacaaggagtacgatagcaaagtgcgcggccactagcctgcgctgccaagcagatttttgtggtgcagagttgtgttaaagtccaactcgtctaatgcccaagtttgactccaattactcataccaaactctagaattgggtcatagttaagcagcatgttttaggtacgatccacgagtgaattatgaaaccacatttactaatgtcccctggacatagccatcaggagataatcaatacctccgacaatggtaatattcacaataaaaccattatattaagacatatccacaaaaatagtggaatgtgtcggtgcaactgtcgttggcataacgagctcaacgca

SEQ ID NO: 49420 - DNA, 1340 bp, Oryza sativa
caacggcgccgcccgcacgaccgcctccccactgccgccgccgctggcggccgccgtcgcggcgccgccctcctcctttcccgcctcctcctccgcgcctccgctcgcaagccgcctcgccggccgctgctcagccccgcaaagaggagaggaaaaagaagagaaaaaaaaaagaaagggtaaagagagagggtgacgcggacacctgatatgtgggttccacgtgggtctcttgctgactcagccgccacatagaccaaaaccgaggtcaaaaccaccgaatgacctcgggtgaccggttttgtatagttaagggaccccgaatatctggttttgcatttcgaggacatttttgtatcccgatgacaagttgagggaccttcggtgtactttttccttttggttcccttcaactatacccatagtttgatttttttaagactaaaaaaatgcccgtggatgctattttaatttaattattattatacggtttagttagggtgaaatttattgtgggaattcatttggatatttttttaagaaaatcataagttgtaattaggaggtcgcatttcatctcaagttagcattcgagtttttttaaagagatttcttatatgacttcttttgtatttccaaaagcacacgagcttaaaatgcaactcaaacatggatctatatttccaaaagcaaatgaacttaaaactgactcaaacacggataatgtaccaaaataccggcaaaaacattttcatgttttataatagtagagatagagatataacgggtagaaatccgacctctatatccataattggatttacacagtcaataccctagtttgattgttgtcaagaccagatatgaagactcccctcaacccttaaaaccgtccaattcaacttcccaggaggttttcagagtggttcggtccgatgtgacgcttatatggcattaaattacagtaaaataaaattaataaatgcagtgaactccacacatcagtgaaactcctcgtttccccttcctccctgtattacaatcaaactgtagctatctttgagggaggtaaaataaacattctcccaaccgtaaaccaaaccatccgcgtaatgggccgcgcttgggggcccaacactggaggccataataaaccctcgagaaccccctccaccggcgccgtcgccgccaccgccaccgccttcccctcgatcgccggagcggcgagcccacggcggcgagcgccgcagccatgtcgcgggctctcctcccgcgcggcagcattctactcgtccttcgaccgcgagtcccgtccacaccccaccgatgcttcgcgattg

SEQ ID NO: 49421 - DNA, 1501 bp, Oryza sativa
tactccatccgtttaaaaatatataacgacctaatataaaatgagacatattctagtaatataaatctgaatagggatttcttagtatcgagatgtatcccatcctgtattacgttgctatattttggaacggagtgaagaataatcaatcaactgagcttacttgcttggtagcttccaactctgtgtgatctcatgattacctttggagctgcagttagctgttggttactaaagaaactaaaggtgcaatataatataatggtacccttaagcttaatctctctcatcatggccgccctcgatctcatggtggcctagctacctttatttctgagactttttcatctctgaatctgccgggaccatgcatatgcatagaggtgccccaatttctctatctttcggaccatctcatcaaaaggacgttcacagatgatagatcaactgttgtgtaataggtatatttgcaagtttcctttaatttcaattttggcatgatcattacacatgttgagatcgatctagagagagagatggcaggagtctttcagctggcttgagtacgtgaaggcagagctggctggctagctagcttatgttgaattcatcacttttgggctaaccagcattatgcattatgcatatggccatatgggcctgattgatgaaagggccattgcaccttgactgaccgtgagatcgccttttaaatgattatgtgtatatcgatcggccttatattaatatggctatactatagtaatatggtgctactacctctgtaaaaaaaaacttcattattttcctatctcacacataccaatataaagtcaaaagactaaaatgctctccatttttttcgaactccaatacatttgttcctcgcttttttaaatctctaatgtatttgtgtttcacttttccaaactttgatgtattaactgtcttaaaaatgaaggcattatgggacaaatgaaaaaggtaacaataaagtctttgtgtgatggagggactactacatatgttttaaaatacaaattgttgacttttgactattcatcttattaaaaagttaatataaatatgaataagtcatatttgaagtatatttaatgataaaataagtgatatttacatactcccttcatcttaaaatatagcaattctagctatatatacggacatacttttatgcaaatacatatagctaagttatattatatatttcaggatggatatagtagtatttttaataagatgaataatcaaattaatttattatcatcaggagtcaaacacatcatatatttaagagtcctgctccggtgctttctacttggagtagaaagcaatctgagccgttcattatatttaattgtagggttgtgatctatttctactcccaccagagttagtggtagtagaaatgtacaaaggtatattcgttcagggataataattcgtgcaggggtattatcataatttatcaatatctaac

SEQ ID NO: 49422 - DNA, 1243 bp, Oryza sativa
taggctccattaccccatgattagtttaacactaatgaccttaatgaagcttttggttgtaatgtaatgtaaatgtggtgtggtggtgttgggtggtgtgggaatgaatgaaaagacacacaaatgcaacacaaatgccaaggagaaaaaaggggatctttatgtgcggttgcagcatgggcgattgggcatgcagaagctatgccatcatgctcccaatcctgaccttctgatgagaccatgtgatgtgatcacctgtttctttccttctctgcattttattagccatggattagaggagagtagaaagatcacctgttaattgaatacttctacatttgtggcaagaatgcactaaaatactatttctgaatatttctctccctctctctcttaagttttgtttgactgaatttctgcaatgtcattgtttgcttttcagcttataagccattgtcagaatttgaattttgaaattgactttgtggctttctcattgtagtttctttctagcattttcttttaaaccacgaatagcacagatattgaagttttgcccacaaactattttgtggttgcttatacgctgttctatggtttaacgatcaaacttctgaacatcattctgaatgtgacagttccgaaattcagcaggaagaatgcttgcaatgcaagatgctgttgtgatctcgatggcatgattggtgcaggttgatgtggattagtttggattaatcccagcatccgttcttagcggttactgtgcagtcaaaagagtgcaaattaaagatgtatattagagagagtcaagtaataatgcagtgtagataagatcttcagtttcgcctaaaaagccctgctgctgcactgctcacaatcattagcacttctgtacgtagatttcttctttggaagatcattagcatcgcagattcagaaacggctaatctgtagcatagctttgtcattcatagctagtcttgtcagtctctgcgtgatttggttcggattggcgcacgcgatgatgattggaaagtgatttggaaaaaaatttggaagaaataattccactgtgatacgatcgtcgtgtgcagattttgtggggagagatcccggccgtccacagatcaggaacggacggagaccagcagacatgatccgcgatgcgaggcagcgtcaatcaatctcggccgttcatcacaagaaacagacggtccgcatacttccagcaggttctgcgtca

SEQ ID NO: 49423 - DNA, 1501 bp, Oryza sativa
gtagattcagagagatatagcaaagatctaaataaactagacaaaactctaaccctttttatatatatgtatgacaaaaagttttagtgagatctttataagagctctcataattctggtaccagtagtggagactcgagcccttgccgtccttatattagatcatcccctggagccatgcatgcagagataatatatacactaaactccgatcttttcatacatgaatatattagtagaaaatcatagctcgtagtactaagaacatgtaatattccatattatgtttatttattttggagcacaatgaacaatcagaatatttatatatacaatagatctctcctacgtatctaaacctaattggtacttgctaaaaactggtcgtacgtacgttaaaaaatatctgaccattttagatggatcatattaacatgatctatatgcatttaacttttcaggtcatgttaaaaacttatctattctacatctacatattgtgggagtttatacttcatgatgaatgtttttttttataatgggaatttataaaacccggcttcaaactggatacaacggggtttttattgattccaaattctagactaagcaaaatgtcggtaagctacaactaagattacaaactgagtacaactcaatatttattaattcagaattatgaaaccattcagttttgctatataattgtcgataaattttcttctagaaatttaacatatataattatagtactatcatgatataattacattgtaatttacatataactataatataacttgtacgcaactttcacaaaaaatttgaattggtagatttgtttcaagattcttaccggcaaggaaggaaaaaaaatcaaattgtgcgtacatgtgagaggattcggttgacctccatttcacgaaaatagcatgctacgaagagatttttaaaagttacatacaagtgacattgtagttacaatgtaattacaactcgattgtaccataattacatctgtcaaatttctagaagaaaagttgtcgacaaatgtatatgtgacctcaaaaaattaaaaaaaaaatatttcaaatgtcaataacaatagctgtgcgacacacggttttacgactatgaaatacaagaaagaagagatcgggaatacaaataagctcagatatatgtgtagttgttatcacttgtttatatcagtggcatggccgctcgtgtgctgctagctgcatgccccatccatatattgcatacatacacacatgctagctactctcatcactctaaattctaaaatacacacgacaagacagtacaaatcgacgagcgtcttctttataaatcaatagccagcctgcaccacagcctgtgcccatccaattaactacaagaccccagttcatccagtggatcgatcgatcagagctagctagatcgagagatcacaattcagaagcaaatcaatcaagcatcgatcgatcgatcgaca

SEQ ID NO: 49424 - DNA, 1501 bp, Oryza sativa
tgccaacgatatatagtggaaatttggctcattatttacatctagaaatgaccaaacaaggtatagccgtacatgatctcaatatttatgggcttcgattgcctgcacatcacaaatatgtgtttatctcaatatttacacactctggttgtctgaacattgcaaccactatttttgcatgtactgatttttgctgggcagtagagactggggagagcgaaaaattccttgctctttgcctccgattcccatgcatgtctccacgataatcgattgaacacccaaactttccctttacttgctctttacttcgtcgatcagtctatgttataccggctgctgctacatgcttacagtagtactcaatccctcatattccaaaccaaatatacaatttaccaaaattgtgttctctcaaaacaccgcggacacagccagccacaatgaatccgaacaggactcctcgccaatccggtgacgacacgtcgcccttgtacgtttcccttgcgctactgcctgctgcttccttcctgccgcatgggccagctgagcctcctgctgcccgggcctacacaaaaccagcacactgcatggcacagcaccaccgctacagtacccgaccatatactccaacaatttctctctccaacctccaacctcctccgcgaaaaccgacgcttgcacggacatctcgtgaagcccgttgcgaagatctctttaacacggtgtctatcaaccgtgtgtggcatctcgtatccaactttatcccttagtatcatttatcatttggaccttaattcctccctgagcctagtctcgatcttaccgttgaccaaagttgatctctaagaattctgactctagtcacttttcacatggtattacgaccgtgctagatctatgctcttccgtgagtatagtcctaatccttaccattgactaaggccgactttaagtcacttgcacacaatcagacaaaacaactatttctggacacaaatatcacaacatgacccacattagtcacacacgctcacaccaatatccacatataattccaaaccaattttcattgaacaaactatttgcaaagccaattgttcatcacaaaatattaatcatgacaatgatttcacaatgcgtacatgaactcacatttatgcacttagattggctgcctgaatatggaaaatctgtgtagatgaactcaacacttatgcacttcgattggctgactgaacatcgaaaatctgtgcatctcttgatatttatgcactctgattgtctgaacatcgcaactatatgtttatctcataaaggtgggtagagaactagatgatctttcttgacggtgttatgcacactttcgggtgatgaatataattttttaagagtaattttacagcggtctctacgggtgtattctacggtcaatattatccttaaaggtgcgatctcaatcattgatttataacttagatatgattcattgaattagaaa

SEQ ID NO: 49425 - DNA, 707 bp, Oryza sativa
caaaattgcttctatggccaatagttcatatactagttgaatgcctgtgccttccaacgaatttaaaagaaagaatcatagtaccattattgtctcaaatattaatccaagaattccaacagtataaatgctccttatagaattcgttttattattgttcgtgtcactgtggctcactattcaccaccactatttttttagtgtttcagagaagtatatatagcacttcgataacgatagtgttaacataatgctattttgagaacgttggaaactttgggtgctatcaaaatgaatcaggatcttatgattctatgtagttataaactttcggtgctagaaaaataattttgacttattagaaactatggtttgcaaatgtggttcgtcatcgaaaaccgatccctagtggtttggtcgataaccgtgcaacagttatcgatgataaccagttgaattcagataattttttttcacattgatctcgattttggtttgattttttattgaacttgaccgatttatcgagccgtttgtaaatatttattggcttgataaggttgataaccatgataattgagctgttgccgtcgcatttcaataccttgcaatgaagtacccttttagaatatggtttttcatatatgcttattctttttacaaatatttggccctgttgaccaatatttgatcaaatggattgtagg

SEQ ID NO: 49426 - DNA, 1501 bp, Oryza sativa
cctcacttgtccaatcagacgggatgagtgtctaaggttgaacaactccttctcattttgcaccggattattctcccactctttcaagtggtaccgcacagcacgaaaaggaggcaagaatccttgtttggctccatatccagcatcaactagatagaattttcctatcatatgatcgataagttggtcacattcctaaatatcaacatttgtcatggagaatttgataaactatagtaatatattaccttgtgggacatgaaggccattttcacgttccaaagcatctcttaaaactacagcatcatgtgttgtcccctccgaaccagccaagacataagtaaaccgaagatcaaaatctacggccgccattacattttgagtggcatgggacttcctaccacgaaaagaagactccacattcttacgaacagaggctctaatatgtgtgccattaatagctcaaatacaatcctattttgtgttcaacaacattaaaaattagggacaatatatcaatgttcacataaatataaaatgagatagggatgaatctcacaccttaaagtaaggatcccatctaggatttcctgctattttagttggagtgtccaatgagggggggtctgataagttcatctcgtagctcaccaattgcatgaaggactttgttgaaataacgacttactgtttctccagacctatcataattagtgcggactaacctatttctaaggttatgccccaccgtatgcagaaacatagcaacttgttcctcaatacacatgtggatggtatcttcaagtaaaccacgatccttaaacagcttacaaaaacgaaaaaaactttctcttctaagtctaagcatatcgatacaagttgtatcattcctcctctagggactcaattcttatcctatccctttcaaccattgggccatatctaataccttctccttaacctcttgttctttttctagaccgaataatcatggccatcattgataacaataaatttatagcagcaatacaaactaaaagcttggtcctcttatccttctagatccaccaccaaaaataacacatgaccatcatctactgtcaataaatttacccaaaaaaataacattgttgaactaattatactacaacattcttgaacaaaaacagacatgcacagatctataaatgaaatccccattcagtgtagggatggagaggatgaagattttttaccttgaacaatggaaaccgagctctgcagtttgtgggtagggatggagaggatgagggagagcagcaaccggcaatggaggaggcacgcgcgccgtcggctcgccccaacttccgcagccgcctcgcccttctcgcgccaccgccactaatcctaaccctagaggctatcgtgaggaggagaaaagagcaaagggaaaaaagaaaagtggtgaaaatatgtggtgggacgcgagcgttaccgcgctgaggcacgtaaaatcacgagc

SEQ ID NO: 49427 - DNA, 1501 bp, Oryza sativa
taattttcaattaagatatgtttatctcaatccgaagaatgggtccattaaagatcctctgtatttgcaacagctcagtggaaaataaattttagccagtttgtttgcttgtctgaactgacatccaaatggtctgtaattagttcccataatctcaaaagttatggatctgtttgtggtgtttttagatgtgatatgttccaaatgttctttctttctttacatactccctttgtcgtaaaatatagcaacctagattcaaatttggagtactaggttatgtatctgtttgcatctttgtctctcatgtcatgtgactaatgtgaatgcatttctattctacatgtgcggcaaaacaatggtttaaggtcatcagttagatatcagagatactatccctgtgcactaaagtgccttgtcagttagctgatgattcttatttgcctttaagtaccatctacacacatgtcaaattagagttttgctacaggtttatcggcatagatttaaagataatgacatgtcaagacctgacaaggaaaataaaagggattcaaaagcacaggctggtgatctgatggatgatggtggaattcttgtccttagatttcttctgctgcctccttgtcttcgtgatacaatcaaaaactgcgggatcgtctatgtactagtgtgttaggtcgttttcaaaaggtagtgcataatattcgccttaattattgggaagtgtttttctcaagaagaaatcagagtcaggaaagtagtgatgtatagtcgtattggttgccctaacttaatttttaagattttaaattttaaatttttaaacttaatttttttaagattttaagttactttcaacatagttttcttttcagctttaacttttaagtcacaacaaaaaacatatatatatatatataattttatccataaattaatttttattttctaacaaaccatttttggcttattaggaaatatgggcaaccaagagtctaaaccgtgccaagaataatactctgtttttctatcaggcgtgttgattccagaatgtcaaacatcgaaaattataaccaattcttagttaacttgccggtacatcaagctcataaatactataccgatatactcattcaaatttgacttacctttacaaaatattgatttttatatctattaagaatatattgcctccgtcttaacaagagtttctgcagtactactttttttttcctcttcaaccattcctcattcaaatttgtcactcctacctaccgtgaaccactcttccactcccaactagtttgtcttttaaatgaaacaattacactgttttttagatgaagtatctgataagaaattgacagtcgaagtgtaatcttttctaaaatagagttctcagggagaacgtcaatcgtatcaaagtccactcatttctacgactgtcgaaaagggggggaaacccccccaaaaaaaaccccccgggtttttggggaga

SEQ ID NO: 49428 - DNA, 1501 bp, Oryza sativa
ttacatgcattttgggcatgtttctatataaaaaaaattgggatgccaattttgatggcgacatatgagaatatggatatgctttagttaggttttcccaggcttcatagaattcctggcacagccactaatcataagagcagatttcgaacttaaaaatccaaagatacctctgattgagctgtgcagaggtgtgaataagacaagcttacaaaatgcagataacagagattttggggccttttgagccatgtacttttttagacttatgcagcaataaaaactgggtacaagcagatgcagaatttaagataaccgaacagcttactattggtaggaaacacttagtgataaataaaggcatatgcatgagtgcagtacatacagggtatccctaaaaatatcttcactgtccacaatgtcaatttgcaagcgcgtcctgttaattgttaaaacatggcacaaaaaaggttgctgcatgttctacctcaaataacaacatagccaaaggaaagtaatagtagtagggtcacctcaagcaacgacatcccatagctgatatagttcctcatcctcccctgtgcagtgatcctgatctcattctcactaattggtgtctcattgcgaggcttctccaccctttggtatctatccatgcctatgaattgatacattgatatttcagtacgacaatatatacaagccacaatgtagaattacttcaagataggatcataaattatgcagaaataagatagggagagagcaaaccgtatacgaatataagatagcatcataattaattttcactcgatcatatatagactgagtgagattccaacgaccggtgaaatttatacaaaacctaagagtaagttaaaaatgaaaaccatcaaagtccccaaccaagatgaatatcttttgaaactagagattaaatctattactgcaatctgacaggtaagaccaccccttcatcgacttgcaagaaaatgattaattttcgctaggaaaatgcaataagattctctttttcactcatcactctttttgattctgtaacaaagcacggacattctgctagtaccatgaaatacacacaaaggagatgaaacgtggacaaactgaggcactaagtacagaaatctggcaggtcaagatgaagctccctctcacacattagtgaatctacttaggaccttagtgacaaatcacagtcacagtgatgtttgcaagtgacactcaaacactgaggacctaaaacacagcaaagttcattagagcagaacgttagtgtgataattcagaaacccaacacgtagcacgtacagaaccattttgcgcctccgaaatcgacaaccaaccgttcagagtagtcaatcacaagagtgcgaacaccggctactaccggtacacctagaactaaaaatataactcgactgctactcccaagccttagtcgtttgatttaatcctaagacagagtgattccaacacaagg

SEQ ID NO: 49429 - DNA, 522 bp, Oryza sativa
aaatgatttatatgaaaaacgatccaatgtcttcctttctttgcgtgacatgtttcaaaaaaaatgtttttctaaagaaatgcttgtcaaattgcatgattgaaatctgaattgactatcttaagttgttctgataagaagctttagtcgagaaaaaaaagaagattgctccatgagctggtgactattgagacttgagaattctggggactaaagctactagtcgagactattgagacttgagaattctggggactaaagctactagtcggaatgggtatcctaacaagtgataacaaatttgagtctttgtatatgctttagcctgaaatgttgaatgtgtagtcccaatgaattcagtcaatcaagcacattggccctaattttagttagacttgcacatgtcttggaaagttggaatttcactggtctttcttctcgtatttatgttcatgatatgatttagtatcatattgcctaacttatctttgtgctctgcagtgaggtacgacaagatgttgg

SEQ ID NO: 49430 - DNA, 301 bp, Oryza sativa
tggcgcgccaggtagggggcgcgtgtgtctttctagccctcgtcctctttcgtgtgcgccaagcttctcccgctcagccccatggccgaacaggcaatggcgcacaatctctctccgagcgctagcggtgacgatggggagcagaacccgcgccgtcgagctcgtactccactgtccccctctcgccgaagtcttgggcgggaggaggcgctcgaggaggtcgaaagatccgcgacttcgccgcacgcgggcgatggagaaggacggcgagacagggagcgtcgtctcctcgtctacggcg

SEQ ID NO: 49431 - DNA, 1501 bp, Oryza sativa
ccttcggattcttgatgttccagttattggtgtaggaatgtgaaaccttttctggttttggttaattctagctgttgaaatgtctctggttatgttcctagactggagtattatgtaatgtgatgaccataattcgctttatgaaagtttatgagatttgaagtacctttacctgtccttttgatctttgttagatgtgttgtatctgctttgtgtttttgaaatgctttcttgctcttgcctgatattggattaaagtattgaacaatgcagcattgatatgtggtaacgtggtttggaaaatgtctctttttttttgctctgcaagatactgattatgtattgaagaatcgttcatatttttgccgagtgttttatttgcttgaatatggagcttaagaggtttttgcctgatctgtgcttttatctgcctgccggatttcgttatcaaatctgctttgtgaataattagtggtttgcagcttacaaacttacaatttacatgccatgttatccaatttacatggaaagttgttcagtcgttcaaacttacataatttacatgccatgttatccaatatgcaaatgttgctaaatcattctgtgatgcttcaaacccaatgtacgaatgcaacgaaaacctaatattcaaatgctgtttgtctgtcatgatttcaaactgcggtgtattttttaaaaaaagtttttatatgaaagttgcttaaaaaaattatattgatatatttctgaaaaaaaaagctaatactccatccaaaattaatatttagtttataatttctcacatactataaggtttgtagcaacaaaattattaccgtatgaaagtaaatttaaatctcaatccaataatataacttttaataaataaaaaatattttatattaactaagtgttggtcaaatgtttgaaaggttaatcttcaaatacgggtgcgtcttatattatgggatggatggagtacttaattaatcacgtgctaatcgatcgctctggacgtgtgcagcagctgtgttgggaaacgcagcctaaatcattttattgatgctaaaatcccactgtacaattgcaacgaaaacccaatattcaaatgctagcctaccattgtataagcatatgaatatgtgaattgagtacaaactaccattgtataaaacatatgaatatgtaaattgagtacaaatcgattagtgaacgtatttataccgcaaagagctatcggtgactccacaaccgagcatatgaggcctgaggagaacaaggacaataggctggtgttgcacctgcttcgcaccccttatccgcttcgtcaatgtgccatccatccaatgtatgcaactgtcaagctcgctaggccagcaagctgaggcaccagcccaaccatggacgccgttgccggggcaagcgtgagctcctcttcggcgcggctccgcccgtgcccacgcccccgccgcatcggcaacgtcgcaccggccaccgtgcg

SEQ ID NO: 49432 - DNA, 190 bp, Oryza sativa
taaaacacagatacacattaaagaggatgagaatagattatggtatggtgggacctaccttgaagtagaatttgtttacataaatgtgggacccacttaacatatattcttgcctttcttgccttgaacattgtggacatagggtatggagacataccttatttccaccatggtaatggtagtgccatta

SEQ ID NO: 49433 - DNA, 495 bp, Oryza sativa
tccagcccagacaaccagcgaaatcaagtctcccgtaaacatacttgtatcctaatttttttaatcagaaccccgtactgtactcgattgtcattggagagtttgattctgctatagcatactgcacactgtaaactgaagtgtttttaaagtttaaaatgaatttcaaagtttgattttaaaagaaatcaaaacaatattttaattgtcctcttttttttgcggggattttaattgtcctctttagcgatcatgaaaagagaaccaaaacaaaagatgaaaaacactataatatgaatattcgccatgcaggatgcctaacacaaggagccaggaccccttagttggcgccaacatgctaacacaggggttacgatcttgattggcaagtgaaacccgagccccaccaaggcatcaattttcgctaattttgaagcatttcatataaattgggacaaatttcgaacaagatgcgcatctagaaccatctcgaga

SEQ ID NO: 49434 - DNA, 257 bp, Oryza sativa
atccaggcacgccctagtccctatagtttccgcattcttctgcaaaaaagagcgtcgaaacatgtaaaataactacattatcgactcatcaaagacattttcgagaagcatgcctaagaatagatgaactatcatcacaaaaagcgcgcaggtgcgacctcacgaccagctggggagatggacacgctccacgggctattgtgaagcggtcctctccgccataaatgaaacagatttatggggagccccagccagca

SEQ ID NO: 49435 - DNA, 229 bp, Oryza sativa
ctgcagcccttgaatctcgacaaatatatgatgcccctatgctattgtgcattttctgtcaaggaattatcaaaagctatttctatctgattcagtaatgtcgtaacattgcctggttcaggaattcatttattttgttgtttcttatgtgtgcgttaatgaaaagtttggtaagagttgccagtctagagttaagattttactgctaatgtctttatcttcttgcagg

SEQ ID NO: 49436 - DNA, 493 bp, Oryza sativa
ttgctgcttaattagttatactggccactgacgattctcaaccttccagtttattttgttgctaaaatttctcttcatgttggtattcagtgttatggacatttggatcaatgatggccagtgggccatttatttgtgcatccactagtcaatgttcagatccgaaattgttgatttgttgccacatgttctttgcttggcacaaattcatccatgttatgacgagtggactcagggaattcgtcttttattgcctgatttatgtttactgcataccctgctttatccattttctgattgacacacactatactcgtccagtatcaacagtcagatgccaaatttgttgctagaagaacaggcataactgagtaattgagtatctctgtttgcatatatgcaatttatgtatctgaacgtgaacttgctattaacaatgttgtatttagctaatgaacgattatctctgatctcttacattcccacccatact

SEQ ID NO: 49437 - DNA, 1501 bp, Oryza sativa
tgttgattactactaggtttgtctccgcacacctgggatgctcccagtttagttattatccctctcaggctctgccacgtagagcagaattaccatggctgtagaccccaaggcgccgtttgggcgcgtaactgaattttttagagatgtttcgttacgatccttgattgccaatttggctggaaagatatggcatctgtagcaataattttgatcgagaaaacgtgtacgcgtttcagcggaagcctggaaagatgcttcgagaagaatattttgccaattggtcatacatattacatggtcgctggccaactttcttttatgactcggctcaaacttttaatccatggtctctgaaaacttaatatagacgtgattcacaaaaaaaaaaacagaaaaattcacacgattcttcacagtaactgtagatctcgggttgtaaaattctccggtcgtgtggtggttgtcataaaccgaacgacaacaatgtcgtatggtgaaaaaaaatactgccacacgattaactcactggcatttttcagcctatctgcaatagattcttctgtaaaacttggtgaatttgtattttcggtgctatggtatcaccgatgacttctcatccaagacctgcacttccccgttcaatgcaactacgacatatgatctgcagataaggattgcaatgtcttagaatatgtagagcactgcatagctgcattactgtgcactcaagtagtaagtgtagcattgatagaaatcttgggcatcaatgattactaaatatcataaaggaaaggctgcttctcctaggtctaactatctatatctttgaaacaccttggtctagtactagattaaactatatatagtcatgttagtttgagaaatttacggaatgctggaaactatcccatggtccacgacaccggcaattttctccaagctttctgctaccttacctgtaaccgaaacaagtcaaaccagctaaaaatcaatcgaagaaatggtcactaaatcatcgagttaacttagcataccaagatccgggatgggagttgtgaagataacatcaagtacatgatggccctccttggtaaccaatgggaagtcacctcctaatggaccagcggttccaatcgatggccgcctccataccttcatcaggttatcatgtaacgatgaccaatgatggaaagtactcagattcacatcaccacaaatccagtagttgctcagacttcagagtaaacattagaattacataataaatatatgagtgcacctctgcgtctcctaggaacaagtcatcaatctcttcagcagtgtcgatccaatttgcctgaaatgacccgttcttctattaatgatgattattgcaattgcagaaaactgatcactccagtaccagaaggtggcttacacttttcaccaagactggaattgaaccttcgatgcctttcacatatttttcatggccaatgatgaaggcaagtttatcagc

SEQ ID NO: 49438 - DNA, 155 bp, Oryza sativa
tatgtcaactttttatattaccaaaagaacttgtaaggatatgatcaagatgaaaaataataacaaaaggaaatatcaacatgatatttcaaatatttcaaataacaaaagaacttgtaattccataccctacttgcaacaaaatatttcaaata

SEQ ID NO: 49439 - DNA, 1501 bp, Oryza sativa
caattgcagaaaactgatcactccagtaccagaaggtggcttacacttttcaccaagactggaattgaaccttcgatgcctttcacatatttttcatggccaatgatgaaggcaagtttatcagctgatttaacaataccctatggaggcattttcacatgacaatgtggaaaagaagagaacagattacaccaaggttgtctcgatgagcaactaaatgaatctcatttctgatgagctttttgaataccttctccaccatgaaagaaggctctccgctctccgttttccgacggccaatgacagcggtcattgtgtcctcttcaattatatcagcatcagtgaaagcaaagtcaatctatatgtcagtaaacaccgtttcagcagttcacccactttctcccattgtcagcaagatttacaatggtgaaagaaatcaacatacttgggtgccttcctcgtagctgctgacctgtatccctgctttcactgcctcacttgcactgatcgtggacctggctgatcaaccccaagaatggattaaatgcaactgacaaagcatgtcatccaaggaaattcaggtcaggagctcatgcgtccactcttgaaacaatgagtgatccaaaaagaagttagcttcagcaaccagaacttacgagggtattccaaggatgccagtgagagaccctcgccggaggcgagtgccgaggtactggatggcgaggccggacgccgggccggagccgagcccgaccaccatgccgctctccacaaacctgtccacctgaggccaggccaggccagccaccgagctcgtcagaataatatacacatgatccaagcgtcaacgagctgatggaacagtggagaatcccctcaccgtgagcttggcggcgtcgaagaggccgacgacgtcggcgtccgcggcggccgcgcaggtcacagcacgtctccggctacggcggcgcacggtggccggtgcgacgttgccgatgcggcgggggcgtgggcacgggcggagccgcgccgaagaggagctcacgcttgccccggcaacggcgtccatggttgggctggtgcctcagcttgctggcctagcgagcttgacagttgcatacattggatggatggcacattgacgaagcggataaggggtgcgaagcaggtgcaacaccagcctattgtccttgttctcctcaggcctcatatgctcggttgtggagtcaccgatagctctttgcggtataaatacgttcactaatcgatttgtactcaatttacatattcatatgttttatacaatggtagtttgtactcaattcacatattcatatgcttatacaatggtaggctagcatttgaatattgggttttcgttgcaattgtacagtgggattttagcatcaataaaatgatttaggctgcgtttcccaacacagctgctgcacacgtccagagcgatcgattagcacgtgattaattaagtactccatccatccca

SEQ ID NO: 49440 - DNA, 515 bp, Oryza sativa
tatgtcaactttttatattaccaaaagaacttgtaaggatatgatcaagatgaaaaataataacaaaaggaaatatcaacatgatatttcaaatatttcaaataacaaaagaacttgtaattccataccctacttgcaacaaaatatttcaaataaatgctcaaacgtcataaataccttagggggctctaataattgtgtcctcaactttgctatttttgctttcagttgtccaagatggtattctgtatgacaaccagaaataaaaattattcccagataacaatatgcaagacatttctcacacagtattgagtatgggtgggaatgtaagagatcagagataatcgttcattagctaaatacaacattgttaatagcaagttcacgttcagatacataaattgcatatatgcaaacagagatactcaattactcagttatgcctgttcttctagcaacaaatttggcatctgactgttgatactggacgagtatagtgtgtgtcaatcaga

SEQ ID NO: 49441 - DNA, 1501 bp, Oryza sativa
acgcaacttcatcagaaaaaaaaaacttatccctcaatttaacatgtagcattgttctcaatttcaacacagatctgaaacaatctaagctagcctggcacacgattctagcacaaatcaaagagcatatgtgatatgtcaggatgagtaccacccctagatatgtcaagcgacacacatagtttgtgaaccctagctaggactaatgcaaattcgagaaagaggggatgcatggatactcaccagccagcgatcgagcgaggatatgcggcggaagcagcagacgccggaaacgatggtagcgcggcggcgatggagatcgatcgacgcaggcgaggcggcgggcggcggaggcgtcgtccgtccgggtatggagtgactgcatgggcccacggtccggcccaccccacacggcaacagaggcccactgtccgtccaaccgcagccagtgacccggcccaatgatccagcctttgggtgctttgtagccaggcctttttctgactctttccaatggagtttttttttaatataaaaaaaacagttgcaggctttccaatggagttttgataggatgatcttgttgggaggcttcaattgcttacaacttcggccagttcaagcggaagttgccaaacctttctcttgccaaaagagtctggcaaaatgccattctatgtttaccaaactagccacccatatttttttagctttttttatcttctaattgtctaattgagtggattatctggttttgtgacagctcactattctagggtatataaatgactaaatcaactattataaagttgaaattttgttctatgaagatcagaggagatacctttatatagatttttttacatgaaatgcactgttcatgagtttgaaaatccagaatctttcatagaaagagagccatggtgttttgattgtgcgccaattaatgatgcaaggaggtaaggcctcaagggccattgtttttgtcatggattgtgaagtttatcaaatttataagagtaaattttacattgggcatatatttcgagcataattttataatgtacaagggctaaacctaagtgctcacttaacaccacacgtgcttacactagtttgcactttggactagagcacacataaaaaagaatatgtttgagagaacctagtccacaatagtaccatttttagtgcgtcatagtattaggataaatatctttagataatcatatcaaaaggcatttttagcaaaccacaaaaacacatttttcagatcatagtacaatacaatgacgtgaacgtgtttaaggaaaagcacaaattaatctacacatagtctatttagatatgtagtactagaaaagtatcaaaatatcccatctaattttatgttcttatattttaagatgaagagaatactatacttttgtataaacttaattgatttaagaaaatcaaaacgacttacaaagcaggttgtggttacttttagttgcccacg

SEQ ID NO: 49442 - DNA, 716 bp, Oryza sativa
ggtgtatatgtggcaagtttgttactttgtaaatgcatataatttatagttaaaaatatcactaattgaataatcaaaatttcaatctttgatcgatgaggtatagcaaaatacaagtgtgccaatttatggaataaccacccgatcaatttataaggctatgaaaagatgtatataagggattattcatgtgatgatgtatgaaacaaatgcaacaatcgtgttcaatgctatatacgatttccgactttgttttaccattgttttttttgtcttgttttagtttgtcgtttaatttagcaaggatttgatcaaacgtgaaaattgtattgtaatacacatgcattttttttgctagttagaaaaaagaaaatcaagacaactgagcgagtatctaacaattgacaaaagtatcaaaattgctttttacaaagaaaatttccaactgtcaataatgcatcgatgagtgatacttttcttcatggctgcatcacaacactctcctttctctccttcctttccccttttgtcgccctccaccctctcaaatcaaagcaaaaaaaacacaagagcatttcccatctctcccactccttccgccatggccgactaccaccgcccctaccggagcgacctcgacctccgcccaccgccgccgccgccgtcctccgcctccttcccgcactccaacggctactacctcccctcctcctcct

SEQ ID NO: 49443 - DNA, 1500 bp, Oryza sativa
acccccaatcacacaatctaaaaaaccaaaccacgccctttcccccaatcttccgaacctatattaaaaaaacaaatctaccttttcgttcagtggagtccccaagattctcccttccaacaaaaggctagccaaaaaagaaaagaaaaagattccacctccacatcgccacacatagcgaccatcagagctcgaaacaaccaagaacaaggtctcaaacagatcatacccaggggagacacagcagcagatgaacgaagagacggagaagccctcggctctcgagcttcttggagacgaacgaggcgaagagcaagagcaggtattcaaagtaggagtagtagtagtagtagatggggaagtgttcttcaaggggactagtagcaattttattccagtggtgtgggtgcgcggcgtgtgatctgatttgcagcctgtgcagtgctgcactgcgggtcccacgagcaggttatctgctacgtgtacgcgtgaccgctacgggttgtttcacttacaggtgggccatagcgggggatattcatggtggggcccacgtgcaagagaatgtcacgatctcgagtaggaaaggaaaagaaaagtggttgcatggagcacgagggaagtgtggtccattccgaggatatttttcgaatttattattgggcttgtttgtgttgagcaaatcgccatgttgcctgttgctgattcgaaaataattgctgaattgttcgctggggccaaaatatatatgagtttaagcaaaatttacactccacgtgggtgccattgttcaaaaaaaaattgaagaaaaaagagttgaatgattgagtcggcaactgcctagatatatagagcacgtgggcaactaaaagtaaccacaacctgctttgtaagtcgttttgattttcttaaatcaattaagtttatacaaaagtatagtattctcttcatcttaaaatataagaacataaaattagatgggatattttgatacttttctagtactacatatctaaatagactatgtgtagattaatttgtgcttttccttaaacacgttcacgtcattgtattgtactatgatctgaaaaatgtgtttttgtggtttgctaaaaatgccttttgatatgattatctaaagatatttatcctaatactatgacgcactaaaaatggtactattgtggactaggttctctcaaacatattcttttttatgtgtgctctagtccaaagtgcaaactagtgtaagcacgtgtggtgttaagtgagcacttaggtttagcccttgtacattataaaattatgctcgaaatatatgcccaatgtaaaatttactcttataaatttgataaacttcacaatccatgacaaaaacaatggcccttgaggccttacctccttgcatcattaattggcgcacaatcaaaacaccatggctctctttctatgaaagattctggattttcaaactcatgaacagtgcatttcatgtaaaaa

SEQ ID NO: 49444 - DNA, 1501 bp, Oryza sativa
gttgcaggggcaggcactgtggtgggccagacacatggtgggccagcggcatgcaggcgcatggccgcgcgcggggagcggggccggggggagcacccgattttgctcccccgtccagtcacccagatagcagcatttccccggtatttttataaaggaaaaatataatactggaattgatcatgcgtaaataatatgtctcgtttttttcctcagactgatttgtctgtctacacggtatgatgtgttggatggattgaactttcaagtttaggccgtgttcagttagttggccaattttttttatgtatactgacacatatttgaagtattaaacgtagattaatgacaaaacaaattatagattccgcctgtaaactgcgatacaaatttattaagcttgattaatctgccattagtaaatgtttactatagcaccacattgtcaaatcaggacacaattaggctcaaaatatttgtctcgcaatttacatacaaactgtatagttggtttttttcgtccacatttaatgatccatgcatgtgtctaaatatttgatgcgatgttttttgccaaatttttttaaaatctaaacacagccttgttgttgttttggaattcaaattcgtatgattagcgagcctcatgttgatttgggagtagtagaacagctttcacctggcactccgtacaaccgctcatcctagccgaacgtgtatgacctcgaatgctttcgacaaggacaatcattaaccatgtttgtttcagggccctggcaaatggatcacaacgatttcacatcacttcgtaaaccgtttactccgtcctaaaaaatccaacctaatactctatccgtctcagaatatagtaacctaggagcggatgacgtatcctctctccgtctcagaatatactaacctaggagcggatgacgtatcctagtactggatacgatacaacctaattctataaatttctattcagatttgtttcgttgtgttagaatatgtcatatttcttcattattttttttacgaagagagtagtagatctcacatctcggtagtctattcaaatcaaccttggccgccgtcctatccacggcgagccccacggcccccaaacccgccggccgccggtgggccaccgctccccccacaacaattaattactaactcctcattactaaatgatctctttattaatcccttgtacacctgtaaccactccacagtccaccccaacccagcgtaacgtccactcatcgcgagccgctcaatccaaatccaacggcatcccgcaacccacgtgtccctcaccgcgcgcgagtttgaatttcccaacggctctctcgaccgttgctgccacgctcctgaaaaaaaccaaaaaaaaaaataaaaaaaacacgcatctgtttttattctctcccatctctcccgatctctcgcccatttgcctctgatcccgaaacaaacagttggcggcggcggcggcgcgagg

SEQ ID NO: 49445 - DNA, 466 bp, Oryza sativa
ccagatcagagggtggtgggcaactactattgtaaatttttgaaacatggaattagttttgtaaatattttaataaaaaattaaaaaaaatcagcatatgcatggttgtttgttttggcccgaaaaattgctgcataggcaaagcccaacatttgttttgggctgtaaatttcaggccggtttgcccggaatgctctaggcccccaaaattaacagtcacatataagcacgcatgattttcttttttttttttggaggaaacagggaccactttattcaatcaaagcatcgacacaaacaaagttgtgcgatagcagtacagctattgtccggccagaaatgagtagttcctcaactcggcctttactaactaaaacatgactaatatgattttcattcctatgcaccttagcaagactaatatcccaacaaaaatagacacgtatgattcaaagttcaaacagtg

SEQ ID NO: 49446 - DNA, 1244 bp, Oryza sativa
tggcgagtggcgacaaatgcgtcacgctctgtatacgtactgtacaaaagcttaacgtgttgcttaaattatacgtgtcatgttaacaaatatatatttctatcaccgctttaattgtgtatatctttgttggcaaattaccacgcatgcaatcttagtaaaagtgccccttaacaatattgtttgggatgacatatgcgccacttatttcaaaatttacatataatcatgtgagaaatgaaagcccatatatacttggacttagtggcggacgtagctatagaaaaaaagaatgtgtttgatgctcattctataaggataatcgaacacaacatttatattataatcacataaaaaagtataatataatcaataaattaaacaaacatgaatatttaagatggtacctaatctttgagccgtaaatagtaaaaaactactcaaatcttaaataaaaaaatcgaaggaaataaccaactgatcacttgttgctcatccgtcaatcaaattcgaagttccactatacaatcctacgataccttggttctgaacttattaccaatgacacttttcccatcaggcatgcattcggactcaatagcctttctcgccctcagccagcggcagtgattcagattgtccctccatctccatagattgcacccatagtttcgctcttgttaaaagctcctcttcagagaccatgcatgcgaggaatgaatgaagaaagtgaaaaaaacaagtcacaaacaaagtctcatgcgattcgattggaactttatgggctgacctttgtcgatcgaccgagcctacctaatgggtaaatctgcccctgcttggcctgtgaaatatcttgcacaatatgttaaatcgagggataagttattttctgatgagattgtaatattgtatgcttgtataaattattcttgatcatatattgatatatagtatgccattaattagctaaccagttgaaaatttagcttattgctagaatgctcgtttctggcctatgttgcattgtctcttatgtttggatggtcatgcatcattaattcctgagtatatattgttcaactgatggactgtaattctttccaccacaaaatgcgtgcgatgatctgcaactgcaaaatgcaagcgatgaagcaacatgcgtaatgcattgcatgcccggcttccctcttctgcaaactccttatatatagccctccaaactccacacagctagtataccagta

SEQ ID NO: 49447 - DNA, 391 bp, Oryza sativa
tttgcattctgtaccttctaaaatgattaagacacatgttcttctataattgtgtgatatgatgcagcatgttttgtttggaaatatggggaaacatttgattttttttttaaaaaaaaatatccaccataacaagtttttcctacatagatgaattaggcattttcttcttttttttcaagagtgacatggaaagttcttgaatttggttttcaatgtttgtgtggaatttaaatccatttgctttaggcaaaaaactaaatccttttacagtgaacatgatctctatgactgacacaattcaagcatttacacatgtttattgtaagataagcagtaaaccactgtaccaagtgagtgcaagcaaacaacaaggacaagtaataaccaa

SEQ ID NO: 49448 - DNA, 581 bp, Oryza sativa
gtcggatctccttggagtgggatatatgtcggccctcggaattgccaacttggatttgcaggaatggatacatcgctctcccacttctctgctacttctgctgctgctgctgctgcaagcttagggctctgtaaactaatggtttctgcttctgtactttcttctcctatctaggcctgtttaacttcacaccaaacttccccaaactaccaacttttcatcgtatccaaaacttttctactcacataaactcctaacttttttttcaaactaccaactttctccaaacttctccccaattttagaaactaaacacagcctaagagtatgtaactgatgttgtaagcctgtatcactgtatgcatcaatgcatcatatgcatgttgatgtcgtagtaatatactttattcatactggattataatttgactgatgtggatctagctggggtagttaattctttgcaaaaaaatgatcaagatgatctattaaacaggtagctaattatctgcaccagcctgttgattccattggttatctttggtcaaattcagacccctacacaggaagcattggaaaaa

SEQ ID NO: 49449 - DNA, 361 bp, Oryza sativa
ccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaa

SEQ ID NO: 49450 - DNA, 661 bp, Oryza sativa
aaaatggcagccccctacagccggccgctaggcatgagccaacggccatctgccacaacacgaaaatcgctatttgggagggctatttctaaaaatcgtcctctcaaagagcggcgggtgactaattttgtaaatttttgaaacacaaaattagttttgtaaatattttaataaaaaattttaaaaaaattctgcatatgcttacgtcgtcgataaaactgacgaaaatactcctttagaaaaagctgacacgaacaaaacggttcaacagattgaagctgcacctaaacaaagaaatttcgatccacggatggtacggagtatgcactaacaaataatcaaaacaaaaacaacctcgtcgacaatatatttggccgatcgctacaactaaatctcctgccttggccacacaatttcagaatttatccttttgttattattccttttgggatcgatcgatgaacatcctagcaagcagccaagcatatatgagttctgattaccaaacatgggcgattaaagaacaaatttgttgcagctgcaacgacacaccgttctggccaaccaccgatctaaccggatatatattcacttaattagccttataaattgcgcacagattggctcgtgttcttcgcactcactgcaagaacagattaag

SEQ ID NO: 49451 - DNA, 1501 bp, Oryza sativa; identical to SEQ ID NO: 21903

SEQ ID NO: 49452 - DNA, 1501 bp, Oryza sativa
tcttcgtaaagtagtaacaaagaatttgaattgaagttcaaaacggcgaagcatacttagggtccctttagcacagcttggcttttcgaaactactgacatttatttggtctatggattcatgcaaccatcaagattacatagagcaacacaagatacagcactgcaatcacacacaatcatgaaatgtctaaatatgctagtaaaaggagcaaaggacccattcccgttcgtgcaatatcaatgtctggaaaatattcactagaaggaatgcaagatattcaggtagcatatctatcagtaaatcgtaattttgaaatgatatgcaggaacaactgcagcttagctaacaaacattgcttgagcagaagcatgaacaatggtcaataggacatgtttaaatattacatgtttaaattttaaatattttataatgcacatagcacgttaaaatcgagttagatttaaactttataacgcagagcatataccgatttggtccaaaactagaattttctttacaattgagctattcaacaaataaccaaaaaatagcacaagagtttgactgaaacataaatttaggacaaaatccgaccatataatggcagttagcctagagactatagctagcaagttagacgcaaagtgtttaaactcgctatgggcacctcatagacataccaaatgaccctaaaaattcggagcttaacatttcggcatgtaaagtaatgagtgagtatcaatttggaccagttatcagccaaatcaacaggtttacagcgtagaacaatgaacacgttcaaatgaaccacgaagcctatcaccttgggtgtgaagagcggctctgtgaagaggatctggccctcatccccaatctcccacccaatgttgctgtacaggacgtagttgagcaggtcctccatggcgtcccagtccttgacgaagccacgcaccaccggctgcaccacctcctccaccaccgcgccgtcgcccatctgaccgtcctctacctccaacttcatcttcgacggcatcacctaaccaaccaaccaaaaccaaaccaaacccaaaaaacctcagataattctcaaataaccaacggaatctcaagaggagcgggagatctggccgctcaccagcgatggggactggtcgggcaaggcgatgccggccttgagcagcttcgaccccgcgtcgacgaccaccgcctccatggcgcccgcggcggggagcggggaggagaaaccctaagattcggagtcgagacgagaccctgcctaggagctaggggaagaggaggatgtggatgaggaatttatttttgaaaatctcctctccccggaagcgaagccgcgggaaaacgcgagggttttggagaatttggaggctgcgcgaggaagaagaagaagaagaagaagaagaagaagaagaaagagacaagcgcgtgggatctcgaagcggccgcgacccagaaaacacaagcgatatatcatttacgt

SEQ ID NO: 49453 - DNA, 373 bp, Oryza sativa
accatgcctgcaaattgcagcattagtacaatccaagctaaataatgcagctatatgatgtactgcattgttgtgccattacatcacgacattggattgaaaggttgtgtagatcacttttaacttttattttcccagcaatcaatctcagactacagttgttcttttcatggtttgcatggcgccaaggccccaaaaggataggtgcgcaagattcgtagccaacctttaagctgcatcttgtccttcagaaaagttttaaaaaaagaagacatccgacaaggcagacaggaattactcatagcacagctcaaattgccaatcaacttggaagaacaataccgcttctagctaagctttgttttcttgtagt

SEQ ID NO: 49454 - DNA, 170 bp, Oryza sativa
ttggtgaattgtttgttatgtgatatctgtatgctagttatttgtaattagaatagttgcctatgtcctggatttagatctatatagttgtattttctctgttctgtattcccatgatggcaaatagatgaatgcgttgaccatctttactaatccgggttttctacaat

SEQ ID NO: 49455 - DNA, 1501 bp, Oryza sativa
ttgcctaagaatgatactaccaaatggtaatccctcacatctgtacaataccccttatctaagagcaccctaaaaaattcccacatatcatcgcccttcccattcgtgcagaggctttcgcaaaggtgtataagcatatcgctgcttggaaatctctccttccctatcatgaacttgcagaacataacagcagcatcgacatcaatctcagacactgaacaaatcagtgcattcaacacgtcatcattgatagggaaatcccctaaaacaattgcctctgctatttcctttgcctcgccaatctgcctgctggacaacaatgcaaacataaactccctgtagtcctccttcctaggcgcaaccccgagcttcctcttctgcttcaagatcctaccttcctcttctgtcctccctgcttccctaaacgcctctgatacaactctataagctacaaaatctggcttccacccttgaaacctcatatcctccaaagcttgccaagcatcctcaatcctcccctcccgacacaaaccatcagcaaccattactgcaacaactgacctatcaactcggtccccttgatggcgcactgcctgcaccaaccgcagaacctcggccaatccatgcctcctccccacatttttgacgaacaccccgaaaccaaccgtgtcaagctcgacggccctcccgatcattctgtcgaacaccttgcgcgcggaaacgagtgacccggaggacgcgagcgccgcgagcagcgagttgcaaagcggcgcggggagggcggcggagtcggggacgaggccgaagtgcgcgagggcgtcgggaaggcggccatgtcggagcagcgcggaggcagcgaggacgcgggttgccgggaggagcgggagccccgcggcgcgggcgcgggagagcgcggcgaggatggagcggagggtggccgggtgggcggcgcgggaaggcgccgcgagcgacgcgaggtgcgcgtggaaggcctgcggtgtagaggtgggcgcggcggcgtggggagacggcggcggctggccggagatgccgcgcgcggcggcgagtcgcggcgggaggaggaggaagcgcgaggtcgctggcggtggggccatggtgtcagcgagagagaagggggcccgcaatgcccaccaagtagtcctcaagcggaaacacagaatacgccaaccctacaagaaggcgtaaaattaaattacgtaaatgatatatcgcttgtgttttctgggtcgcggccgcttcgagatcccacgcgcttgtctctttcttcttcttcttcttcttcttcttcttcttcttcctcgcgcagcctccaaattctccaaaaccctcgcgttttcccgcggcttcgcttccggggagaggagattttcaaaaataaattcctcatccacatcctcctcttcccctagctcctaggcagggtctcgtctcgactccgaatcttagggtttctcctccccgctccccgccgcgggcgcca

SEQ ID NO: 49456 - DNA, 605 bp, Oryza sativa
aaaagaacaattgtagtctgagattgattgctgggaaaataaaagttaaaaggaatctacacaacctttcaatccaatgtcgtgatgtaatggcacaacaatgcagtacatcatatagctgcattatttagcttggattgtactaatgctgcaatttgcaggcatggtcgttgcatcaccggatttgttttggattggtaacagtagcaaacgtggcctccaacaaaggctgcctacggtccaacaaaggtggtactggtaataattcttgcagattagggtggccgcttgtgattgcgggtaagaggccaatgaaagtggtcgatcttgtctctaatggaagctagcgttccctttgccattaagctgctctcccgtgtcattcttccgcgattaagacccgcctcgtcatgtgggttttgtcctatcaacaagatgcgtcttaagtcgctgtcgggctatcgagccattaggacggtgctgatcgatggtacaaaacatttgctaagcaaatttcagaggtcgtacgaaggaagaaaaaaggaaaaatagaaaaaggccgtgtgacaaactggctcgtgacccgtttgacattgctgtctagc

SEQ ID NO: 49457 - DNA, 1501 bp, Oryza sativa
gtggtacctcggtattcgttctctctaagcgcgtataccaaatattccacatacaccattgtttgtcgataatatgggaaatgggtttgagaagcctttaaaacccgacctgtggtgtcggcgtgtttgaaaataaaatgaattgtgaaaactcgcgatgcaggtgctgtgcctgggtggcactgtcccgtattcgcatataagaaccgattcctttgggaaactcatcaagcataacaagtgcaaccacatggtggtatgggacaccctggctaagtaattagctgcttttggaaaatcttgtatgtcaatagaggcggaaagccgggatgtgggggtagaggcatcctgggagtccgaaacagaggaaggcatccgggagtcctaaaaggaaagccggagttggcccgatgttggtcaaggagaccctctatgtggcatgaggtgacccaaagttagctttggaaaggctttgtcgcaaacctctaacaccggccagtgtctggagtaagttcgtgtcttgtgggtaaagtgtacccctctgcagaggttaactaactgttcgaacagccgtgcccacggtcatgggcggatgtgaggtggttcccgatgcgtagatttgtttgcctgtgctttgtgaaaagttgttgtgaattgggaatcgtaaccagaatcagcctaagtggcagatggatgacctgagtggtcagaaacgaatctgtgtgattcgggatgtctgcgggcatcatagactaggcttcccgagtggaagcggattgctttgctgctgggcagctgaactttgggagtccgcaaaaatgaaaaaggctctgggagccgcttaatcaagtgaaatggctctgggagccgataagtaatgatctgacccgggggtcagtacattaccatttgagttgttgaaaagcatctcttaagtcgaatcgagacgcaagtctcctctcgacccaaacttaaaaagaaataaatcacttagtgattccaaaatgttttcaaacaaaggatttgcaaaacaaccttgcctctcttccaagcttgcattaaacacctaagttcccgtgacttgctgagtacgaaagtactcatccttgctctatataaatatatatatagttcctccgccctgaagctgaagatgaagtgaagtgaagattagggtttcgtcctggttcccagccatcgcctgtggtgttgggtgttagttcgttggttccgctgctgctgctgttgctggtgttttctcgtcagtgtcttcggttgtattctcaggctgtcctgagctgcaacctaagttaaggtaaataagtcctctatttattttaaggattttgcaatgaatcatatttgtcaccgtgggtaccagcactatgtcctgggactggtactgtgatcgcggtttcgtaggaagcggttcgcgccgtttttcctgcgacacgctcctatcaggtgccgttgtacggcggtgccggattggggtgtgaca

SEQ ID NO: 49458 - DNA, 810 bp, Oryza sativa
gtgggcccgccgccatccgtccacccggtgcaccgctcctaagccacgtgcacccgaaaccctagcgccgcacctcgcatgcgcccatcccaccgtgggccgtgtcaccgacaagcgggccccacctggaacccgcgaggtgcactcggtccaccgaaccgctcccccccttccgcgcgccctaatgggccgcctttcccgtgcctgcgccggcccaaatggctcggccgagcctccttcaaccctcgggccgcgcccttgccgcccaaaaaagtctaatatacatccctcgtccatttccttttccataaatcaattctttattccaaaattccatgaatcatttcccttggtcccgcacgtccgtgactgtcaataatattcttgagaatattatttctataaatttcataaatcaatttccccttgttccacaaatatcttcctttgtccacaaattccaattaaacttccaaaattcatatctcccgatccgtaacaccgattgaccccgttccacttccaataattccgtaaaattgagatctatctaatggaactattatttagtctaaataggatctttcttttggtcttttgtttaggttttttattgtttgcgtatagttgcggttaccggattttcgtcgatcgcgggttttctcgaagattcgtgaagcttcgtgaagaccttgagcaaggcaagtcaccctttgaccaattgctcctataattgaaaaatcattactattttgtttgcaacttgcattattagaatcatacactcaacttgcttggcctcggtttgcg

SEQ ID NO: 49459 - DNA, 1501 bp, Oryza sativa
gacccccgggtcagatcattacttatcggctcccagagccatttcacttgattaagcggctcccagagcctttttcatttttgcggactcccaaagttcagctgcccagcagcaaagcaatccgcttccactcgggaagcctagtctatgatgcccgcagacatcccgaatcacacagattcgtttctgaccactcaggtcatccatctgccacttaggctgattctggttacgattcccaattcacaacaacttttcacaaagcacaggcaaacaaatctacgcatcgggaaccacctcacatccgcccatgaccgtgggcacggctgttcgaacagttagttaacctctgcagaggggtacactttacccacaagacacgaacttactccagacactggccggtgttagaggtttgcgacaaagcctttccaaagctaactttgggtcacctcatgccacatagagggtctccttgaccaacatcgggccaactccggctttccttttaggactcccggatgccttcctctgtttcggactcccaggatgcctctacccccacatcccggctttccgcctctattgacatacaagattttccaaaagcagctaattacttagccagggtgtcccataccaccatgtggttgcacttgttatgcttgatgagtttcccaaaggaatcggttcttatatgcgaatacgggacagtgccacccaggcacagcacctgcatcgcgagttttcacaattcattttattttcaaacacgccgacaccacaggtcgggttttaaaggcttctcaaacccatttcccatattatcgacaaacaatggtgtatgtggaatatttggtatacgcgcttagagagaacgaataccgaggtaccacaagggtggagcgacaaggaatcagggtagtacgacctacaggaattagtgcgactactaggtaggtccgacggtttggcacgcaaaccgaggccaagcaagttgagtgtatgattctaataatgcaagttgcaaacaaaatagtaatgatttttcaattataggagcaattggtcaaagggtgacttgccttgctcaaggtcttcacgaagcttcacgaatcttcgagaaaacccgcgatcgacgaaaatccggtaaccgcaactatacgcaaacaataaaaaacctaaacaaaagaccaaaagaaagatcctatttagactaaataatagttccattagatagatctcaattttacggaattattggaagtggaacggggtcaatcggtgttacggatcgggagatatgaattttggaagtttaattggaatttgtggacaaaggaagatatttgtggaacaaggggaaattgatttatgaaatttatagaaataatattctcaagaatattattgacagtcacggacgtgcgggaccaagggaaatgattcatggaattttggaataaagaattgatttatggaaaaggaaatggacgaggga

SEQ ID NO: 49460 - DNA, 1501 bp, Oryza sativa; identical to SEQ ID NO: 23849

SEQ ID NO: 49461 - DNA, 1177 bp, Oryza sativa
ttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataatttgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgag

SEQ ID NO: 49462 - DNA, 271 bp, Oryza sativa
cacgtgcaaccgcccggtgtgcacgcttttgcccgtatcgccgtggttcgcttcgccgctcgccgccgccgcccgccgtccattcgaggccgggtcgtcgtctacctcccgccggcccgcgtggcagccacgtaggcgccacgtcggcgccagctcagccagaccgggtcgggccgaccccggtcggtccctccgcgtgcgcgcgatccaccgcgagccgtgaggctgcgcgtgggcccgccgcacctgcgtccaccgcggaccgcgcgca

SEQ ID NO: 49463 - DNA, 1501 bp, Oryza sativa
gtagggaagagatcacgtgagctccaaactgctaaagaacaaaggtttacctgtatttacacatgggaataggtgctttgtggatatcaaatccttcttgtcccttagcttgctgcctgctgttctcatcaacacttgtgctttgtcctggtgcgagtgactaacaagcagttttactgtagctgcgcgtttcaacaaacaaaaaaaaccacatttgtacttaattatttttagttgtttcattcaattttatcaaccgagcaaacgagtgtccaaagagtactaagagagaagatcatactcctaggcctggtttagattcaaagtttgaacccaaatatgtcacatcgaacttttctacacacacaaactttcaactttttttcgtcacatcgtttcaatttcaatgaaacttccgattttgacgtgtaactaaacacaccttagtactctaaaaacgtgtggatgattgaaattgccagataaacatgcaagtatcagagatcttgcaggcatgaacagtcatgcaggtggtacttattaacagtctttaacaaccatcgtaccagactactgtataacagagccaggagattcatctttcaatttcatggctctacatgtcaggacttgacagtgctgagagtttcagatccaaatgacaccaaacaaaaatcatgtggaattctgtttctgctgttctctgcgcttttacagatcccctgttcatcagaaatgccagcaactcagcattgttgctgctgtctgcaaatgaaagattctcaatgtcaaaaccaatcatatgttaggcagttaggccatgcaagttcatgccaatggcactatgccaaatatcaagatgccatcttttgttcagttctgttcttcaaaattttttgtctagaataaatttacactttgttgagcaaaaagtgctgtgaaatcatgggagaaatgatttttcaagtgcaaaaaatattttttaaaaagaaaaaaaggccgtttgtggttcgctgttggcgccacttgttttgggggccttttgggagtataggattttaaacccctcaacctccctagcgataggagtttttccctcttagtagctagtactccctccgtattttaatgtataacgctgttgactttttgaccaacgtttgaccactcgtcttattcaaaatttttatgcaaatataaaaatacttatgtcttgcttaaagaatatttgatgataaatcaagtcacaataaaataaattataattacataaattttttgaataaaacgaaaggtcaaacgtttataaaaaagacaacgacgtcatacattaaaatacggaaggagtaacatttttgtttgttacttgttttcggttcttctatccttgtccactgacaacagccttctgctgcttgtgttgtgtaattaaactttacttttcttcttcttctattttacttttcttcttcttctattatattgatatgtaatcattttg

SEQ ID NO: 49464 - DNA, 368 bp, Oryza sativa
cggcttggcccggtcaaagccgaggtggcgccgacgtggcgcctacgtggcagccatgcaggccggcgggagaaggaagaaggggaggccgagatggacggcggacggcgggcgtgttcactggagcaagcgcgacggatttggtcttcggggagcacaccggagtgacgagggcatcgagaaggagcgagccaacggctcagattcgccggagggagttcgacgttgacgaattgcggcggcggccgccggcggtggtaaaagaggggatttgtcgacaggcaacgggagtccgattcaaagcggtgggagtatctatggtggtcgggaagcccatttctggcatcggatggggcagagcgacgcca

SEQ ID NO: 49465 - DNA, 1501 bp, Oryza sativa; identical to SEQ ID NO: 23847

SEQ ID NO: 49466 - DNA, 983 bp, Oryza sativa
aagagatgggccgagcggaattcggcccatcgaacccgggggaggcaaactagacttttgcggagggattcgatttggaaggaattggattcggaattgaactcgacgatagatcggggattgagatcttgagatggcacggacactagacaacaagcaaagaaacaaatttcgcaattagggtttttaagagataattttcccgctaggcgccacgacggaacgggtgctacagggatttagttggtcctgcataaaagaaaaatgatgtaattacatcttcaatcaagcagttcatacgcaaaaaacttcggtaaaatcatcagacatgaacataaaataaactttttttttgaatggaaacataagataaactagaatcttggtgcttaggtcgctccagttttttttttgacgatttacttactattacgcactcatggaaaataagattcttttttcttttcgcttgctttcaatgtgattgaaaattacgaatgcccttgaagacgatggtgtacaccaatacaccatacaaaaaccaaattactttctccccaaaaggtgccaacttgaagtctctgttataaaaccggcccccaaatcacatcggaaaccaaacgcggaagaaacgccatagaagatccaaatacgatgacgacactgaggcacgatatttgataacgaagttctgccgaggcctacatctctgggtcactgattgcgggcgttcctccccgatctagcatattacagcgtatcagagttacaacgactcacggctggtcactgccggcagccgctccctctcgctgtgctaagtcgccatgcggttacaagaggcacgcccctctatttatgagagatcctaggatatagtccgactcatactctattcctatacctagtacaactctaagtcctaaactgtaaccgattttgtacacatgttcgacacaaactctaacactaatgctagtttc

SEQ ID NO: 49467 - DNA, 621 bp, Oryza sativa
cgggtggacatccacccgagtgtttaaaacagtttcccctagtgtcattgattagttgggtggtcaaaaggggagcaagaaccaccagattttgattgctcatgagacatgtgcattagaatctataaaattctcacgcatgcttgcttacattttgggggtcacggttcaggtgtgccacactcacactggtttggttgaactatgatgtgcaattgtgcatgcatgcatgccaactgagagcaccagccaacaccaggtagatgaaaggatataaacacgggtaagcaaaattatcaaggaagcctatgactaggcagacaagtatttaatttgagcaaagttcagcatgatccctagctgtatttactgaattatttagcagtttttcaccccacgtatatgtgagaggcaaatggccatctctgaatttttagattgtttttttggtttgtgaataaggctatatagtacattgcacaatgtacttatgatctgctagtgtgtgttggtagatgagagggttcttcgatgggatttaaccacatatgctgctgtgaagaggtaaagacaaacatagcaggacaaggatataaagtaaaaaaggagattaccacacca

SEQ ID NO: 49468 - DNA, 192 bp, Oryza sativa
cccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaagg

SEQ ID NO: 49469 - DNA, 198 bp, Oryza sativa
ttcctgcgccccaaagtcggagggctcgccgggatttcctacgtcctgaacggggaagtgtgcaaagcatgcagcaatcgaaatttgcaaacctcggtgtgaagctcctgctggcgggaaggcagagagatctctgccaggtgtggctcagggtggacagggtcggtgacgttgtccacgtcagttgcaccagcgtga

SEQ ID NO: 49470 - DNA, 1501 bp, Oryza sativa; identical to SEQ ID NO: 21883

SEQ ID NO: 49471 - DNA, 507 bp, Oryza sativa
gttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacg

SEQ ID NO: 49472 - DNA, 1097 bp, Oryza sativa
ataatccggtagtcctagtagtaatatcaaatttatgtgatggtggagagattaaatatgagctagatgtaattgtttgggagattatgtttgttgttgttgttaagttgagaattgtgaagagccaccaataatgcataatgcagggtttgcttctgcaattaatgtgattatatgtgaatggttctaattaatagtagttgttatgttttggtatgcacaaatatagcatatgacattaaattttccaatgggataatgatatgcttggtggtaccaaggctgtgttcagaacctttgttccaacttctcttctcgtttttcgcgcccacgtttttctaaactgttaataggtgtattttttcaaaaaatttctatacgaaattgcttaaaaaatcatattaatcatttttttaaaaaaaatagtaaatacttaattaatcatgcgctaatggaccgttccgtttttcgtgtgcacagcttgtgctgggaacatagggttctgaacgcagcctaagtactccatccggcaaagattacttgatatttccgacagctaaaatccattaagcgcaagttattttgtttgtccgaaacgtcatatagtattatcgtccagggaatatattgcagctttaccgctgtagaagcaatcctgacactttgaaaagcaacagccgcatcgattttcaggaatttttgcgatggctattcagattcttgatgttttataaaagtctactggtcaaagttaatttagttctttattaattcttcgcataaataacacccttttcaccatattttgactataggagaatatttttggagacaaacatatcaactcggttgactcttttatttgcaagaactttgattattacacttttaaaaatgaactttgatgattacgcagtattacagcggttttagcctgcaatcaactgcaggcccatgaatacagttttagctatactagtgatggaccattatgggccaggccgtatttaacagccgtctcagaaaaggaataagtttatcatgacttcctcactctcgctcctgattgaattgcttccctcaaccgtaaaaccagg

SEQ ID NO: 49473 - DNA, 424 bp, Oryza sativa
atcattgcttcctttgtacagaggttcttacggaagctccagtcgcccaagaacagattaatccaggtctagaaatggtgatgaatgatgcaaatcgctgggaaaatccatgaaaatatccttttgccgtgtgatggatagtggacggcaaaaggatgttggctctatgcacacgctgcaagaagcttctcttgcaatccaagaagggaatatttaggctcagctcacggctcttagtcttactgacccaccaagcaaagcaaacgctaacgtatgaatgataatcaatctttgttctatatcgaaatgcttatagtaacaaagaaatataaccatactttatttcaatgtaaagatcattctttgtatattatggcacactagataataacaaagaagatctggtagtgtacaggccagagca

SEQ ID NO: 49474 - DNA, 1501 bp, Oryza sativa; identical to SEQ ID NO: 45924

SEQ ID NO: 49475 - DNA, 513 bp, Oryza sativa
aacttttccaattaaaataattcgtgaaatgatgtttcatttattaaaaatacttcccttgctcaaacaattcccagaaaattctagaaaatagaggaacaagcaaagtatttaataaaattttatctaacccaattttatattgagatttagcaaattaaaattagatcttctcttttaagcttttaaaatcatttctaataattccttttaaacaacaatttataatttaaggattttaagcaagaaaagcacttaacaattataattagatcattattgatcaaataattactgaactgttctttgtatcatttaggaattgagctccgaaaaaatccgagaaaattccagagagtataattaaccatggagaatttaataaaaaattaaatccatccatgctttatatttaggaaattttatttcccacaattaacttcacttgtaaattaatgaacatttaatataaattctattaataatttattaaatgatttataaatcctaaga

SEQ ID NO: 49476 - DNA, 1197 bp, Oryza sativa
ggtcctaacgtttaaagataaaatacatatgtgcttgtgttactaataatatctaaaagactaagtagtatgtattaaatatgctagagaacataagaaacttaaaaacttgacgtggcaaaatgggcgcttaagcgacacatattgcactttcagctgatcttattcccccttttaaatttcatgtccccattttgattatcacatggaatcaaccacattatacctatgcattcttgtgatttctgaaattaaactcgaaagcaaccaagtaaagaggagggggagaaaaagttagcagaaaacatggatgatacatgtcaataagctgctagcataaccataagtgtagggcacgtttcttaggacaatggtataaagttacaaactgaaatatcattgttaggtcagtttgatataatcagtttggattactatagacacttgtcatagtaaatagagatggatcatttcttaagtagcatcactactcttattcacgaatgtctttgctaccctttctgttatacttttcctctttttctgtagaaagccatttgtccttatattatcattgtcaaattaaggatgcgtaatctacaccctcactcaaaaactttgataagataaaaacaaataaatccatgcctttatagaaccttgtcaaaattatgctacacctgtgctaggaacaccataccatcgtagcttacttgcacgctttctgttaaccctttttcctaataaaaacgtattcgtccgtatcgttgttatcgctttgatcgtgtgggtttcactttatatccgttgaaacctctgttaacacgtccaaattatttatatcggtattatcactcaagatcgtgcgggttgttttgctttttacgtttcttgaagcttctaaagaggggacaaacctatataaataggagaggagagcaccctctcaactcagttcaaaattgaaaaaaaaaagaaaaaaaaagagaagaaaaaaaaacccatgggttgcgtagccgtagctttcccaccatttccttctctccgaagcctcctcctctccgcttcctcccgcgaaaccaaattccaaagcatttgatcgaatttctcccaaacttttccagcgttttcaatttcgccccgatttcggttcgaaaacccctcgcgaattcatttcaaactcgtccgagagcgcaa

SEQ ID NO: 49477 - DNA, 157 bp, Oryza sativa
attaagcaaagtatttaataaaattttatctggccccattttatattggaatttattaattaaaattagatcttctcttctaggcttttaaaataaattctaataattccaattaaacaacaatttatatatttttggatttttaggatgtgacagc

SEQ ID NO: 49478 - DNA, 1166 bp, Oryza sativa
tgtaggataaatcaaatcctcagtaatattttagaacaaaaataataatagtaggatggtatatcatggtttggccccgttggttagattcctaaattaatttattttgaagcggaagaaatagtagctcaataattgcaatggtcgattcataccattcctagctacctatgtatacacgttgattctgatcgattgggcgacgatggattacacatgcagctagtgtgtgtcgtatatacttatagtatactatatgtactatcttcgttttcaatagatgatgttattgactttaatatattgtttgatcactcattttattgaaaaaaaatataaagatattattttttatgacttgttttcgttattaaagaagtacttttgcatgtatgcatcaattttaaaatctgacaagtggtacaccaaatttaaggatatcatctatttaaaaaaggagagggtatatacgtatatgcaacttggggtgggctgaggaagatcaacatcgagaccgaaaagaccgtagttttttctgtttatgtttatgtttagcgtttgaccgtccgctttatttgaaattcttttatgattagtatttttattattattagataataaaacataaataatactttatgtgtgactaattgttttctaaattttttcataaattttttaaataagacgtacggtcaaatgttagacacaaaaacctactacacatgagacggaggtagtgctacgtactttttctttttaaacaacatatacttatatatgaacgtacttgctcagttattggacgtatctggcaggcaggatgcaggtatacatatactatactactagtagtaacaaataattaacacatcgaagttgtctcatcacgtcaaatatatgaagaggggggtcgtcacgccaggcgatgctagagtccacgggagttgaatttgtctgtccgattcctggagctttccagattgaatcgggtgttgtttaacctgcagtctaggccgggtcaatctaggtctctggtgcaatcctttatacaagaacttagggtttggtcttgacctcggtgtagatcgattcgctttggtgtctgctgcgtcgtctgcagtcggggaagtccagcatatagatcaaattggttcttggcaata

SEQ ID NO: 49479 - DNA, 188 bp, Oryza sativa
ggtcagggaggagaagcaaatgatatgatggaggggtgccggaagctgtccaactacatgatgtacctcttggtgaaccacccttccatgctgccgctcaacgtcagctccgaggctacgctggctgaggctgcgcagctgatgaaggtggtgagagggcgagcactggaggagatggtggatccagc

SEQ ID NO: 49480 - DNA, 803 bp, Oryza sativa
ctactccaggcctagccaagggcaatcaacctccggagggcgataccaagcagaagaccgtcatccgcttcaaccagcaatcagaaggaagcttctcctgtgaatgatagcattatgcagtcctatcacatcatcacagaaccaatcgaggatgcagtcactggaacaatgccagctatatctctccagaatcaaaatgagcagccatgtttgtggttttcagtccgctacttatcatggtgtaatcgaaagtttgcagcaatcatgtaatacataaatatattcatgtctataaacagtgagcttgctatgcttatggatgattcatattgagaatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaatagccaacctgtggatggaaaagaaaaacaattaaactgtgttgggttaaaaagctaacgagacagtagttgaggataggagttcggatacgccttttacagatcaagataaggattgttggaggaaaccccgaagggtacccgccatacctctacattgataagatcggatatacctgccaacagataaggagatccaggagacatcaatatttgagaacataatagtcgatggttggtaattagtttatctggtatcaga

SEQ ID NO: 49481 - DNA, 187 bp, Oryza sativa
ttttcactaggctgcaaaatctgctagctgtttcatgctgccactctggctatgtgcgctcctattatattgtgtttgctcccctcctacaattaacatgtcgtccaatacaatatatttttgaagttttgccatattgttttctctttaaaatccctatcagctgagttttcgtcctctaaacagt

SEQ ID NO: 49482 - DNA, 727 bp, Oryza sativa
gacgagggcgttaatattcctgctgttatggtgagcctggtttttacgaaacaatatagtgcataatgacggccatgcttcagtcactagttctgtggtgtttcttcggagttatgctgaatcattgtttctcaaccggcaaccaagagctgacagaaaagggaaggctttgtgtcgccctgaacaggggaaggagtcaggtccaactcgggcctttccatagcaacgtgtttgttggcttatgtctgtgaatggctgggctaaaatcaatgtcgatggagctttcaatcctgaaaatggtaatggggcacttggacttgtaatcaggaattcgaggggcgaagttctgttgtcttcttggaagtttctcaggcgatgtgtgtcagcggaggaagcagagctgcttgcgtgctatgaagggctgaagctagctgctgaatggattcccatgccagttatgcttgaatatgactgtgccacagcgattgcgaggttgttgtccactactgaagagagatcaagatggtcttttctgctgcgagcagcaagatcagttatagggttaattaaggaagtgcgtttgatgcactgtaatagagagtgtaatagggtcgcacatgaacttgctcagattgctatccgttcggggcaaagcgcggtttggcgtaataatgcaccgaattgtgttatgcaatgtctgcagcatgactgtaatcctgttacgtaa

SEQ ID NO: 49483 - DNA, 1501 bp, Oryza sativa
cggtagtcgagatgtcatatggcagagggttggtgccctgctgctaggggctcagttccgcctgcctgtcccgggtatcccggccgtaggtgggattgggtcggtactcttgtctaaggctaggatgggttggaaactatgtcacgtcttccgtccgtataccgtggtggtatgtggcgcgtggttacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacaactaaaatgtggaatggttggcctgggttggcttgggacgagctgggacccaggtcgggttgccagttcggtccgaaccatcgtaggccttgggttaaggcaggttcgtgagggttcacggccttgtttaataatactgtgtagctctaggatcgtctttataaaatggctttgggcaactaagtgacttttaaaggctgttactgcaaaacttaacccctatattattatccccttgtactcctttgcattaattatgcatctccggtgtggcttgctgagtactgtggttgtactcattcttgctctatctttctccccccttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatgtaataaagatgtgtcttctatatcatgtttgtgtggtgtaccccggcctttcctgggacggggattaatacactagcgttcgggaaaaggcaattttcccggtcgcgacaagctggtatcagagccatctcgactgtaggataagccaaatggataaaacctaaggacatattttataaataaaattatttgcgaaagttcctctttttctccttcccctaatgctatttgcaaaaggtttactcttttcttccttcttcaaatttcaattagtactagatggtcagctttgcgaagaagaagatgtcgtcagttgtttgccgaagctccggaagactgcaggatccgcttgagaagtgcaggaagcagtgaagccagctgtgaaggagtgaagatcttgggaacccgtcgcagaacctaagccaccctatagggtagtgttgttagtcgtgtgttccttgcttgtgtgtgtagcgcgtggtttgcatcagtgggttgtgatgtaaccatgctaggttgtttgcttaatcaacctgcagaataagcaaaacaaacaacacatcaacaaaaagagttagttcctgtaaggtcttgtccctagttctggtctattctttccttgtatgctttccctctcaacctctaccttgtgacagatggataatactggtaacaaaggctatgggaa

SEQ ID NO: 49484 - DNA, 208 bp, Oryza sativa
aagatggtcttttctgctgcgagcagcaagatcagttatagggttaattaaggaagtgcgtttgatgcactgtaatagagagtgtaatagggtcgcacatgaacttgctcagattgctatccgttcggggcaaagcgcggtttggcgtaataatgcaccgaattgtgttatgcaatgtctgcagcatgactgtaatcctgttacgtaa

SEQ ID NO: 49485 - DNA, 1501 bp, Oryza sativa
ctgccgagtcgccgagccgccgccggaggtgacgtcaccgctgacgtcatcgtcgtcgtctctcgtgagccgccgtagacccgatcgatctcggccgtccgttttggatggatcgatcttggccgttcgttcccgtgaaccgttgccgtgtgcccggtccaccgcaaaccctagccgctgacgcaataaatcccttttccttttcaaaaataattcattattgcgtcataattcaattaaaatccatataagtgttttaatctgatttaatcttcaaaaattcataactaattcatcttagctcggatttagttggttcaagtctctaaatttttctaaaattgagatctacatgttaaaaatatccacatgtactgttcatgcttgtttatgtgctattttggtgattttgctcctttttgtttagattccgacgtttccggagagtctgttttcgcaggagaagaatttgaagagttccaaggccagcaaggcaagtcacacagatcccaaacaaccctttgagcatgctgaacctgtttaaagctattgatttatttcaacttatgcattgttttctgtcacgcccggaatttctatccaaaattccaaacgctttcatgtgtgtgaaccctcgtccaggaatcagccgaggcacacaataacaaattgataatagagtacaattattactctaattaataagcgtataaaatgtcattacagaggtagatagttcctctcaatcaataaagatctaagcagcggaaaataagataaacggcgcagacgactccactccacaggcagcttgaccaaggctacacctaatccttcacaccatcagcatcattgtagaactcttcctctgatgaatgattgcaaggtgagtatatgacatactcagcaagccacgcatcaaatatgcaagtgcacaggataacaaaggatggcataatagggttccatttgcaaaagcagcatttagcaaacatttgagaatttaataaaacagttaagtaataattaaacaatattaatccaacactatacaacgtaccctgttgtataggcccaaccattctgaacaaccatcccggctgtacagatctatctccaaaccaggaatgtaccattccaaaccaggagctaatcaaattattaccaattatagcatcttctattagggtgagaagtgtgggactaatcacaaaagacattgttagactcgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcacaacacaatccaccgcagcgcaccttcctggatcataatcacccccttataaacaaggcatggactccccagcgacccccgtgggcttatctccgccacttctcagtctggtgccccgcaa

SEQ ID NO: 49486 - DNA, 539 bp, Oryza sativa
tataggtaaatctaccctttgtcgtctttttatgattggaagtttgtagtctcttgtcctattaaagcctgtcggtaactttgtttagatagtctcttgtcctattaaagtctgttggtaactttgtttagatatttgtattggcacgtttcttgttttcaacacgagtttttcctctgttgacaagaaaaaatgagctgtgaatctgttaactgttatattcatattcctgcattccagtcgagtccatgtttgtttttcagatcccttaaatattgcctcatttttatttttgacggttcataaaaccaacaagggaacaaatgaagcaagctagagaacaaagcatgccatcagcacccacaacacaacatgaacaccaacattagaccattggagtgttcagtgcctaacatgtaacagaagcttaacacaacacaactttccctgtcattttgtctgacattgcttggcaacttggcatcaggtaacagttaaatgggcttggtcctttgggacaatctgttctttgatccaca

SEQ ID NO: 49487 - DNA, 1501 bp, Oryza sativa
aattatgtttgaaacttgtcccagcttccagggccctgtaaaagtattacttcactctgaatgatatagttgtacaaattcaatcttagctcctgggaacttccgcactaaccaattttacacatttttttatttcctacctttgccatgtgaatgtaaaaaaggaagtcaccttgacgttctttggagtaatggtaaatcaattataaatgaatttgctgccccttctgtgatgtacccatgtgatgtatatcttcatcagagctcatgcgatataattctttgcttgatttctgctccagtgttgttcatggtcctcttcacattgaccaggtatgctcaatttactttggttgatcatgagttctccttggtcgtagacctatatatttatctcatagagaattttttatggcactaaagatatatagtcatttacagatcattaaaagcagaaaggtgtcactgttagccttttctttttacttaactagcaagatctataaacatgttttatttgtccacattagagttgagaggtgtatacctatcaatttggattatgtggattaggattaccaaaatatgggttttgtctatggtaagttggtaacatttgcacccattttagtttgtgaacttaaagaaatccataagtttacacaataaaatattttcacttgcagaagtaattgtgtaatcacacatatgctgttaatcttccttagaactgaaaattatgggtactttaaatgatacttgtattttagactgttatgggcagctcttgtaactttcattttgaatttgtgttattccaaaaaaaaagctgtttatgtagcataaaccaaacaaattaggtgtaatgtttggatgagaactaaaaggactgcaagatgccaagtagcaagtcccccatacattcctgtccagaattgtcatccataggtttacaatccccaacccacatgccccatcaatggagcaactagaggagatgaagacaaataaagccatcagcatcctgaattcctgatggaatagaagcttaagccttttgttgcatcacaaaaaaggtctatactgtacacgactacacacacacacatgcttacatacatggctgttgcatgttctcaagttcctgtggcttgcagctgaggttaccatggccaagaactagctccctctctcctgcatcgtacaggactcatatgtgatctactgatcttctatttatttgcattgtaaatctaccaagaaacctcacaaatgaagcataggagctacctagtccattcctgtttgttgattctttcgtacataaaaccagtattctcttgcccaacgatacactaagccatacgtgatttgatccaagttttcaaacaacaatgaaggaaatggtttcttcctctacatttagagctcccggtggattaggattcttggggccttcaaaataggtttgattcctttgagaaatagaagtggtgtgaga

SEQ ID NO: 49488 - DNA, 449 bp, Oryza sativa
tactccctccgtttcaaaatatcaggatttctagtatttagtttttaatactcatataagcattccttctctgatttctacaattcccatcatttcaataattccaaagccaattagatgcttggaaagagaatctatgcaattcaaaatttaaaaattgacaactaaaatgacaaaaaaaattgccctaaacttagtattttctaaacaacctataaatccttaatactccaaactccctttgttttaaacgagacaacaacaacttctgagcctagaagtttattctttctaggacggatggtgtattttggaacagagcgagtagtaagcattttgttttgttttgttttctttagctatacctcttgtttgcagccagccatggcagtatctatctccaaatgattggcttgggtttatgagcccaagcttctgtctcctgcagt

SEQ ID NO: 49489 - DNA, 1049 bp, Oryza sativa
ggtgacgtcaacgctgacgtcatcggggtcgtccagccgtgagccggtcgtgaacgttcgatatcgtccgtccgttttggattgaatcgatctcgaccgtcagttcgcgtgaccagtcgccgtgcgcccggtccaccaaaaccgtagcccgctgatgcaataacgttcttttccttttcaaaaataattcattattgcgtcataattcaattttaaccgatttaagtgttttaatccgatttaatcttcaaaattcataactaattcatcttagctccgatttagttggttcaagtctctaaatttttctaaaactgagatctacacattaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattatttctattcaactattgcatttattttcgaatgtcattgggtggaattaacctattctttgttatagcccttttgttcttgattactttattccttgataccttgggttataataatttgactggttgaactttatttatattggttcaactagatattagatataattgcttagccctgcttagaaacattagcacactattgggataactataattcacttttatttcatgatggcttaatgatagttcacgatggtcaatcgtgattggttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataag

SEQ ID NO: 49490 - DNA, 1501 bp, Oryza sativa
tgctaccccaatccatcaattgcctggctgcttattgtttgttatattagaaccatattttggattatttcggttggaagtaccatagtgaaatatttacgtatctcatattaatattcggcattctctttgcagattggtaagcctgcagatgaaattgaaaacaactacttcaacaacattgattgatcttcaaaatgtggcttccagaatacaggagagaatctacaaaatagctattgactttgtatgacggtttgttcttaatagttttttaagcaatataatttccttagatattaattttattttttatgtatcttaatgcacgtaatattgttaaccttaatagtagcaattttgttcatctgttgattattgcaaagtctcaaagctcctgaatgagtacaacttattgccaagaagtctataactacttagagctataacaattgtgtgatacagttaggatgaccatcttacttgagaacatatggttgcaatatgttctatgcaaattttgtcaatctaattaaaaaaaattaattactattccagtattgtagcgcggaagacactaggactgaggttgtatttaattaaagtgttcgtttatacacaattccaaatatttatgttcccctttcgattaacttctttttaatattgtggatagaatcatcactttctgatttattcgcttatacgtgtatcgctagataaattctttcatatattgattatgcacttattcttggcttgccagattgtggacatgccctcttaatttgctatctttgtatgctttctctggtattcataaagttatggttcaatataggatgttatgttttaataaaagttctcatatttttttctttctcgcactacttagagtgattatctatggaggactggtcttataaaaggcgatttggatgattcatatcctgtgctgttgaacaattttcttcatgttcgaaagcaagcttcaaccccttcagttgtcttgctccatgagaagaataagcatggcgaaattatccatgcacaaggaaatgttcaggggacatcatctagtggtatgttcttttttatggtgcctacatgatgtattttctccatagtctacacatgattctaatcttctggaatgctttacgcatgaaaaatatatgccaataaaatttgcaaatccacaacccgattcccctgtttgagttaaagcaattttcatatttgtgtcctttacacattggtaattttggtgcaaaaaccatgaatatttgttattctcatgcaacgcttgattgatgtgtgagcctcaacctccttactgttctaagaaaacactcaaagctacccaagggaaattctttatcatttgtgtaaagtgcatttaagatagcaatatctctgtgaagctagacttcagcacacataaaaattgtaaaattgttgcgagttgtttgtgtggttctcaaagatcatgtacttacac

SEQ ID NO: 49491 - DNA, 205 bp, Oryza sativa
cggtcaattttaacttataaaatatagttttagaatttttttttgcattgtttagctttgggtcagctaaacatatcatcatccctccttctcaagccggcggattgtattgggtctgattggaccacgtggcgtacatcacatcacagataaatgttgaattaaggacgggaaaagttctgaaaacgtctccatggagaataga

SEQ ID NO: 49492 - DNA, 361 bp, Oryza sativa
ctgagggcagcctcctccctttagtctcgatacgccctgacctatatcaccaataataaccggggcagcccgaaccccaagcacggagggggcggctgctgctctaccccgggcccgactccctcgggggaatgccacatgggtactgagggcagcctcctccctttagtctcgatacgccctagcctatattaccgatagtaacccccggcgttaaccctagccgaacccttccatgagtggccaggtttgacgccattcttctgatccagtgacatgtgtgcctagtattttttgagtcatgacacatttccgcgatcgcggcccagcgcgcagtggaaaaccgcatccctggcaatga

SEQ ID NO: 49493 - DNA, 278 bp, Oryza sativa
ctgcatgctcgtgtatggtaattaatattgttatctaaagtagaatagtgggaaaaaagtctcactatgttcctttcaatggttctggcatgatttgttctgttataaagatacattattctttcaatgagcaattggcatttagtttggtcaggtttcttgtaagtcataggcttatcatttcagtactatgatagtttgtatttaaatgatgtattagcactgatttgcaacctgtgtgaccttttatatccacatgctcactttttggttgatat

SEQ ID NO: 49494 - DNA, 1452 bp, Oryza sativa
gaacgacgacgtgaacccggagcaacgatggctaggtccgcgttcccataaaaccactgcattttaggggctgagattagaggggatggaaccggcatcgagactagattaaggaacgcaaaagaagatgaaacggccgctgctctatttcgttggcgaccttcgtcttcttggtggccgacgatggagatgaggaagaaaggagcagccggagctcgttccctcgatttgcccggatcagaagtcgtaatggggaggaggcgatgcagctggcaggaagtgaagacgaggctcgacgttgccacgtcgaggccacgcatcgaacgcacctgagagttgttggcgccgatctttcctctctcacgttctctcttgcctgctggtcggttggaggattgcacagggtgaggacgagccacagccactgataagtgggcccaaatcgatgacaccaaggttagggagaaagggaagggtagaaacaaaggtagacttgattttggacgattttccaggatttatttctcttccccttttttgttaattcatatattaatttgtgttgcagatgtgttcatgtggattttattgcaggtggatgaatgtacctagtttccatttctttggttgcacttaaaaattatggataggttgctcacagaaaattgaggaatatgggctatttggaaactagtttgaatttttaggaggtctaaaaagaggataaaaattctagaaaaattatatttagttatgataaataatctagtatttaaataaattatttaaagtatacacttttatgcattttaattcactttttgggtgaggtatggttttagccaataaaggattataattagtctactatgtgactgttttgactaatttatttgaggcaccaaacttagttattaagttgtaccaaaattacagtaagttgtatgtgttaaatagagactacataaattttcccatgattttaccttgcatattttattttaaataattagcaggatctttctatatatatgtcccactttataaatgcatctaaagatttttatgtaaagtacattaaacttctttcacttgtgatggcattattttgacttccttatcttatcttttaaaattatacctcatgaataacttttgttttgcttagtgaaattatttcccttaattatgttcatgagtcctaatatgcaatgccaaccaaaatccaaatgcactaagaagactcaagtcaaaacatgtcttatgcgagtatgcatgcttgctcttacgtttgcatctatgccctaggttagagatgaaaaaggttttaatttgttctcaaattttaatcatgcaatggtttaggtcggttattacctaagttaaaacgaaaatttttggctgtcaaaattggaaaagttaatttcaaactattttgacgagaaattttta

SEQ ID NO: 49495 - DNA, 531 bp, Oryza sativa
aaagctagtaaattaaggtttgattacttaaaacaaattacttactgtcaggttcctttcagtactactccctccagtcacaaatatgtgacttttggaatgcgtgcaccgtgcagtcaacatgtttaaactttgaccatcaatattgctttgaatattttgaattcaacttttaaaaatgttatgattatatttgtcttaaaaatagtatcaaaatattataccagtaattcctaataaaataattgtcttgatgactgtgtcattgtgcaaaacgtcacttttttgtgactggagggtatttagcagggataaaaatgtcctgttcaacattgagataaccttatcctttgagtacccaattgagatgtttgtttgtatttgcagggatgatcctggtgcgagagctaggagcagtcctattagggctgatgcaagtttaacaaaagtggatggcaacaatggtgctgatactgcagaggctggtatatctagagctgaacctgtgccaaccaatggtaaagatttagc

SEQ ID NO: 49496 - DNA, 1073 bp, Oryza sativa
agccattaggatgaccatcttacttgagaacatatggttgtaagaagttgtacgcaaattttgacaatctaattaaaaatgtttaattacgcttcctttatagtgacgtataagatactaggactgaggttgtatttaattgaagtgttcgttcatacgcaattccaaatatttatgttcccttttagattcagttttttcatatagcagatagaaatcacccctttccaacttattggcttatatatgtgtatttgtagataacttctataatatatagattttatcctcgtgtggcaagtactttgttttggctcattcaccattcaataatatataacttattcttgtcatgccagattgaggacatgctcgcattgctatatttatatgctttctctggcactatttagggtgattacctaaggagtagccttataaaaggtgatttgatgattcatatccggtgttgttgaacaattttatgcatattcgtcaacaagcttcaaccccttcatttgtcttgctccatcagaagaataagcaaggccaaattatctaggcagagggaaatgtttaggggacatcatctagcagttagttcatgaaaatttaaataccaatttgttcctttttcttatggtacctacatgataaattttctctttgttattataatctcttggacttatacaagaaaaatatatgcgaataaaatttgcaaatccacaacctgattcccctgtttgagttaaagcatttttcatgttttcgtcctttacacattggtaattttggtgcaagaccatgaatatttgttattcttatgcaacgcctgattgatgtgtgagcctcacatccatactgtttttttttaaaaaaaaacctcaaagttaccctaggtaaattctttatcatttatgtaaagtgcatttaagatagcaatatctctgtgaagctagacttaagcatgcattaaaattgtaaatttgttgcaagttgtttgtgtggttctccaagatcatgtagctacactaagtaaatcagtatccacttctacactgcaggccaca

SEQ ID NO: 49497 - DNA, 453 bp, Oryza sativa
tggagaaagaagttgcctttaccttagcagatcctccgatcatcatcataagtgatgatgaagaagaagaatccaagcgcacccattccaagattgagtgggtagcaactcaagatgatgaagacgagcagaacgagccttcaatcgacctccgatgctcggaagaactagagtgacttgttaaatcgtggtcttagatcgttgtgttagtttgcttgctttaagtttgcttgtgtgtgggtcgcatgtgatttacatcagtggtgggatgtaattgcatgtgtttgtttgtttttgagtgttaggtgcttttgagtgttaggaagttggtgagtttagtggtgtgggagtcttcagtttgtaataataaaactcagttaagatcaataaaagttaaagtaattctctatcctaagtagtttcccccgatttctcttcttgtgccctgccaga

SEQ ID NO: 49498 - DNA, 1501 bp, Oryza sativa
aatacatgcaagaccacgtagagatgtgtatggcgaggcgacttgattaatcaaatttaatatatgcatcgtgaactaagcctatagcttctttcggaataaaaactactccaatcaatcttctctttttcagattcttggaaggctagaattcataaaacgaaccagaacctaaaagctggtttttctcctccaaacatgcccaaagataatgtgtgtttgtatgtttctatacattatataaagttacaactcattatgtatctaaatctcaacatacaagcatattagttattactacatcgtaaagattaacatacaagcatgtcatatcaacccaccgaacacctaaaaccaaatatgcatgcatagcaataacatctacaattcattacattctaaacctctagcatacaagtatgccaaattatcacttcttacattattttcacaatatttactccaaatcaaatctattgataagtatgccacgtcaatccactaagcacctaaaactcaacatacatgtctaataataacatctacaattcattactcccccgtctacaaaagttacacatattatttttatcactaagaccaagaagaaattaaatcatcttggatgttacaaaatcaatgagtgaatacaaccatgcaaccaatgagtatttaaataacttcttaggttctaatcaaacacttaatttatcttttcatttaagtcttgaatgtatacaaactaaaaatagaaacaatttatttggaaaaacttaaatgtgaaatatgtgtaacttttgtggatggagggagagtacattctaaacctcaagatacaagcatgctaaattatcatttctcatgttattttcacaatatttacccaaatcaaatccatcgataagttttacgacattcaacatatatccatatatctcaccgcaaagtgggggcttcatctagtttaaagagatgaatgtgcacctgtgtatacaaatatatatatatatatatatatatatatatatatatatatatatatatatatatatatatacttgtaattttttaaaataaaaacagattcttataaatattttaagaacataacatgatatggtacattaggaccaaatcttgatttacttctaatcatttagatcacattgttgagaaatttatatttgtaactgtttttctattatgtgtttccttcatccaaaatatcaatagctaggaccgaacaagatatgaatatccatatttacagtaatagtaaattttctatccaattctaagttattactccctctaacccaaaatgatcattatatatgtttatgcatcaagaccaaagataatttaaatcgcatcaattaagataccatgtacgcattcgattaaagcatcatacgaattacaccctagcatgtacatattcttctataatgtgttaattgtatttcgatgaaatccgtgtttatgcgattatatgatgatc

SEQ ID NO: 49499 - DNA, 520 bp, Oryza sativa
gtcttagttacggtcgttgcctatggcgatggcgtgccgctgccttaactccgctgccttatctacttttgcttttggaatgtattccggaccgttcggtcctatgttctaagactatgcctgggggcctatgatgtaataattcgcactagactctcgtgtatgtgcacttggtatttcagctatgaactcgtgagtaccagactacttgatccagggaaatgatactgtttacacgattgattcctgttataaaaacgggggtccacagagctggtatcagagccatacgactgtaggaaagaccaaatggcaccccacccctttctagttggccaagggagaaattcccatttagtaatactttcaaaaaaaaataaaaatgctatgtttacaaaactctatacgattttcatcttactcttaactattttcttcacaaaacaagttttacttttagctgactttggtttttcttaaaaatagatgacagatcaggattcacccactacctgggaga

SEQ ID NO: 49500 - DNA, 1501 bp, Oryza sativa
agattatcggtcccgcgtttttgcgctacggcaaacattagtcccacgttttcatcctaggggattggtatatttaagcaaattcttctcgttcgtgtatataaatgtaaattattaaaaaaagatatattcacgattttttttcgtaaggagaatccaggatattatttcgtatgaatttttactccctccccccttcccctgcttttttttaactccactacatttaggtttgggcaactgcacttgacgcgagggtattttcgaccatggtcatggtataaactgaatattgtagtgcggactgtggtatgaggcaataatgggatacttttatggtattttctgatttggaccctacttgtgctctaaacataattttccccatttagaattgagaaaatatgtccccaagtgtttcacaatcctatctatacctatgaattttgcctcatttcttcctttttttttcatttcaattccctctatatctatactgtttagttgattatgagttggctattagatttttctgaaatggctagctatactgtttgtcgctcgtacttatacaacttatagatcttatgtgctacctacttagaaacataaatctcaatgctaaaaatactatataatcaaataggacaactagtgaaatacagggaattgaagagtatgactataccattcagtgacaatacagtcattttaaaaaataagttaactgttaattcacggccatgtcaactagcgaaatggatatagagggaatcaaaatgaaaattcaaaatgaaaacctagaggcgtgcagaggaggatgagatatagagtatagttctgagcttataatggattgaataagaactcacaattacataagtaattttctcattaaattatgacacgttattttcctcgtttcgttttttcaactcccttatttatgaagttaataataataaataattcacgtaatcatgcgctagttgctcgttccatttttcgtgctctattgttcagctttaatgggccaccaatttaacggggcttttaactatttgctacttttagatttggcaaataactatttcccacctctatctcaataacatatgggtccacatgtgtctatgacatatgggtacagtgacaaaaagttaattgccacatctaaatgtggcaaatggttaaatatctccaatttaacaagatagccaagaggttagcccaacgcggcccagcatggtgtcggccatcttcttcttcttcttcccagccgccatggctcctcctcctccttcctcctccgttgctcttcgacgattcaacccagccgccatggagagcggagggaggtagctgactagctggggctggggatttccggcgaacggaggtgaggttggtgccgctccggccgctacttccgcgacccaaagaatcggcaagtccatagataccggacctccgcgaatgccccgcggccatagacgccgcc

SEQ ID NO: 49501 - DNA, 894 bp, Oryza sativa
aggtccgtaaggagaacgcttgggcttttgacaactagggtatcaaagattgatataatttaggcatttgtcattaactatcgtcgtgtgttagttactagtacttatttagcactgataggatttagctgtttaggtggttgatatatacttaagtaatttactgcattgcctcctaatttatttacttattatttaactctcggtttagtctaagcttatacttgcttgctcttcggtggtttcgattgagccatcaaattaaaggaaaagttcagtgtagcacaggcaggaaacaaaatcatggttcggaatctcagggtcgtcttataccgcagcttacacaactttctttggtttatactttattattccacctccatccacagtaacagatgtgtcttctgttagagtcgacttttatacacgaatctaaaattatcgatggtaccctacctagatatcactattataattcaccttctcatctaatgcaagtcattgtgaggctacccgtgctctgactttctcatctctacgagctagtgtgaagctatcagtgctcttgggaaaggaggatagggatctttgattatcgagtgaatagcttgggttttcaattgtgctcctcgtgacgcttttcgatccattttttttataaaaaaatatttgcaaaaaaccacccaaaatatcgccatgtatttaagattcctccctataaaacaattattgcaaatactcctcggctcctcttaattcaccttggactgagattggttgctcctcctcctattattgttgcttgcctattctcgtggccataaagccgacacacgttcatatgaatatatactaatatacgatgagccgtgattgtcattcatgtcgaccagg

SEQ ID NO: 49502 - DNA, 1501 bp, Oryza sativa
ataaacttgattaagcataaaaaattgactattacttatgatatgaaacgaagaaaatattatataaaacaaaagggtttttaagctccgaaatgtactccttccatcccaaaatattttagaacgacggaagtatatttttggaatcataagagaagaaaaaacatacgaacaaattgttcaatccaattgatcacgtgaatttgtaacaaatgttgttggtggcactaaaacaaaatcatagttacttttggaccaaggaagagaaaacacgaggctagagttcttcttgttttcaaaataaaaaccgctcctcaccgatttatcaaaaatcaatgaaaactagcaaaaaccaacgattttcagtcaatattgtacgaaaaccaactaaaacgctcattaccacaaataatgatcagcggttttacgagaacccatcgtttttaaccctaggctaaccgatcccatgttagtttctcaccgaaattctcatgaaataggtattccataggaacttgttagttttccaccaaagttcttgtgaaatgggccattcctctagaatatcatagaattttgtggaagccaatctgcaacagagtcggattattttttataggattgcactcctatatttcatcaccttttcctttgttacaaaggagcccttacctattacaataattaaatactgcatttgcaaaactttttcagatacaataatggctggattaacagggaaaaattgctccatgttgattgtcagactaaaaaaaatcatttttatgggtaaaactaaaaaatatcatagtaattgtgtggagaggagcaacggaacaccgggtattgctagtgggtgggtgatcaccttcctctcctcctagcgatcacccgtccctccccctgtacgctcttcctctccctctttcctcctccccttcttctcttcctactacagtacaccataatattttttttaagaaaaaacaaagttggaaaatttatgcacagaaatactatatataaaaaatttgaattcaaattcaaatttgaaacgggtatgtaaacttttgacttataaactttgggtctataaactttaaactttagatgtataaactttagatgcatagaaatactatatataaaatatatttgaattcaaattcaaatttgaatcaaatataattcaaattcaaatttaaatcgggtatgtaaacttttaacttataaaatttgggtctataaactttaggtatatatactttagatgtatagaaatactatatataaaaaatatttgaattcaaattcaaatatgaatcggatataatttaaattcaaatttgaatcgggtatgtaaacttttagatgtgtaaacttgaggtgtataaactttaggtgcataaatttactaaaataggaaagtaatgcggtgccaaaaaaggaaaccacgtggaggagaggggggcgcgctaggggcgatcgatcgcccgttagc

SEQ ID NO: 49503 - DNA, 216 bp, Oryza sativa
ctctctctcctctatatctcacgcggtctgcacggtcacactcactctcggtctcactccctggagctggagcgtattaaaacccttctccgtccattcgatcctgccacttcctttctctcgccacgatctcctccatctctctctctcttcctcctcgccggccgagtcagctatctcgccgccgcctgagtacgtacgtccgtctcggtatgg

SEQ ID NO: 49504 - DNA, 1501 bp, Oryza sativa
aggaatcaagctctcgaggtggaaagtgagagggtgacatagagggtttatacaggttcgggccgctatcaatcgtaacaccctactcctgtctgtgtgtgatgatcttcgtggggttacaaagacttcagatcctgggagtacaagctagggcttagccagcctcttccctaaacctgggtttctaagagacgtccccttttctcgtagggcatggtcctccttttatagatgaaggggataccacatgcatcgcccctgctctcttctcacgggagtggggcccacaatgcctatattaaaatgcatcttgtgccttgggccggaagcaatccatgcggctaaccttgggtggcccccaccggaactttacggctgacacggggggcaccccccatcattcgctattaaatgtttggtgacttcatgggcacacgttcatcggagatgacgacctgcaggacctcccactgcgcatgatgggacagggcatacctgctcccacgccgcctgacacgaatcgggacgtgggtgcgctgtcgcccgtcccatccatccatcaccgggtcacagaccggtcaaaaggcggtcgctaggcgcacgtccatcggtgaacggcgcatgccctgccacgtcgcattaaatgcgaccggggcggttggcgcgccgctcataaatgcgcctggtggacagcgctcacgcctgctcgaggctcctgcgtggtcaccacgtggcggccgagcgagggcctcaggggcggttcaacccctcgggcccgaggggtacgacgaggtaccccgagcccgggggaggggaggggggacaggcagccgcttcccaatcgaaggcgtgaccccctgagggggaccgggcccgctgtgcgcgccacacaggaagggctttccttccccttagaccaggtaccccctggcccatatcaccgacaatatttgtgaatgatatggtatgtgatgtcatttcctcctacatgcaagtgaatcatccaaaaatcgttgactcattgtacccatctgccgataaatatattatcaaatcatctccttactcccacacgtcctccttcgttgtataagcccacgagactcactagtgctgcaatactcatggcatcgtatgaatcgattgacgatgaagtggatccaccaccacaacaagtgaccaagagtgagttctatgaaccaatcaattaggagagagctgttagagttccctttcagtatatacgcgacggatgtgatcgtgacgatgagggagctccatcagccagtcaattcctagggagaaatgaagaactatgaagataacatcgtcaagagatgcaaactgcctaagccatgattaggtctactatgttttgaccttagaataaagttttattaagttagcctttcaacgttgtttgcaaaatacgcaaaccaaatcaagaatgcttgttgtgtatgctttgacttggtacaggtgctgaactatgatgtgatca

SEQ ID NO: 49505 - DNA, 1501 bp, Oryza sativa
aatcatttctgcgcaaagcgataaggtaattaacaacaccattgcagcctcgcagcgtcattaaacgacagcaatgcacagaggaatgttgccgcttaataatgcagagagcaggacagcgcaactaatctctgaaaaattagtggctaggagccttggatcatagcaaaaaagtgctaacaactgcactataaaatgcgtgcctcgcgagtcacaaaattggctgttgtcagagaatatgaaattgcagaagattcttgcaattttcctgttaagtgcatttctgcatgatgtctgcatgacctacatgataggagcacaaagcttttacatctttggtaaggctttcacttacatggattaaaagaatgttaggtgctagcgaaatactagtggagtaattcacagcttctctgatgtaattttgtcggagctaaaaccctgcaagctatgataatcaaactagactactgatgttggatagaactgcatattgtcaacaactccaccgtccagatatcagccatgcatgcagtcaacgaccgccctcactacaaaaatttctcttctgttaccatcaccaacatgtataaatgattaaatgtactccgaacaaatgaaatctttcacctttgctcaactgcacttccattgggggaggaaatgtaggaagaataattttcaatggttacaggataaaagaaaccaatgtatcaagtcctaatcatcgtctgtccttgcctaatgacgtctttgccaccgatttagcactatcattttgctgtacctgacgcgaacttcgtatatctaatattatatttcatcgacttcaaaatttagagttcccatttgctcctctaccgatcggtgatccgaactatctagaaatgtagaaagtgcagtttgaagacatccagtataacctcactgtatctagcgaagatattctgagttgagaatgcttctacctgaccaactgttgaaaaatgcgagctttcaacaagagggcaataattatcagccaaatcacacagcagactttccctagttactcgtatttgtcatgcatatggaagtattccctccgtttttaaatatttgatgccgttgactttttaaaatatatttgaccatttcctatcatttaattcattgttatatatatatatatatagacacacacatacatatatatatacatatacatatatatatatatatatatacatatatatatatacacatatacatatatatatatatacatatatatatatatacatgtatatacatatatattacatattccacaaaagttcttgaataagacgaacgatcaaatatgtgctaaaaagtcaatggtgtcaaatatttagaaacggagggagttgaactagtttcaacagtcagacgaaaaacaaattgtgaaccattttcctgcacaagctaccttttcctttgaattgagaggaagagttttacgcaacttgtcaacagtggc

SEQ ID NO: 49506 - DNA, 258 bp, Oryza sativa
acaactccttaccagccttttctatattagtttcttcgaattgcatctagttaggagtaagatgagcaatttgtacctggaaaccaaggtgatacttgagtgaaatctatagtctttgtatgaacattgttacttgagatcgaatgagtaatttatgttaatgaccatcttatgccatcagctacaaaagttcactatttctgaagcgagttctacccttcctctcgcgtcgccctcccccagaggtggcacgggagg

SEQ ID NO: 49507 - DNA, 1501 bp, Oryza sativa
caatgcactatccccggatcatagtcaccctttttaaaggtatagactccccagcaaccctgtggactctctgccacttctcagtctggcactccacaatgaaccatattgctatacaacgcatccagacgttgctcacgttggcttatgtctgagcctttacgagtaggatcaacagtagttgaatgacatcaaccctctcgagaacatacctgggcgactgaggctcttcttaatggaagaaaggacatcaagtgttaggatggatgtaattcttgaatttctagctctctacgtgaggaacggagctgtacttctgatggaaccctacctttagagagggcactttgttcctatcttgactctatccgagcaatggatgatttctctattctcctggatgatttctctattctccaggcagcttatcaggatctgtgggatcatgaggaatgataagttttcttccgtgatgtggtttcccacaaccgtgatttcctggaagctcaaagcatgaaaggaatgtggattgaggtggaatggaaattgctatattcaaagatagaacgagcccaagcaaggctcgaaagaaccgaattccaacccactcttttgttcttccaattagaagatcgaaagagggagagggaggaataatatgcttcagaaccattatcattatcacaacagtagtttgcgaactggtcgttaattgtcatcagcatggccaccaaaacactatgctcacaactcaccattatcaggttttagctggcgattatttaattaaccaatcatgatttaccatcacgagctaccattaaatagccatcattaagtaattgtgaagcattcattatcccaatagtgtgctaatgtttctaagcatggataaacaattacatctaatatatagctgaaccaatatataaggtccaacctagtcaaattataacccataagataataaaatcatcttcggccataatatgagaaaaaaggctcaccacccaatgacattcgaaaataaatacatatttgattgaaatagagaattttaaacatgtgttcagcattctcaaagggtattttggatctgtgtgacttgccttacaaataagcatcttcgtcttcaggaacttctccagtgaacgaacgatccttcataaacagaacgagagaaaacactaatagaaaccaaataaacagtacaactgaagttcataaatgagtagagatatatgaattatgaaacttgaacaagctcattccgagttcatatgaattgaaacttgaacgagctcattccgagttcatatgaattaattatgaattactaaagttttaataataaaaccctataaaaacgaactaaatgatttactgcatcatatttaattatgtttgtacgcaaaagtagaggaatatgacgtcagcactaggagagaagagagataaggttgatgacaggtgggacctactagtcatggagccgctacca

SEQ ID NO: 49508 - DNA, 240 bp, Oryza sativa
atcggccgcccacgtggcctttgccggtcggaattgcacgaatcgcgacgcgagatcggacgggtgtggctggctcgggagatgtggaacggggcttgttgacttgtccggcccggattgacgccgggagcgaatcgacgacgactgagctgctggatttttttttcgccccactaatccggccctgataccgtgtagcacgacggccaccggggaggtcgccgccgatgagccccacca

SEQ ID NO: 49509 - DNA, 1043 bp, Oryza sativa
agcaaatctcgctaataatatcctttatcacctagcatcaaaagaaatccaatatcatagctgcaaggtgcaataagattggtggtttaagtatgaaattattaaaatataatagtaaagaatattgagcatctttagtaccaaatatctaatagtgctacatctctcacgcccataatctaagccagactgcagtccttttggccccacattagctatgaccccagcaaaatctgcaaaaattaaaagcataagcaatgtaataataaattatttttgaccatcagcacgtccatatctatgattgtcccatatggcaatgtcatgaggcaactatatgtttgaatttgtcccgagattccctgattatggaagaacaaaattagcgcttagaaagaacaaattggaagatacactttttgtcaaaccatttgcacatgctaaattaaaattgtatcataaaaataatctagtccacatgaaagatttctttattggcatgcataagactcaagaaaacaaagacggctttattggtacttgaggaggtcatatatctcactattatttaataaatttaaaggatggtgttatcttggtataacttatatattccaacatgcacttctattcttccatgtcactctcaacacgatggttggtatcatacatatagtccaaatggattctgacaattctatgttgtttcatgtattcatggttctcactctttgtgtttggatttgaaggaagttgtacatcatctagggttaattggatacatgccactgcaaatatggcaaattagaaaaatgtcactactattcatgaaatcaggtagatgccactataatctactaaaattagaaccatgccactccatcacgatttccgtcctatccatcacattttccgccgtctccgtcttcatcttctcgttgtcctcgtctcgacggcggatgggccgatcaggacggctgtgcgctggtgctgagccaaagcaaccgcacgacggcggtgagatagccggccaatagacagca

SEQ ID NO: 49510 - DNA, 337 bp, Oryza sativa
tcaccataattttccttagcagaaataatgaacatgtctttcgaattatctcccatctaactcagaatttttttgaggattaatattatttttatgaaaaatcgcaaaagtagtggccaaccggggaaaatcgcgaaagtaggtccctgtcgaacgggtgcaattcgatagggcacctatcgaacgacgggcagtcgacagagccctgtcgagcggctggcgttcgacacgcttgcctgtcgaacggagggagttcgacagggcccaccaccccgcgccgccaggcctgtcgaaccgggggcgttcgacaggtccctccaccgaccctgtcaaacaa

SEQ ID NO: 49511 - DNA, 398 bp, Oryza sativa
tttgtgaacgatatggtatgtgatgtctggaaatatattttctatgtttatacattatcaaatattaataatgtttataaattttaatattaaattccagtattgatataatgagataaatttgcggcgggggtgagaatgagtgacagctcattcaattctgttgcatagtggcatgcgcaaaagtactgtatttctattggagcgtgtctatttacatatgagtcccacctagttttgtcatgattttctcctccaacatgcaaatgaatcataaaaaaatcattgattccttgtacccatctgtcgataaatatatcctcaaatcatctccttccacacaatcctccctctccttacctctcccctaacacacgatcctccttctttgtataagc

SEQ ID NO: 49512 - DNA, 748 bp, Oryza sativa
gtgcggcacagtgtttgggtacttgtagatggtggccggcgggcggagtaggtgatgaccgggctcccgagctggtgcggtgcgcgagagcggctgcggtttgacacgagcacgtgcttttccttttggtgttggctataacaagggttaattggatccatgccaacttttttttcccacctctcgcaggcgcagccaaaaccaccgcaaatagttaaatgcccccaaattctcccacctcctcggcttgctacctcaaatcgcaatccggggattaggctgggggttggtgcctttccccttcgcctcgccggaggagggattggtacggtggtttgggcgcattgggaggggtggttagggttcgtatcatggagggcactgatgatcctgacccggagcggcagcgctccagctctgttgcaccggcgccgcctcgccggctgcggtggcagccaccaatcggtccgtgcctcccccgcgctccgacgaaaagaaggtacaccctcgttcggaatttagtagttccttctcgcttgatttctgggtgaaacaagtaggatgaagtgcatatatgtgttgatgcgttcaaatgttcaagtttgtgacttcaattttgtttggattttgcatctggtattctggttagcttgagtcaattgccttgtgatagttcgtgaatccattggagcttcttagcatcagttattctactcatcacttcatagtttgaagggagagcttgccc

SEQ ID NO: 49513 - DNA, 1501 bp, Oryza sativa
aagtaagagcacgagctcgaataaggcggaacacagtgaacgcctctagctgcgatgcatggattgcatgacttcatcaggggtcaaagcaggaatgatgctaccgcgacagttcaaagtgcgggcaaggcttttcgtgacacgacccttctctggccgactggccgtcgaaacccaaccacgacacgcaccacgggagaaacaacagaggaagcttacaaacaaaagtgccatcttatcttggcgaggcgtggcagtagagcgtatcagggctccttcagtccagcaatcaatgtagggcatcatggacataaactcgataacaccaagcgtaccagtactagaaaaaggaaacagggagaaaggttttgatgccctcagcaacctctaccaacctgtctccacaaaggcacaagaaagccatcaatgagctctcgtcaggaaatggaccttaattgtaacaaagtcagaaattacagaacagggtccacccggaacaacgaatcatcgctaattctgctggcaagtgatcagccataaccataatacgctgatttaagcccgtgacatgagttatacaaatgcatccaagcttatcaaccaagttgcccgtgccagacaaatcaaattctgttgctaaagaaattcatttgatgtgatttggctagcagccaaaaaaaactggaaccgtgtacccggtaaaatctagactccagacagaaccagtacctttccatcatctcaaccattaggagcaatagaactataggagtataccatgcatgacatgttttggactcactatgcatcactctttcataggatcttcaagcaattgaatgtgtataaggaagctaagactgctagtggttccgagatgaaggaacacttcacaaagatgcagctagccacattggcatcccacatgccaacgacagccggcctgcaaatctacaaagcccaacaagttgggccatacaatgggtctttctcctctacaaaacccaacagcatgccaaaataggaataagtccacttcgaatcactttacaagcaactgcatctgcagcatctcagataggagtaggctgcatcactagcccaaaagcttgatccacaggaagggcaccccttcttgctgtttctgaatgacttctgcacacattcagcaccgaaaataaggtagtaacacttttcgatcacaacctaaagggtatgtttttagattcaatatgatgaccaagtttataagaaatggagcaagattattcacatttttctgtcggttgtggccgacaccacatttcactattccttcatctcctggaaggtgtcacagggtggagatgacatctcacagaattatctttccttatataattctataagcagaccagaaatttattccaatcaatctttctttgatcttggcttgtttgatccattgaccacctcaatattttagcctcatcctgtaagtccaccatcttcctcctcaagc

SEQ ID NO: 49514 - DNA, 1501 bp, Oryza sativa
cattaaatgcacttttattcttgctaaagggtattagtgaaatgtgtcaactgccaaagggcatattaatacccttgacaatactttgccatactgatattctagtgttctctgcacgcaataaacagtaagtctcctgctcatgcactgtttgcccttaattccagcagtatggtaaagttgcattaacgcgacactctctagagggcatctcgagccttttcgagttagaggtaggatcatacgcggactacctcgaaccagcgttttagagatggcccacaaggcctgcttctctccagagaaatgcacgagaacaccggttccgcgttgtatacttgaattttgctctcctttaaacaaatgaagtatctagcttcatagggctcatcttgatgtttcttttgtgccttttgtgtacttaagtcgcattacttcctttcaatatgctgttgaacttgtagatttcacactattcttttttgttgacggcttggttttgctatacttcaatgcagaaatcaaaaacttttggaatagctagaagtccataagttggagtactgttcccttgggagtaaattaatgatctaaaacagcagcagagtgctaataatgagacccttggtctggttaacaagccttgggagaaggctagctatacttctatgtttcctttactccaaaaaaccacaagtcttcaaacatttaccaagtgtttcatttgaacagcttgtgatagagttgtactatgttgtttctgttcacagaagcagtagtccttgctcagaattctgccagcggtaatcaacgtagaatatgaaggaataaggcaataagcctcccaaaaagcatattcctaagcatgtgactactacagctggtttttttatgatgctaccaagtttctggcgaattcccagtcatattatagtgtatctaggttcctcagtcagcctgagtaaaagttagcctgggcaaagaactggcaaaaaaaaaaaaactggttattggcacttgcagtttgtgaaacacactttctgttgaatgaacgaaaaccttgaaagcgcttgccccttttgttgcacttgaatctgcctatcacccaaatttatcttgttcgtttagcaaaaaataatatctacacagtagttcttcacattgttagcgtgataatatgtgctgaatttttagaaaatctaaagttagtaatgcacaatatacatgttgggttgcttagtaaaatatatacgagcaatcatcacctgtgtaagttctaaagagggacacacggtcatgtaagtcctgaagaggtcatgttagcttgatttataaattgtttggatcaaagaagaatatttcttaatgagttgtgttgcaatcttattgtttttaaatgttactgcagatctttatggaaggtgtcatagtgaaacaggttgaagatggtttgcatttagtggtatacaccttgcacaggagttgcagcaggcaaacagca

SEQ ID NO: 49515 - DNA, 502 bp, Oryza sativa
tttttagttcttaaatataaggtttttttgaaaagagcagtactaactcagttaaatttggaactaagattgagttaatgtttggttgtaaaagagactattgcatacaaatcgacaacaaaaagatttcgaaaatattgcagccaccagcaatgttaatttataaagaaaatgatatgtatatgctatacataccacatttttccacattttccccttgtgtggtaagcatgtttgccacgcttttatgctccaaatttgttttctggcacacttctgacatgttttgctagaaaatgtgtgtcgtatgatttagctaaaacattttatggctccaaatttgtttaccacacttttggtatgtttagctagaaaatatgttcatgacatatgggtctaagagtaaaccttccttttgttttatttcatctcccttcccccttttattttttggaacacatctaaactcttggtgaccatacactgctcactccaacctagc

SEQ ID NO: 49516 - DNA, 1501 bp, Oryza sativa
caatttttctatataatttttttaaaaaaaacgtaccatttagtagtttaaaaagcgtgcgtgcggaaaaggagtaacaatcttccctatctcccctgaaagaacaatctcccgttagtagtactgcatggcatttggcacgggatgcaacgacattttgatcgagctgccattctttcggatgggctctcttaatttgttcctcttttaccttttggttcgttcgtacgtgaagccgcgatcgatcgattgatccataggagtctggaccattaattcctttactgcctttgctgattaggatgatgtctgcacatacatcgcccttcttctaacaaaacaaagaaaaattcctcacccggcgcgtcttcatcttcttttctgtgcctaaccaagtagacatcggatccccatcgatcatccagcataatgagagagagatggactatatgcgtagttgtgtagattttcttgccgtgctcttattaccacccggccgtataatgcagcaagtaaagtagaagtatacacagtattgcagttaaaggagtggacgcggtgctgagctttcataccactcgagtacgtgctcaactattgaagtttcagtactcctcgcttcattccctccctctatctcatctgctcatttgctaggtgctctcttttgtgggccatttttgagccctaaccatcgtccgcacaatcacaaggaatctaatctttgaatgcctttgatcctcgtcattatgcatcatcctttattcaccttgtctctacgtgtagtatagtgtcgctcccatcagaaactagcagctgcctctcagtagactttaatactggtgcagtggtgggttgggtaacgcattcttttcttacagtactagtacctcatgcacacaaacgtgcaaaggattagtattaccctctatcatatggcgtgcgtgcgtgcttgctagctagtcatgtcagtctggtttagagatagaggcaggaggcgcctatggtgcaaaagaaaaggaggaaagttaagctgtgcgtggcgtgcatttgctcgtacgtgtatgtgcaccatcgatagggcgcttgcagcctttgcttattaggcggcttgtccgttggcaaatgctgtagtgcaccaattatccgttctttatttacatgctggtcgatatgcatgctatacgatccaatgagtataaggaatggacacgggttactcattagtgagtacttgttgacccaatattgcagctgaaattaaatcaactataccacacatttactccctccgtcttgaaataggttcatttttaactattttcatttgttccaaaataaattcaattttagagaaatcattgcactacaatttgtgaaaataaaaaaataattgtttcgagagtagataaaagtaggaagtagttgcattgagatttaataaaataaggtattctaatcttttaattttgtattggtatatttaagatggtgaaaaata

SEQ ID NO: 49517 - DNA, 1501 bp, Oryza sativa
catgggggcaaagttgtaatctcacatgtacgattgtggggtatataagccgatcaaaagcatgtagcaagacaagacataatttaatactactagagaaacattagccatcaaagttctgtattttgtatttgagctcatttctttggataggcgagaaaagaaactttcctgtttatctccaaacttattcgtgacctaatgtcacgacataatataaataagttttttttaaaagaacgaaaacataaaaaaaatgtaatgttgcgcagctacttattgaaggtcacctactccgtctcatcataaaatggtgcgatacgatctgccacacattatatgacgagcacttttggccattccttggtctctcacccctcggctgcagctagcaaacggaggtacggctggtctgtctacccataccctactaggctggctgctgaaggatttaatcgtgatctcgtgaaaagaatgaaagaaatgaaagtgattctattcagactcagctcagcacctcaagccaccggctatgcttctcggaggcctaggagagatgtccagttgtacaccacgcatatgtttggccccggtgcaacgggtgcaaataacacctctagtctctagaaaaaattattgttctaaaaagagggtctctacaaaaaagacgtttgggcagacctttgttacttgtagcccatatatgagtcgtaccattgttcgccggccccatgaggcccacatggtaggtggagctacgtagaacaagcatcgtgttttcttgtagaagtactacacaacactagaaattctacaaaaccaggtgaagaaaaaatattctacaaaccagactaattgtgtaagtagataattcaacgcaattcaaattgttggagtttcaatttcgagatactgtaagctattttggcacttttacagttatctttcaaattgaccaacactcttcagtaccttctaccactaatggtagtagggtgcatgagtagaatttaaatcaaaccatagatttcttatgggcatttaaaatattttatccaaagctttgttaaggtagctttatcaatttatttattttaacacgatatatgaaacgcattggtaggttttttttaagtaaattgcatattgcactggatagagtgaaccttggtttgctttgcaccggatttaatacatatttttacattgaaataaattgtacctcacactaggtgttgtatcatataattgaagggaaaatattgtaaaatatgtgtaaaactttcaaaacccttttgaatttagacaatatttgaaagggatttattaaaataatgaaatatcatgaaagccctttcatatatatatatatatatatatatatatatatatatatatcttcattattgttcattgaattaaagatttggttttgttttctcattgaatttgaagatttcgttcagatttcggatttaataagttgaagatctttctgact

SEQ ID NO: 49518 - DNA, 1501 bp, Oryza sativa
tctagtaccgtggagtgcgagattagcgggagctcaatccctaagcaagtgatgcttagcttgctaagctagatagccatccgagcatgcaggaactgcacgctcattaagcaagaaagagctagtagttggagcagcaagagaggcatgcatgcaggagcgcatgtattgcatgagtgtgatgtgcaaccgtgcgtggattttttttttcttttgaagaaatgcaacccctagctttgacggatgtatccgcaccgcacatgcacacactcgtttctatactacttaaaacattagaaatggtggtatatatccgttatgccaagtgcaaccccctctctcaactgatatcccggacccacaatatcgaatgctcccaaagtccggaacgacccacaggggtggatctgcggtactaaggccagtgtcaggcgacaccgtcgacttttggtacaacctataacaaaactgcttatctatatgttataacaccatgatctaagtataattagcatactacgacaccgatagacatgttatgacaccaacgaatcgattttctggattcgccactgtcgacccatccggcctgtcttcgtctctcgccttctcactgcagcagtgcagcctctccgtctcgccgcttcctcatcccgtgcgacaatacctttggccgttgctgccgcccggcaacaccccacgaatcgttgccctcgcaccgccgctacctctccatctttgatgacgccccaagcagccacatccgccgatgagatggcaacttccctagtgaatcgcgaccacccatagcacaacctctctccgccactgcttaagtggggctggttgagagttgggagcgactgtggcttgtaggcggtgccaaactgtccgtgtctacatacaatgatgcccttgcagcgtggaagcctgacgcgattgaggcagagcagtgcataagcccatcttggatgcggtggcgtagcgtggaagacaggcaccgtcactgaagttgggcttgttcggagttgggagcgatattggcttggaggcggtgtcaaggtgcgtgaaagctagctcacgcacgtgcgatttttgggcacgatttctgaaggagttacatgactagccgagttagtttaggataataacagtaactaaaaaaatatttttcctttttggaagattttttttactagaagattgaaaataaatctttacgcgaaagaaattttcaacttaaaatttaaaatttgaaactctaagctttaactttttaaaaattttcaacagttaaatttaaaaactttcaagtcaagatttataattttaaaaattttaagacaaattttaaaaacttttaactcgagatttaaaaacttttaagtcaagatttaagtactttaaactctagatttaaaattttctttagattgaaaaatttgcaagttaagatttgaaaactttcaactcaaatagattaaaaaaatcggaaaaagaa

SEQ ID NO: 49519 - DNA, 1501 bp, Oryza sativa
taggtgggtgaaaagataatctttccctttatttgttttatgcatgatccgcaaattttatattttcttttgaggatcgttttttatacttgtttattatgcattgatgattgaatatctctcaagaacctaaatgcaattttagtaatggagtgaaatgcaaaatcctttaaatgtagtatgttgcatttgtcttggtggaaaccggtccaaatttcaatattttccggcttgttgaaaacacaaaccgcttggttttcggtctagttcaaaaattttcaaactgaattttaagttttgacatgatttatcttgatttcattttctttttgttatcaactgtttttacaaaatccaaagataccactcgtgagaggttttgatccaatatcaaaattgcgaatcccaactcccggagtggaatgaaatcatgcatcaataattccatcaaggtgctaaaggtgtgcattgtgctttcctataaatcattttttttgaacgaattataaatcattttttcaatcgatcactaatgtaccggaagtgttctcacctagacgctcaaaggcaactcgtcaccaagaaagccatcagagttaaacatgtagtcattccaagagagacggagtataacaaatatagtacctcatctgtctcaaaaaagaaattttacatggatgtgatagtatttgctagtactaggaagtgttatatcccttcaaaatctcttatactccctccgtttctaaatatttgataccgttgactttttagcacatgtttgaccattcatcttataagaaaaaacttttgtgaaatatgaaaaactatatgtatacataaaagtatttaataataaatcaaatgataggaaaagaattaataattacttaaattttttaaataagacgaacggtcaaacatatttaaaataatcaacggcgtcgaatatttagaaagtagtatttagcaatagcttagtgcattggctttaatgaacagattcgatgaaaaacaattcacaaacaagtgcgttttccagatgtcccatattgatgacaaacccgcacacccatgaattgagtcccaagagttcatcgcagacttgcaatgaaacctgccactaacatcgaggcagttcaatcgcaaaaaaacaacgcggctgcagaggtcctcaaaacccgtggtgattctcacccagtcgctctcacccattcgcattctccccgcactattccccgccttgtttccctctttccacgtcgcgagaggcctctgcgccccatccgctcatcataaaaacccaccactcccactgctttccctcccacctcaccacacaccacgccactcgcctcgcctcgcacagtcgctcgctcgcccgctctagctagctcacagctcgctcactcgctctcctcttccaaccaactccaccaccaccaccagtccaccacagcgcgcggcgccatggacgactcgtcgttcggttccgagccga

SEQ ID NO: 49520 - DNA, 1501 bp, Oryza sativa
  unsure (1)..(1501): unsure at all n locations
aatcctccacaccatcagcatcaccgtagaactcttcctttgatgaatgattgcaaggtgagtatatgacatactcagcaagccatgcagcaaatatgcaagtgcacaaggataccaaagaatggcataatataggactcattngcaaaagcagcatttagcaaacatttgagaattataaaacagtagagtaattaatcatcaattttaatcaacactaaacagcacacccatgctgctcaggcccaaccatcctgaacaaccataccgggctgtacagatctatctccaaaccaggaatataccattccaaaccaggagctaaacaaattattaccagttatagcatcttttattacggtgagaagtgtgaaactaatcacgaaagacattgttagacccgcccataaccgcgggcacggctattcgaatagttttactctggccagacgtgtaccactgtacccacagcgacccccgtgggcttatctccgccacttctcagtctggtgctccgcaatgaaccatactatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaaattttagttggcaagtaattaattaaccaatcacgattggccatcgtgagctatcattaagccatcattaaataatagtgagtcataagttatcccaatagtgtgctaatgtttctatgcatggctaagcaatcatatctaatatctagcttaaccaatatatatagcacaactagtcaagttataataacctaaggtatcaaggaataaagtaatcaagaacaaaagggctataacaaacaataggttaattccacccaatgacattcgaaaataaatacaatagttgaatggaaacaatagctttaaacgggatcaatatgctcaaagggttgtttggaatgtgtgtgacttgccttgctggccttggaactcttcaaattcttcttctgcgaaaacgaactctccggaaacgtcggaatctaaacagaaaggagcaaaacaccaaaacagcacataaacaagcatgaacagtacatgtggatatttttaacatgtagatttcaattttagaaaaatttagagacttgaaccaactaaatccgagctaagatgaattagttatgtatttttaaaaattaaatcggattaaaacacttatatgggtattaattcaattatgacgcaataatgaattatttttgaaaaggaaaagggcattattgcgtcagcggctagggttcgcggtaaaccgggtgcacggcgacggctcacgaaaacaaacggcggagatcgatcctatccaaaacggacgcccaagatcgatggacgacgacgataacgtcaccggtgacgtcaccaccggcggcggctcacggatggacgacgacga

SEQ ID NO: 49521 - DNA, 1313 bp, Oryza sativa
caccgcagacgcacgttcaagaagatgaggggggagagaaagaaggggtagggattttgacaagtgggccttagcgattttgttagaaaaaaaaattgctgactagactgctatgtgggctatttgaaccctaaaccactcgcaatagtgaggggggttctgtctgtttttttgagtttacgggggcaattcgatcgaggggtaattatactttcacctttattatatggtgggtcccactatcctatctccccttcctttttttttgtcctttttgctcttgaagagcaatgagtggtggatagggtctttggcccaccatgagttagagattgtggtagaaccggcgcttatttagtcgtctttttctttctctttcttcctctctctattcatactcacctaaataatctcattcgatatttcaatataagccagctgagtaggattgttaattatacctacctaagcatacgatattcatggatggatgtatatacatgctaattaattggcataaatggatcaattttctgcaggtacggcccaattttcaggacaaacataattgctcaagacatgatcgtgtcccttgatccggagctgaacaacttggtgttccaacaagaggagaggctcttccagtgtggtacccgaactcattcatgagagtcttcggtgcagatagcatcatcacgacgttcgggtcctcacacaggcacgtcaggaacctggtcctccggctcttcggccctgaaaacctcaggcgagcaatgctccaggagatgcagaaacgggctcaggccagcttgctctcctggcttgatcgtccgagcatcgaagtgaaagaagaagtctcaagtgtaagcatgcacatatatgcatgacctcaattatgatatatagtgtacgacatgatatatcattggatctaattgcttgtttagcacagtagttaaaagtctaattaatatatgttgtacattttttaatattatttataatcctggcagatgataatattcagcataatagcgaagaagttaatcagctacgactcttcagcatcaaacgggaagttgtggaaacagttcgatgcattccttcaaggattacttgcaggtaaacatataaaatatatagagtggctttacctttcaaataatgtttagatagaatatgtatatacacgatcgatcatgacaatcaattcgatcactgtatatatatgcagggacgaaaaaatgtcatgaggatgttgagagaattgctcgacgagaggaagaagaagacagcacatcaattggaaagca

SEQ ID NO: 49522 - DNA, 1131 bp, Oryza sativa
ctatccgaagagtctcctgtctactactagtaccaacagcatggacccacatgtaattcagacagacacttgggcaagtttggggttaactggttactgtgctatggtgtgcggcagccgttgaattcagttagttacagaagtgaaaacgaaaattcactgatgctgatcctgtcccctcatataaactgtccaagcagagggtaattgtctggatcagtcagtgacaaaggacttaaagacagtaaaaacattttctctgaaatctatgaggacaatttggagcttagcatttcataaaggttttcttcaggaccattgacaccaaatgtacatgttactgtagatgcagacattcactacacagttgtgtggctatggtccaggactccagactgtgtccacaatttgcatatcctgacagatgcaaagcccaacagtaatcccaacaacaaatcacctaacctttttggatctaaaccctgcaggctagcagaaaggtaagggaagaagggaaaagagccagcacagcttctgtacagcctcttgttctgttgctgtcacttgatctccaccacagctgaatgctcccaacttaatagcaaaagctgcaacctaagcctgcaattgaatggagcactgaatggcccaaaaattacagcactgaaggatcatatttatccgggtcgagagatgatgttcaggtacatacctagaaatgcttatactaaaatgaaaagtaattaacatgttaaaactaaaatagcaattttactccccttatcccataatatatgaatctgaactgaatgggacataacatagtacaattaatttggacaggagatctatccaaatttattgtactatgttgtgttccatacgattttagattgctatgagtaattactacccaatagtttgttcgatccaagccaaatcaatcactatatcttatacatgtgtctgtgtgataaactgatagcaagtgataactgaacatgtaaaatggaaaaaagccgctcaacaagttcaggtacaacaagaggcacctttttcacttttcagggtctgaaatgagcacagaataatgcagatggtccacagagtcaaaagtgttagcaccatcta

SEQ ID NO: 49523 - DNA, 175 bp, Oryza sativa
  unsure (1)..(175): unsure at all n locations
atgggcccattgaaatgacatccgctnnnnnnnnnnnnnnnnnnnnnnnnnnnnnnnnncgttgcatcatgtcttagctttatagtcgtggcattccattttccaatcctaccttaacacgggggagcaagcgttttaattaaaaatagatcatttcggaatttttttaaatagg

SEQ ID NO: 49524 - DNA, 1501 bp, Oryza sativa
attatagatcttaatttaactaaatatatttatatttgtgaagtaatatattttatatttatattgtagaaagtcatattttaaataccgttgatttgtatgaatgtatgttttttctgtcttttttatgtatatgtgtatttgtttttcttctagcgaagattatgaaagttttgttttcaatcatatatacgtttgtacgtacggaaagtacagcagtgacatttgtaacgtacaaactcatacgtacggactgtagcgcttgtatgttataaacatgaggaagttattattttctaataatagatctaatctaatggtgtaaaataacgggtccaccaatttaagtgaaaatcaacggtgagattagatagtgctatgtggcggcttaggagcgtttgtagaagtgccacgtagcggcttgagagcgtttataggatgtttaatggacttttagtagatagattttgtcataaaaagttagaatctttaaaacaattgacaaaatatatcgggcctgtttggcgcagctccagctccagctccatccctcctggagctggagctcagccaaacagtttcagctccaccaaaactgggagtggagttaggtggagttctatcacaaaatatactagagttatatttaggagttgaagctgtaccaaacatgaccataatatatcattttacaaatattcgagtttaaatttttgaaaaattaatttatttttcaacgtttaaatacatgccagtaaaatactttgtttgactgcaaaatggttcttctctaactttgtaaaatggcattttatttgattaaaaaaattatatatcgatttacatttttcttggaaaagatttgactgacaaatttcttatttcgaactgtttgatcacaatttatcatcatgtatgagcaatgccctgcaatgtaaatattatcttatgtgaaacccttccatatcatattatgctttcacctgacaaagctaaaagccatagaaatcataagggcctactttctcaaattaccccacgggcatattcaccacgtgacaagctagcccaagcagttctcactagtaatcatgcaataaaattaaaatattatattaaaataataatttaggaactaatattaaattttcacagataacattcaatataattacaattatattttttaagctctaaatttgacccgccactgcatcgcccccattggatcatgctcactctgtgcgtaggttagcctcaggccctcaagtgtcaccattagcaagcagaacatacgcctactccgtctaaactgagacagaatcacgggcccacccgtcagtcacccaagctccaaaacccaaaccccccctaatctccttcaaaactgacacgagatggtgggtcccacccgtcagtgagacagccgcccacgccttaaagcccaaacccaccttaatagccacccactactcccactcccacttcgctccactccacg

SEQ ID NO: 49525 - DNA, 151 bp, Oryza sativa
atttgtcctgaagattaagactacttatagagctctatctcacttcacatgaattggttaaaacggttttatattgctatgacagtattttaaataattaaccaagctaattttgattccaaaatttcatatccttactcctgtaaaaagg

SEQ ID NO: 49526 - DNA, 1306 bp, Oryza sativa
tctaacccatactcatgcccatcgagtggggtaccagacttacgggtaaaattgtcatccatggttcgagggaatgcaacaggatgaacggcggggcaggaggggctggtgtttgtcttggtcagaagtaattatttattttatcatataagaacaagctatcggatattaagataatggaagtacaactcagcacattagttaaattacttctgccttagaataccgaactctcacaaatatacatttttacaactcacgtgggagaaaccttgtttatttctataccaggaggaatgttaggttgccattctggaatattttgttagcagtgcaaatatgtgtactaactgaatgctaaaagtggtagtacctttgaaggcattgtttgatattcatgtgatgattgcaaacctgtaggggggttttttcctcgagccttgaccagtttcaattttctcaatattctactttgatgttgtaaacttgagaggttaaacatttaagtggttgtattatctgctaaatctataatctatctcattacgggattgtccaaaacatcgttagtcggatgtagagagctcgaatatatataagccagttgggatcaatcaggctagcaaacagaggaagccaaatcagccaagcctgaattctgaatgtgaccacgaatcaccgtatcgtcctgtttttggatgtgaatcgacacgagattttgtcaatctaagagatgtaccacaagtactcaagcgaaggcccatggttattgagtgcaagcaaacgcaattctccacgcggagacacaggagttggcgtaacgggcttgcaactccattacccgtacccgttagcaggcagctgcaccataagctcagttgcagcttttatatatacatggataattttactcgatttattcagagtagggacatgtatacaaccactaccatagaaatttatttatattatatttaaatcataaattattgattttgacatgtagctttatgcaagttgggtttcggatcttggaaggttaggagatacagtaacccgggaagcaacaattgcctggatttcttggaagcaagctccatgaattttgcttgcctgaccctcctcccaagtctttgatcccaagcgacaagccaagccagaatgtaccgttggtaccacgtactgatcctatccattaatccataagcaacccagctccaccactctgccactagcacacccacacacaaataaacccggattaaaacgcaatcatgcatgcgccacgatcagatcacattctcaa

SEQ ID NO: 49527 - DNA, 1501 bp, Oryza sativa
ctctcctcccctcccgcgcgcgcgtgccttgggccgccttgggccggccggcccatttagctcggccgagccgccccttttctctcaggccgcgccctagccgcccgaggaaaagtctaatttccctccctcttttcttttcttttcttttcttttcttttctttttcaaaaaggatttaattaaatccttttcctttagaccaaaaatccagtaatcttagaaattcaatatcttcccaaccgtaaatccgtttgactccgttcaacttccaaaattcctcaaatctcgagatctctctaatggcacgcttagaggtcattaatagggctttattttcgccgtttgttgagttgtcccgttttgcgtatagtttcggagcccgaagaaccgcagtgcgaggatttcgaggatcaagctctagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatccttcctttgataattgttatatcgtgtccccttgtaaccatctagtcgcgtctcgatattcgtgcaccctgtgcgagtattgacgggcgccttcaaacttaaaatctgaaaaacctcttgggtaaaacttgggttttacaaaagacttggaaaacccgacacctgggtcggtgcttgcgaactaaatgaatttccaaaaccgcggaccggggaacgtaccgggtgtacggtttcccgctcttgcacctaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccaacgtggctgatccccacgggctgggtgatccgggttagtaatgtcgtgtgggtaaagtgtaccccctctgcagaggttaacaaactgttcgaacagccgtgcccatggtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgaaaagctgttggccgggtgccaaccttgaatcaattctaaagactgatgcattgcacatactccgaccggacgagacgcactgtctcatccgtgtcgtttgagaagcactcacctagttgttttt

SEQ ID NO: 49528 - DNA, 1501 bp, Oryza sativa
aggcttcaaggaaaggctgttgtttttgcaattgattttatttgaactcttttctaaaaacaactaggtgagtgcttctcaaacgacacggatgagacagtgcgtctcgtccggtcggagtatgtgcaatgcatcagtctttagaattgattcaaggttggcacccggccaacagcttttcaaacggccacccgggccaacaactttcaaacggccacccgggcctagctgatcccgtcagctgcagatttttcaaacatcgaacccctttccacaacagcaatttcacaagcagtagtcaaacaaaactacgctaggaatcacctcacatccgcccatgaccatgggcacggctgttcgaacagtttgttaacctctgcagagggggtacactttacccacacgacattactaacccggatcacccagcccgtggggatcagccacgttgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaggtgcaagagcgggaaaccgtacacccggtacgttccccggtccgcggttttggaaattcatttagttcgcaagcaccgacccaggtgtcgggttttccaagtcttttgtaaaacccaagttttacccaagaggtttttcagattttaagtttgaaggcgcccgtcaatactcgcacagggtgcacgaatatcgagacgcgactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctagagcttgatcctcgaaatcctcgcactgcggttcttcgggctccgaaactatacgcaaaacgggacaactcaacaaacggcgaaaataaagccctattaatgacctctaagcgtgccattagagagatctcgagatttgaggaattttggaagttgaacggagtcaaacggatttacggttgggaagatattgaatttctaagattactggatttttggtctaaaggaaaaggatttaattaaatcctttttgaaaaagaaaagaaaagaaaagaaaagaaaagaaaagagggagggaaattagacttttcctcgggcggctagggcgcggcctgagagaaaaggggcggctcggccgagctaaa

SEQ ID NO: 49529 - DNA, 316 bp, Oryza sativa
tgtgcttgttttaccactgagaaattcagacttcagtttagcaaaacgatctttggaattcgagaattcaactgaagcttatatatggtaaaaaatctagccagctcacatgatgattttacaaagcaagcacctggatagatcacaatatactatgcaaaaacaaaactacatctcgccgggtagaacatgggactcatggatctgaaagttgcacagttctaggtttgtaccttgcgaaacatactactgaaagttaaactgtacataagctcttctttcaggttagggaattgcagtgccggctgggttgcca

SEQ ID NO: 49530 - DNA, 1501 bp, Oryza sativa
attaagaacttcagtacagtagtaagttcagtagcgtctaggaatgcgagcaccatagcgcttcactttctgccaaaaacacactactccagattttagggagaaacgatcagataatatatgccgatggacgtcggtggccgggttcgagtccggggccgattaaatcaactgcaactaacgtgcttccgagtcagagattacggacggaggagaagtactactaatcagcgtgctccgacacgatcgaactgaagaaaagaagagagaacgcagaggagccccatgtgccactgcttaaacaagcaggcgcccctacatacacgtgtctcggatcggacaccaactgacaaccccacggctagctccacgaggcacacgatcctgcccgtctactcgtcagagactagtaacgtgggccccacgccaacggtcaactaattaacggccggttcggttttctttactgtgtttgccacttgctcctgcgtgtgttcctcccttattttagcagaaagatcacctgctccagtaggataaaaagaagaggttcgattagaccctagacaggcatgattgatgattccaaccttgtttgccaataaaaaaactgcgtgattgcataaaagctagtagccaatttaatttcttggataaattgaacagtttagtttgtttaaaaccattgaaaaaaaatcaataattcctagtttcggtcactatgtgtttccaaatatcaaaagatagagatagccatttaggacgatgctagaaaaattgatagcctaagaacaaatcaatgtattttagttagacataattttctctctcacaaaatattcatataattttaaaggatttgaaggggatttttggagtcagcctaggactaagccctaatttccctagcttgtagctccacccttagagatcaccaaggaagatgtcgttgccttttcacatcctgcatttcagtgtcctcgctagtgttgaagtaaagaagacatggttttcatgttgctaagggctgatttagtttgaagacaaaacttgccataccaaaatattggcattttaaacgtaattttgttaatgtttagtttgctacgaatacttgtcaataccacacaaatgttgccaaaatattggcattggcaaaaaacttccacatgatttggcattgccaatagtttggtatggttgcaaactaaacaagccctaaatctctatcagtgtctaccgtattcttaaggtactcaatgaagacttacgaagtattttctatcaagttattcatgataattagcggtgatgaccgatcagtagtatttggtagttagtacaagtcactaatttgttgtgtgatattggtatacgtgatgaaaagttaagaggaacgatgatggtggcaatgctcgttttttattaatattataagtgcgggagttgattaatatcgtgtttacgctcgtctatttatatctcttatggtatggtgttt

SEQ ID NO: 49531 - DNA, 414 bp, Oryza sativa
  unsure (1)..(414): unsure at all n locations
tatgtggtttgacttgnaaaagaaccagaatcggtgtttggcttggctcttggaaaaagccatgtcaaacattcatgcagctaaattgaactgctcttgactgaactgttaaagttgcatgatttatgttgcggtacaagggtgcgagagaggtttgattctcattgattgtaatgttcaatttatataaggggatacggtcggtaccgcaggggcgcaaacagtggctgagctaggaaattttcaaaccagggcaaactacttagctaaattgaactgctcttgattgattattaatgtttagctctgatgaatcccctaatgatttttatcaaaatcattaagttaaggtagatacacatcttgtcatatgatcaaatggtttcgccaaaaatcaataatcagacaacaaaa

SEQ ID NO: 49532 - DNA, 1501 bp, Oryza sativa
atgtattgtttatttggtttttattagtcttttttctcgttttgcgtgttagcttgtcgtttccgtcgtttcgaaggatcgtgagtgcgttggaagtatccaagaagattaatggaagaccttttattgcaaggcaagtcacacagatcccaaacacaattcctttgagcatgttgatcctatatttaaattctttatttatttcaactgtgcatttatttttgaatgtcaccgggtggtgtgaaactattcctttgttatggccactttgcattgattactctatccattgataccttgggcttataatttgactagttgagctttatatattggttcagctagatgtattagtataattgcttagctatgcttagaaacattagcacacgattggaataactaatgtttcactattacttaatgatggacatgataatggtagctcacgatggttaatcgtgattggttaattaattaatttgccaactaaaacttgataatggttggttgtgagcacatggttttgatggtcgtgctcatgacaattaaggaccggttcacgagtttcggttgtgaaacattgaccgtgccaaccacaagccagcctaggcaacggctggacactttgtatagcaaggctcattgtggtgtgccagactgagaagtggcggagataagcccacgggggtcgctggggagtccatgcctctggtttttgagggggtgactacgatccatgaaaggtgcgctgctttgagttgagctatgcgaggggtcttgtcacaactacacaaatggtgacatgttcagcatgggcacatgatgatatggtgacatattgtggagttgtgtcttgtgggtacagtggtacacctctggccagagtaaaactattcgaatagccgtgaccgcagttatgggcaggtctaacaatgtctttcgtgattagtctcacactactcattaataataatttggtaattgatggtaattaatttagctcctggtttggaatggtacatttctggtttggagatagatctgtatagccaggtatggttgttcaggatggttgggcctgtgcagcatgggtgtgctgttcagtgttgattaatattgatgattaattactctactgttttacaattctcaaatgtttgctaaatgctgcttttgcaaatgagccctatattatgccattctttggtatccttgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagccggagcttcgctagaccgtaattccactactattttctcttttcttttgtaagtatgtaacgttattatgatgatgaatctgtatattaaattatcagtttgtgtacctcggttgattcctggacgaggattttatgcac

SEQ ID NO: 49533 - DNA, 183 bp, Oryza sativa
  unsure (1)..(183): unsure at all n locations
gtgatgaagactcttnnnnnnnnnnnnnnnnnnnnnnnnnnnnnnnnnnnnnnnnnnnnnnnnnnnnnnnnnnagtatgctgaggtaagttctcatcggctagatctccttttctcgcatcagattgatttcccctcccctcatcttgttttcttcttctctattcttgttcgcatctgtagc

SEQ ID NO: 49534 - DNA, 185 bp, Oryza sativa
cagtgacattcgaaaataaatgcacagttgaaataaatagagaatttaaatataggatcaacatgctcaaaggattgtgtttaggatctgtgtgacttgccttgctggccttggaactcctcaaattcttctcctgcgaaaacggactctccggaaacgtcggaatctaaacagaaaagagcaaa

SEQ ID NO: 49535 - DNA, 493 bp, Oryza sativa
cgggccacccagctagttattatgaaagagaaaaaaaatcttttactacatagtttatgccacgtattccaaactgtttgttatttgtaaagtttttttttccaatcactctatttagtacggctttagatctcatatccatagtacatttgaagtttatatgctaaattatagtgcttaaaatttaaaatttatttgaaatgagcacaaaataatttatataaatgttatcaacaaactatattaaatccatagatttgttaatctagaaatatccagctccaaaaatcttggatccacagctatgccaaaaaggacctaacattgtaatcaagtagctctactagtagattcttgtagtgtaactagcccacttgggctaaaattctagacttggcacgagtactcgtatttatggtaaattatttttttagtggtaggcgtcgtaaccgttgataatgaggtgcttatgttgactttatcaatctctaga

SEQ ID NO: 49536 - DNA, 1501 bp, Oryza sativa
acttacaaaagaaaagagaaaatagtagtggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacaaggataccaaagaatggcataatatagggctcatttgcaaaagcagcatttagcaaacatttgagaattgtaaaacagtagagtaattaatcatcaatattaatcaacactgaacagcacacccatgctgcacaggcccaaccatcctgaacaaccatacctggctatacagatctatctccaaaccagaaatgtaccattccaaaccaggagctaaattaattaccatcaattaccaaattattattaatgagtagtgtgagactaatcacgaaagacattgttagacctgcccataactgcggtcacggctattcgaatagttttactctggccagaggtgtaccactgtacccacaagacacaactccacaatatgtcaccatatcatcatgtgcccatgctgaacatgtcaccatttgtgtagttgtgacaagacccctcgcatagctcaactcaaagcagcgcacctttcatggatcgtagtcaccccctcaaaaaccagaggcatggactccccagcgacccccgtgggcttatctccgccacttctcagtctggcacaccacaatgagccttgctatacaaagtgtccagccgttgcctaggctggcttgtggttggcacggtcaatgtttcacaaccgaaactcgtgaaccggtccttaattgtcatgagcacgaccatcaaaaccatgtgctcacaaccaaccattatcaagttttagttggcaaattaattaattaaccaatcacgattaaccatcgtgagctaccattatcatgtccatcattaagtaatagtgaaacattagttattccaatcgtgtgctaatgtttctaagcatagctaagcaattatactaatacatctagctgaaccaatatataaagctcaactagtcaaattataagcccaaggtatcaatggatagagtaatcaatgcaaagtggccataacaaaggaatagtttcacaccacccggtgacattcaaaaataaatgcacagttgaaataaataaagaatttaaatataggatcaacatgctcaaaggaattgtgtttgggatctgtgtgacttgccttgcaataaaaggtcttccattaatcttcttggatacttccaacgcactcacgatccttcgaaacgacggaaacgacaagctaacacgcaaaacgagaaaaaagactaataaaaaccaaataaacaatacatataaagtaaacaaacatgtagatcataattttagatgtattataagacttgaacggcttcattctgacttcatatgaattaattac

SEQ ID NO: 49537 - DNA, 1501 bp, Oryza sativa
ctttgaaaagcgtgcgcggaatatatttgactacagaagataaaaaacagataattatggaatgaatacaaataatagtgatttgaatgaggacaaaacaattatgctcaaaatatcataccctaattatgtttgcccaagcagcatcatcagcaataatctgcaccgttgattatcccaagaagctccactctgtttccttgcctccttaagcaacctataatctcgttttaactgcttctccttatcttggatctgttgcttattcatggtgacatagggatgtctgttacgaaattctttgacgaccttgttccatgcttcacttgtccacccgttttggcaccggtaatgtcggttattgtgctcatgaagtaaatcaactaaagccttttctagtcccgggttccatgaagctcttaattgttgagctattagacaaaattagatgatagtaagtaaattttgtaataattaacatgaaaggaaaatactccacaaaaccaagttagatactacctttgggagaaaccttcttcttctgtgtgctacagctctttggcgataccttcttttgtagatgcctttgttgttgctgcaataggcttgctttcggagatagtcttccaaacatcataactgtattgcaatattttattgaatgaggaaatacaaactacattacttactattaattgcccatatcataaatgttgattacataaataaatacaaatcataaaaaaccaaaatattatctatactattcttgctagctacaaacataatcttcccacatctaatactattcccactgatcatttgattgctaagagatgccacatcattttggtattcactgtcaccttccggtagatcaacaaaattagtaggctttatattatcaggtgggttgtccaaccagccctcatcaccattaagaaatcggatcatgttgtggaataccgcagcagctgctggaatccacacttggttctttatccgatggaaagtacctactttcaagatgggaaatcgcttctttaaaacccctagagctctctctacatggtttcttagaatggaatgtcgatgattgaataactccttgtagtctctaggtcgacgatgaccacatccaaactcctttagatggtaccgaacaccacgataaggagcaatgaactgtggtgtgttggcataactaccaactagagaaaatttaccatctaggacttgaaagccactattcattgctgatgtaaggaccctagcatctgttgcagatccctcccaaccacatgagataaaagtgaaatttaggtcaaaatcacaagcaaccatcacattttggctcaaagtcccctttttgttcctataaggagctgccttctgtcacaccctaaaaaatcctaaatatataaattgttgtttaattggaattattagaatttattttaaaaagcctagaagagaagatctaattttaattaataaattc

SEQ ID NO: 49538 - DNA, 1501 bp, Oryza sativa
ctcgctctttatccttggtaacctttgcaagggctcgcaaccgtgattgaaccagatcttctctctcatcggccataaggttataatactcatcggctgttaaattattttgcaactccgttctccttgagccgattctaacttcccatggcaaaacagcctcatgtccataaacaagcttataaggaggaacttggatcaatccatgacaagccatccgataagatcataatgcttcggccaaccaagtatgccattgccgaggataatcagaaatcttcctcttaatcaatttgatcaagctcttgttagatgcctcggcctgcccattagcttgtgcataatacagtgaagaattcaacaatttgatacccatgctatcggcaaactgaacaaactcatcggacacgaaaattgaacactgatcagttgtaatggtttgaggaataccaaatcgatagattatatgctcttgaacaaactgtatagcatccccagaatcaactttcttcaaaggaatcgcctccacccacttggtaaaataatcggttgccaccaatataaacttatgtcctttactcgatggtggattaatcatgctgatcatatcaattccccaacctctaaatggccatggcttaatgataggattcatagccgacgccggtgctgtcacgcccagaaattcactagtaatttccgaactaatttgtgcataaaatcctcgtccaggaatcaaccgaggtacacaaactgataatttaatatacagattcatcatcataataacgttacatacttacaaaagaaaagagaaaatagtagtggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacaaggataccaaagaatggcataatatagggctcatttgcaaaagcagcatttagcaaacatttgagaattgtaaaacagtagagtaattaatcatcaatattaatcaacactgaacagcacacccatgctgcacaggcccaaccatcctgaacaaccatacctggctatacagatctatctccaaaccagaaatgtaccattccaaaccaggagctaaattaattaccatcaattaccaaattattattaatgagtagtgtgagactaatcacgaaagacattgttagacctgcccataactgcggtcacggctattcgaatagttttactctggccagaggtgtaccactgtacccacaagacacaactccacaatatgtcaccatatcatcatgtgcccatgctgaacatgtcaccatttgtgtagttgtgacaagacccctcgcatagctcaactcaaagcagcgcacctttcatggatcgtagtcaccccctcaaaaaccag

SEQ ID NO: 49539 - DNA, 923 bp, Oryza sativa
aattacataggggttattgatggcacccacattcctataaaactatagatggagagaaggtgtcacgcccggaatttctattcaaaattccaaacgcttacatgtgtgtgaccctcgtccaggaatcagccgaggcacacaataacaaattgataatagagtacaattatcactctaattaataagcgaataaaatgtcattacagaggtagatagttcctctcaatcaataaagatctaagcagcggaaaaaataagataaacggcgcagacgactccactccacaggcagcttgaccagggctacacctaatcctccacaccatcagcatcactgtagaactcctcctctgatgaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaaacaatattaatctaacgctatacaacataccctgttgcataggcccaaccattctgaacaaccatcccggctgcatagttctatctccaaaccaggaatataccattccaaaccaggagctaatcaaattattaccagttatagcatcttttattatgatgagaagtgtgagactaatcatgaaagacattgttagacccgcccataaccgcgggcacggctattcgaatagttttactctggccagaggtgtaccactgtacccacaagacacagccccacaacatgtcaccatgtgccttaataccaccacggtacctcggaaaggagctgtgacagtaccccttgcacaacacaatccactacagcgcacctttcctggatcataatcacccccttataaacaaggca

SEQ ID NO: 49540 - DNA, 1501 bp, Oryza sativa
tagatcgaagcggaatcaaagatgaggatcgttgcggaaacagattaagaatcggatggagttcggatcggctatgattgagatcggcaaagtccgagtcagactgggtcaggtgatacgaacgattccgacagtacgacttggtgtacgacatcaggtcgagttgatatgcttcaagatgattgccacgcatggatagagtcctgagaagacaattgtatctattagttaggatattttacgtaatttccatagagatatgtttaggcaaaagtctgccgcaaagacttatggtatcttagagtttgttagagataagagtcgtgtccgttatggacatgttgtgtaattctcgggtataaatagacctcaagccccatgtaatcaatttaacacacgttcaatacaatctcggcgcatcgccaccctttttgctttagttttatttcgactagttcttgctttcgggttgagctgcatcggtttcgatcttcaacaagaggtaaaacttgttatgacggcttgcgttcttgggattagtgcttccatttttatgatactctaatcttgtttatgtaattcgttgagttatcatatatcttacataatctctggcaatatcgctatctaatctacaatcggctaacatctgtcggtagagggcagcgattagattagatatcgacgttgacttagattatataaggtatccaccactctatgaaacttccaacggcttgattgtctagatattgtccttcttttcatacttatagttgcatcagttgagtttgatcttatgagtcgtgattagaatctcaatctctagcctgattcttggtcgccgattagggtagaatcgtggtttcagccgatcttacctgatttaactacatttgttttatatgctttattgacatgttaaatcgcatttaagtatattagacttttgtttgatatattctacttgctttaatatcttaatatagagtggtatcggagtattagccgatacatgctagatctatctgatcggctatgctatgaacatatatagtctcattattaatatatatttcgatctaagtgatttatactgtctcggcatggcgaccgatctatcccaatcacttgatttaagtatatatcgatataaggagtatatattgttaatatctatagccgatcgagtagatttagttccttcttttttatttataactgtcgatcgatacatatatgacatcggcgcaaagataaatgatatgtcatcggcacctagccgatcggctatcgtttatggatttaaccatggtttctttgtctttatttcttgttgattgcaggatcaaatcaactggcacactaacatacccgaaggcgagttttggacctgcactacagttaagcagatctcctaggcatcatgtttttcatcaacacgcttttggcatgcctggtgggacccattagaagtcagaatcacaacagcagttcccca

SEQ ID NO: 49541 - DNA, 425 bp, Oryza sativa
taccttgggttattataacttgactagttgagctttatatattggttcggctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccgattcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagg

SEQ ID NO: 49542 - DNA, 1501 bp, Oryza sativa
aagtaaaatttgagggctccttttagaccaaggagaatttaacaaaaattctccggaccacattcgaatttttctggcacgtattttagtgtttgtcaatttcttttcgaattttaattaattctattattccttttagggaatgatttttatttcggaatgaatttatcaggacgtgacacgcaccatctagagcttgtttcacttctccatccttagaagaaccggtcccaggaacatcagcaactaccttcactttgtatttctgaaccaatgtccccttgcaggtctccgtgaatgagctcaagaacttattccatgcttgctgcatcattgtatcaaggtctttttgctgctcaggtgtcaatttatccagagtgatgggcacaatgttggcttcatcaatctcagataaacctagctccgggatcttttctttaacagagccaggaccagccgaggacggcgatgctggcagtttctcggccatggggaactgctgttgtgattctgacttctaatgggtcccaccaggcatgccaaaagcgtgttgatgaaaaacatgatgcctaggagatctgcttaactgtagtgcaggtccaaaactcgccttcgggtatgttagtgtgccagttgatttgatcctgcaatcaacaagaaataaagacaaagaaaccatggttaaatccataaacgatagccgatcggctaggtgccgatgacatatcatttatctttgcgccgatgtcatatatgtatcgatcgacagttataaataaaaaagaaggaactaaatctactcgatcggctatagatattaacaatatatactccttatatcgatatatacttaaatcaagtgattgggatagatcggtcgccatgccgagacagtataaatcacttagatcgaaatatatattaataatgagactatatatgttcatagcatagccgatcagatagatctagcatgtatcggctaatactccgataccactctatattaagatattaaagcaagtagaatatatcaaacaaaagtctaatatacttaaatgcgatttaacatgtcaataaagcatataaaacaaatgtagttaaatcaggtaagatcggctgaaaccacgattctaccctaatcggcgaccaagaatcaggctagagattgagattctaatcacgactcataagatcaaactcaactgatgcaactataagtatgaaaagaaggacaatatctagacaatcaagccgttggaagtttcatagagtggtggataccttatataatctaagtcaacgtcgatatctaatctaatcgctgccctctaccgacagatgttagccgattgtagattagatagcgatattgccagagattatgtaagatatatgataactcaacgaattacataaacaagattagagtatcataaaaatggaagcactaatcccaagaacgcaagccgtcataacaagttttacctcttgttgaaga

SEQ ID NO: 49543 - DNA, 1501 bp, Oryza sativa
ttatgcctcttcctccaaagctctttcaaaaaaaaggaagagagaggcatggctatgcaaaaagaaataaaaaaagtgctcatacaagtatggagcatgatgatgaaaaaaaaaagaaaaaaagaaagccatgcactctcccaaattttcaaaagaaaaaaaataaatggaggaggaggtatacaaaaggagttggtcatatttttcctttttccacccacaaattaaccatacacatacacatgcacattcttgaccagaaagtatgtcttgtatttccatatatcctttatttgactttgcaatatgtgttatgcaagtaatgctctactcttttccataccttgagctccacataagccttattagatgataggaaaagaaaaggcacaatcgtatgcctttgtgaggaatcatacaccttgagtgattaagagaatcaattgaggagcaaagcaaagttataattttgtgttacataaaagaacccaagttgttcttcatgaaaagttagggtgacttgagtcaagattgttccatttctcaattgctcaggatcgcatggtagacactacgaagatccaaagtataggtattactttgaataatttgtttgaatgattattagtaaggaagtcatgaccctgttatagagtccatagccttcactcgggacgagcaaaggttaagtgtgggggtgttgtggacggcccttaaatcataatatctgaccgtcaatacttgcatataatgaaataaaacatggtatccaacttagtgtaatcatttctactagtgttggtgaaatatgtgtatgcaggtaatttgagaagcaaacacatccgtcatgcaacaaaatgcacctccgcgcattcgggacgcatttacacggattggaggcccaataagtcaataaaacccatttagaattggaccaaaacatagcccaggttgttggggcccattaagcaatctcccagctgaaggagaggccgggatgagtgtttttgggttcggccgaacccaccaattcggccaaacccttcctgtcgcttcccgccatctgcttccaggtggacggcgtggattcctcccctatggcggttgcagggtgttttggtcatttcctatacccctaaccgtcatttggagcctatataagaaggtattcatctcacttcaagcatacacaaccttgagctgaattacaagaggctctattgtatcttttgtacattagaataatgtagagagtgaggggaagctctagaggagtgcccggaagtttggcgctcatccaacttctacctcgacgagtgtagtttactaggaggaattcgggaggagtaccggagctgtcggtacactctgcttcgggttcggagaacttcttctataaagtaagcattcgtgttcttttcttatgttatttaattactttgtctgagtaagatagatttccatctttgcaggttcattgtttagtattttgatgtgacca

SEQ ID NO: 49544 - DNA, 753 bp, Oryza sativa
  unsure (1)..(753): unsure at all n locations
cggggcattgatgattgaataacnnnnnnnnnnnnnnnnnnnnnnnnnnnnnnnnnnnnnnnnnnnnnnnnnnnnnnnnnnnnnntattaccaaatttagtcgttaacacagtggcccaccttgcttccgcagcatataactccaaataatgatatccagtaatctaaacatcacgcttaatttaccaaatactactttaatatcatcgtcatgacttagagtcatcataaatacgatcattatacccacaccattgcatctcccagataagctagcattataataaatgtaacttggatatataataaatttggtattcatatactcggaaagtaatacaataccaaagtactataaagaagaatattctaataaaagtacaagtcttacaaaagaaggaaaaactactagagccatacccgaattcttccgaagactccgaggactgaagattctattctatttctattccactatgctatagagactatactaaacttgagagatgtatgaagcttcttacttgaggtgtcttgaaatggagagagtgaggggtttatataggctggtaatgatggttatgatggttggaaaggtcgataatacccaccaaccatcattgggaatcaatcccagctgtctagccaaaccctgcatccatcggtgttgcggctggttcggccgaacccctgggctggcccaaccggctcagttcctggaaggcggcctcctctcttgttgctcacttcaga

SEQ ID NO: 49545 - DNA, 1501 bp, Oryza sativa
gggctcgccggagtaggctgttgtcgtcgccggagggaggtcgctcgtccgcgtctcgtcttctccgtcgaagaaagctcgccggagggagaatgagggggttctctggggaagatggagcgaactcgccggtcggcagtcgccgtcgtctcgcctcgccggagtaagatcgtcggagtcgtcgtccctcgctcgcgtcaatcgcgtgaatggatggagagagaacgaacgcgccgtagacccacccgagaggatcgaaggctcgactaagcgtctggatctagcttcatgggccgatatgagaaatatgggctgctggacttggttttcttggaggaggtttatctgggccaaaactaccctcaattttggcccagaactaccctctgtgtgtttctgcataccgcattttggtcatcttattttcttctgtccacagctggtagtagtactttaccgtactttatcgtactggtatggtactccctccgtagtctaaaataatagattttgacattttacatcaatagtttggtcacttgtcttattaaaaaatttatgcaaatataaaaaaacgaagagttgtaattaaagtaatttggataataaagtaagtcacaaataaaacaaataataattctaatttttttaataagacgaatggtcaaacagtgcaagaaaaatgttaaaatcacttatattaggggggagaagtagtacttttgtccacagctactagtataataacacattttttttagataatggaatataacatcccagccagtataataacacatgaatagtactttataagtggcttatgttttttaatttttctaaaaaaattaaataagacggataattaaagttgaacacggaaactccagattacatttaaatagtacttctgtccacagctactagtataataacacatgaatagtactttataagtgacccatgtttttcaatttttttaaaaaattaaataagacaaatgattaaagttgaatacggagactcaagattacatttaaaatggtacggagggaataactttgccgttaaaaatctaaaaagtttgaccatgttatctgcatgtggagaggagtgacacggggtcacgggccagccgcaactgtcgggttcaaaagatgcgttcgcaagaaagcaaacagattagagtggtggccccgcatgcagtggtaacaactgatcgaaaccacggcatcccgttcaagtagctggtttagctccacggacgcatgcctattctagtgctccactgccactatctttagtagcgccgtgtcgggctcccatatataacgtccctcgccgtctccatttggatttcagcgatcgatctcgaccgcaccggccccgcatgcctgcccactgcccaaataaagcgtcgtcgatcgaccgcgcgcgatcatggcgatggtcgtcgcggggagccatcggccgccgccgccgccgcagtcgctgcggctgg

SEQ ID NO: 49546 - DNA, 803 bp, Oryza sativa
  unsure (1)..(803): unsure at all n locations
cgcgaatggcaacggcgcggcagcggcnacacggaatgcgagtcgncggcacggggctcgggncaacgcgacgggcgncagtgcnnacgcgcggggcgcgaggcaacgtgacagcgacggcaccggcaacgcgacggcgacggcgacggcgcgcggcagcggcggcgagttagggcaagagaccgcaatcgagcacctatggggcaatgaacagtgacttttcctatttaaccccattttagcctatttattatataaatttgattctataaatcctaaattttgcataaatgaagtatactcgatatttgtgttatcccaaccaatggatccactctagattaattgtacccatattttatttttatataatttacttgattttaattagagttaattctcattccgtcgtatttaaatttaatcgatacaaatataatcgcggtaatattttattcatttctatcctcacctcatctttattttaaattatatcttgattatttcttttgccaatctaacttttcgggtttaatcctaattaatgattctttattcgcgatctatgaactccgaaatcaaaatccaataaaatagtcgaacaaaatcggcatgatgcaatttatttaaaaagtttttgaaggcccatatttttggagtttagatttttgtcggtcgaattttcagggtgttacacctaggcaggcgagcgagctcaagctccactcattgacaaccctaattgaaaccacctactaaaaccagtcggaccgcctggttttttcttgttccaaaaaccagca

SEQ ID NO: 49547 - DNA, 1501 bp, Oryza sativa
cccgggattggtccgcagcgcgtacatacgtttcgtcgtcgtcgtcgtcgggctcccggctgcctccgacggctcgccaccaccatcgcacggtgacagcgaatgatcatcatcgcggccgtcgtcgtcgtccatcgtgtcgttgtcgtcgccgatgccgtgcgccctcatgtggccgccgagcgcgcgaccgcacatgaaccccttcttgcacaccttgcagtggtgcctgtacgtcagaggaggaggaggaggctgcggcggcggtggcgggaccagccgcagcgactgcggcggcggcggcggccgatggctccccgcgacgaccatcgccatgatcgcgcgcggtcgatcgacgacgctttatttgggcagtgggcaggcatgcggggccggtgcggtcgagatcgatcgctgaaatccaaatggagacggcgagggacgttatatatgggagcccgacacggcgctactaaagatagtggcagtggagcactagaataggcatgcgtccgtggagctaaaccagctacttgaacgggatgccgtggtttcgatcagttgttaccactgcatgcggggccaccactctaatctgtttgctttcttgcgaacgcatcttttgaacccgacagttgcggctggcccgtgaccccgtgtcactcctctccacatgcagataacatggtcaaactttttagatttttaacggcaaagttattccctccgtaccattttaaatgtaatcttgagtctccgtattcaactttaatcatttgtcttatttaattttttaaaaaaattgaaaaacatgggtcacttataaagtactattcatgtgttattatactagtagctgtggacagaagtactatttaaatgtaatctggagtttccgtgttcaactttaattatccgtcttatttaatttttttagaaaaattaaaaaacataagccacttataaagtactattcatgtgttattatactggctgggatgttatattccattatctaaaaaaaatgtgttattatactagtagctgtggacaaaagtactacttctcccccctaatataagtgattttaacatttttcttgcactgtttgaccattcgtcttattaaaaaaattagaattattatttgttttatttgtgacttactttattatccaaattactttaattacaactcttcgtttttttatatttgcataaattttttaataagacaagtgaccaaactattgatgtaaaatgtcaaaatctattattttagactacggagggagtaccataccagtacgataaagtacggtaaagtactactaccagctgtggacagaagaaaataagatgaccaaaatgcggtatgcagaaacacacagagggtagttctgggccaaaattgagggtagttttggcccagataaacctcctccaagaaaaccaagtccagcagcccatatttctcatatcggcccatgaagctagatcca

SEQ ID NO: 49548 - DNA, 411 bp, Oryza sativa
cattttcccctatgagtttttacatgacaaagtttttaacgaggcagcatgtatcattgtatcctgtaatgatataaacattaataaaggtcattactatttttaacaaattcttttgcaatattttcgcaagtgtggatttacctttaaattatttcaaaataatgaatcacaatctatatttttaaatttttcaacacaacaaaaaaataccattttttcttttttttaacattagcaaatcattacttttttaaaaaacttttatttccattttttaaataccattttttcattttttaacattagtaaatcattacttttttttaaacattttatttccatttttaatttttttttccttatacatttcctttcctttttttaaaaaaaaaaacactgtgcatgcac

SEQ ID NO: 49549 - DNA, 251 bp, Oryza sativa
ctctgcgtgttgcatgatatgttcagtttacatggttgttcattgtgagtatagcatgtggagaagacacagtcacttgttattttaattaaatatttctttttataatctatactaaaaaaacgttttgtttactgcttctattatatgggcaggagtcttgtactgtcaaaatcgaacaaacatttgattttgaagcttgcagaatagtaaatactaactcacctaatgatttaggacaaaggctggga

SEQ ID NO: 49550 - DNA, 1027 bp, Oryza sativa
tttttttcattcctttgcagttttgatgccatatgggtaggagaaaaaacccgtaattagtttaatagccattagtttcctattttttacaagtgattagtttactagtaaattttaaatctgaatgtaaaatttttaattttggacttgaaagttttcaaatctcgagttgaaaattttcaaacctgggattgaaagttttcgaatcttgagttgaaagttttcaaatctcgagttaaaaattttcaaacatcaagttgaaagttttcaaattttcaaatctggacttgaaagtttttgaatctcgagttgaaagttttcgaatctgagttgaaagttttcaaaatttgactttaaaatttaaatattaagtcgaaagttttcaaatctaacttaattttttaatctattagtaaaaaaaaatctccgaaaaaaaatcttcacaattttttcaaattactgtcattagcgttaacgcggaagtgcgtgccgcacacgccagctagcttcccccgttcgctcaggccctgttcttttctgattaagattttgattttaactcagttttcggtagcacacgccttttaaattgctaagcgatatattctgtgcaaaaattatctaaatataagttaatttaaaatatcgaatatatctatttatcaagtttataataattgaagtaaattaatcatgtgttaatactttctcattttacgtgcaaccacttaatcttcatcttcactcaatgtctcgctgaagtagaactgtagagaactagaaattcgtcatatttgtcccagttccaattgaactcagtagctcatttgctcccaggccacagggccatttcggagtagctggtctccctgagtatttttgagtcggtgaactgcagagatggatggtcatggtctggcatgcatataatactctctcttaatccctgaatacgatacgatctcatcagagacagtggagctcatgtgttgatttaccaaaattagttttctgtggtgcttgcagc

SEQ ID NO: 49551 - DNA, 214 bp, Oryza sativa
  unsure (1)..(214): unsure at all n locations
tggaatcaaattcgaatttgaangaatcccaaatttggaccatttgagttttgaaaatttgttttctgtacaagaagttttctaagtggaataagaccttctggacaagttttgttttaagattttagcctgcctacctcatgtataaatagagaggaagagtgtggcctcccggtatcgctttaaagagcattgagttgacagaatagtaggg

SEQ ID NO: 49552 - DNA, 1345 bp, Oryza sativa
  unsure (1)..(1345): unsure at all n locations
caaattttgaagcgcctgagtgtnnnnnnnnnnnnnnnnnnnnnnnnnnnnnnnnnttttgcggtttggctgcggtaacctcgcagtaaggtgcggttactgcggtatatggacggttaccacaagatgctgtactgacagaagaacaaagtgaataaaatgcaaaactaaatggaggaacacttaaatgtctgtagaatttggggataataacaaaaatatataggatacttgaaaacacaacttgtggttatacaatagaaaaaatcggcatgaccttttatgtattacagacttcaaatcaattcaacagttcataacataataattcaacaacaacaatcaacaatctgacatttgaaagcttaaggacatccacatgcaagtgaatgaatagagtacataataacaatagagtccacaatatgatgtccacgattacaaatgtagtttcaatgaaggaaataaacaagtacatacaaacatagagcatagctatgtgttccaccaattatatgccatgttgtgcccttacatatggtcgaaaataagtctgtttcgcatccctaaactttgtgtcaggccgtgtcggcccagcgtgccgagatagcagcccagacacgacatcactattgggccaggctggcaagggcacaactcgagttggactgtgtcgtgcctaggccgggccaatagggcctcgggccttatggctatctataggtcctgaagtagttactttcgtgctctgtttcaggatcactgaacgtctgaacgaaaaaggggggaagccaagcctcattcagggaataagcgaaacgacatatttgcaaaagaaaaataatttgtaaataatgcaaaatcacagtgtgtttgactcttattctgtgatgaacaattagcatatgagattattggttttgatatttggagattattggctttacatgtgatgaataggtactgctagagatttggtccgatcaaaccgggtagtggttgccggtcagaccgttgtgcttcaagcagtcagaccggctagcccacggtctgaccggccgattctgtgtcggtttcggtttcaggttatttcgttggatatccgtggataatttgtgtttataacttcaagatggatactatgcgtatgtaatactgttgtttgctaataatgagtcaagttggagatagcttggtctatgaatatggtttcttgtttgattcatgtgtaggtaatcttgatgtctcgggggagtgttgccggtgatggatcgggagtcaactttgagatatggtgacgtccggacggtcagatatcatgcgggacacttaggctaacgatgaa

SEQ ID NO: 49553 - DNA, 276 bp, Oryza sativa
cattattttctgtatacatctcttaaaaagttagggagttggtggtggttcagattcaccactcaccaccaccactattcctttttaaaggagtatagatagaaatgctcttctcttttaaaaaaaggtggaaccaaatgcgcatttgatttaccaattacgttacttgatgattccaattttcttatctgccaaacaagtttctgccggtgcaatacttagtattaatactattttctgggttgtaccaattgctaattggctttctttaccagg

SEQ ID NO: 49554 - DNA, 747 bp, Oryza sativa
tacaagaaaccaactttacaaactccaattgtaccaaatttggactccttccaaattcgactctgcatcccatacacacacaatatctccatcgtatgccatatggaatcttcaccaaccacgtgcattcatcgttagcctaagtgtcccgcatgatatctgaccgtccggacgtcaccatatctcaaagttgactcccgatccatcaccggcaacactcccccgagacatcaagattacctacacatgaatcaaacaagaaaccatattcatagaccaagctatctccaacttgactcattattagcaaacaacagtattacatacgcatagtatccatcttgaagttataaacacaaattatccacggatatccaacgaaataacctgaaaccgaaaccgacacagaatcggccggtcagaccgtgggctagccggtctgactgcttgaagcacaacggtctgaccggcaaccactacccggtttgatcggaccaaatctctagcagtacctattcatcacatgtaaagccaataatctccaaatatcaaaaccaataatctcatatgctaattgttcatcacagaataagagtcaaacacactgtgattttgcattatttacaaattatttttcttttgcaaatatgtcgtttcgcttattccctgaatgaggcttggcttcccccctttttcgttcagacgttcagtgatcctgaaacagagcacgaaagtaactacttcagg

SEQ ID NO: 49555 - DNA, 309 bp, Oryza sativa
cacaaaacattaacaaatctctgtggaagttcaaggcagccctcaaagttaagattttttacttttgtaattacaccagggtgtagcgtaaacgaaggacaacttagcggaacgtaatttgcaaggatgcaggaaaaagctggttttatcatataaatcagacaactaagaatatctttcactggtggagaagtgctttttagtcccggttcgtaacccccctgtagtcccggttttcaaaccgggactaccaatccgggactaaagatcgttatctttagtccaggttcaaatacccgggactaaaga

SEQ ID NO: 49556 - DNA, 883 bp, Oryza sativa
tcaggttattgctcggaagtatttggttcaaggtgtgccccaacctacttttacatccacattgtaacattgttactcaatgggaagtcttgggcccatcgatgccacaggtgtaattagctatcctgtgaaaaggtgtattggatcatgcttgaagaatgatgactataagaacttattgtaactaggtcaatccgaaacactttattaggacaattatagaatactggatctgccactatattttctattaatttagaatttgatacaaaattagttaacggtaattatgcatacaacttgcattgtttctttgatgttccatttgggatgcaaccatcaacttcctctgttgttacttagaattccaactataaattcttgcgaaaatgctagtgattgtatgacatgccttcaatatggccaatgctttcttgtaaaaaaatgtatatggccaatgctccaaatttagtatgaccttactatggaaggtaatgtaaactaaacttaggttaatttcatcctcaaccacacattcaagatcttgcacatgcacaaaaggaacaccacgcaaagatgacttctcattatattgaaaaactatcctttttattcagtaactaatgatcttcgattgttctattaaaaaaatattggtccttggccatttcctaatctgagttgcataaaactacatatgttcccatggtcttccattgagagaaaatggcagatgatggtttcaaatatcatgaggttagttcgtttccagttgccatttttttcttgtgatacatcttgtgtgttacaattgatatcgatcttgtattatgctgaataagagaattttgaaaaacaccatcaccattttattttgttttta

SEQ ID NO: 49557 - DNA, 1195 bp, Oryza sativa
catcacagggattggcattagttgactatgaaagttttgaggaagcacaaactgcaatcaaagcaatgatgggactcagctgttaacaaggactgtctatgttgactgggcattcagcagaggtcctatacagaaactcaccagtacaaggtgtgttattaaccatgcttttatcttttgcatttgctgggatagggatttgttgtgttacactggcatagggtttcatttactccacaatctcatcaccaaacaatgtcttgttcttttttctgtttgttctgaatctaaaattctaaatctaaatttcctggcaattgccctttcgtgaaatcttgcatgcaagatctgtaactgtaacatattgtttcatattcagtggctattttttccctatcctagtggcctgtttatttggtttggtttgatctgggatttgcataagcagttcatccagacttgtggaattttgacataattagactcgtgtaaacctgttaacctggaagacattacctatgtttcatactccctccgtcctaaattagatgtcgttttgactttttgcttgcaacgtttgaccattcgttttattttaaaaattattgtaaatataaaaaaggataagtcatatttaaagtacttttgataataaagcaagtcaaaaacaaaataaataataatttcataatcttttgaataagacgaatggccaaaagatacaaccaaaaactcaaaatgacaactattttgggacggaggtagtaagtttttttctgcagaaggtccagtgtttgtgaactcatactatcacatctgatctaggttgagtgttaactttattcgatctttggtgtgcaacttcaaccactatttttctattataatataatgataatatctaataaaattataatattgtaaaagtacttataaagtagtaaagtatacctatatgttttctacgctttcaaactatatatttttagagatgatggtcaaagtttcaaaagtttgaccgaataaagtcaacaatatcatatatttaaatacggagggagtactaaatagtccatcacctctagctctattgctgtatttccaaattccaactacttcgataaattgatggtggaaacaagtagtttatatttgtgggagcagaagtgtttttgttctcttagttccgtgatta

SEQ ID NO: 49558 - DNA, 452 bp, Oryza sativa
  unsure (1)..(452): unsure at all n locations
ccgcccccgtgatgagcttctctngcagnagcncatcagtatcttcccacacagaaaatagcttttgaccggagtccaaaattggttgaactgctttaacatccgtcccagaagaataacactgctcgcaaaaaccagaaattttctggacatacggacatacctgcgcggctggcgactgggtgcggttgcactcccgcgtaaaacacgtcacattctaacttgcttcaaacaaacgccatcatccatcggatcatcccatcttccctaagcctcggggcaccaagtagcgttcggtacagacccccatcctctcccactagctcatcgcctacgaatccccgtccgattcctgtacgcttcttgcaggcttgcagctctcaacctcctcgtcgacgccggggaagggaagcctgcgttcgggcgagcgatggagcagggaagcgagaggc

SEQ ID NO: 49559 - DNA, 440 bp, Oryza sativa
  unsure (1)..(440): unsure at all n locations
ccgcccccgtgatgagcttctctngcagnagcncatcagtatcttcccacacagaaaatagcttttgaccggagtccaaaattggttgaactgctttaacatccgtcccagaagaataacactgctcgcaaaaaccagaaattttctggacatacggacatacctgcgcggctggcgactgggtgcggttgcactcccgcgtaaaacacgtcacattctaacttgcttcaaacaaacgccatcatccatcggatcatcccatcttccctaagcctcggggcaccaagtagcgttcggtacagacccccatcctctcccactagctcatcgcctacgaatccccgtccgattcctgtacgcttcttgcaggcttgcagctctcaacctcctcgtcgacgccggggaagggaagcctgcgttcgggcgagcgatggagcagg

SEQ ID NO: 49560 - DNA, 1501 bp, Oryza sativa
ctatccctgtgttccttattactaaatgctaatacatagacttaatttcagttgttgaactcctttccaacagcctatctgttcacaacaaggaatactaggtgcaaagaagactacctaggacatgtttaggattctattgccttcttagtccaactaggtaattttcattgggaatcatgtgactttctacagcttacaccaaggtaattaaacttcagtgtcattgcacttgtgaagttcatttcattgctttcttggttttaattcccgccatcacattttatacatttagttaggaacgaagcaatgactatcacttttttgtttgtttctatatttatgcaaccgtggatatcaactaaccaagttgtggtatcttatattactacttttagagctgatgatgacctacaactgatatcatgaatttgtgactcaattatattgatgtccctaactttttttaatgttcttgaattgattctctaggaatttcatgaactcagtaactaaaaggtaattcagagcagttatttatatgtcctcaaattttatcatttggctgtagaatatgaatttgttccacaggacgaaatgcatggtataatctgagatgttctgcactaacagccgtgccagtgtcacctaattatctgtcgtttattttatattgttagcagttaaaagaattgattaagccatcatttgatatgattttttttcaattcaaaattttaataagtgagcaatctaaagggcagaagcatactcacaaatttcaaatccgataatggaatatctgtggttttcagttcttttattttataaagttagaatccacgtataacagacctttaggctcttttatcgtagcaattgtctcttactctgatgctcatgcatgtaagagcatgtgacattatcaagtttttgcttttgtaacactaacaaaaccatgttccagtttacattcaaatcggtgaatgtattgattggatttgcgtgttcattgttgagtttgtagtgaatattgaagaaatctgttgatcaaaagattttatgtttatgttgtaaaatggaaataaaaaaatgtgttctatttctttactattattttaataaaaacagaagtgaacgaggtggttttttaaaatgcgaatactaagatttgaaaaacgtgtcttgcatactagtatgttctataagggactctcattgtaatgaagtattgatagggactctaatcaggcctcctataaatcgttattgatttgtcaaaatatctctggaaaagaattactactacctgccggcgatcacaacaccgatttggacaggttttattgtttgagcacgacgcgaaatctaacaaaagctgctccacacgaacactgcttgtagaaaatgacgataaattcacaggctcacagtgcagtggcccatctctttggacggagagggccaccggagacaggaaggcagaaagaaaaaatggcga

SEQ ID NO: 49561 - DNA, 1501 bp, Oryza sativa
accggttaaacagcctgctgcaggtttttctggtctaattgaggagcactgtactaataaagcaatgtgtcagctatctagaggagaaaagaaattgaaaaaaactgagaaaaacggtgagggtaggagggttattaactgatgatacggggtagaggtgggccggttcagtttacaggattttctcgtgctacgcacgctagggaagagagcaggattgtacttttaaagtagttgtagacaaggtaataaatagcgatagtagcggactacatatagcgtattggaacttagcagccgctatagcgtttcgcgaccgctatacagtctgttattgactttgttggatctctataatgctaaaatgatgttctttacatatggatagaataacttagtacaatgtgccttctttatcttatatattaatatgttattccataatttttatgttatgaaatgtagaagtaattaagcatgcagtttaaattttaatttttaagtgaaacttgatgttaatcttgatataaaatctaaatttatggttatttttcttaattttgctattgaaacttagcgtccgcaatagcgcccgctatccgcaatccgctacccagtcactaatccgctaccaatttactatacgctatttattatcttggttgtagataaaacaaatatacatatttaagttgtaatattacgatatgatagttttagcaatcgtgcttattaaaaaccatatgtttggtatttgctactggattttaaatgccttaaaatttattaaaaaaaatacaaattacatattactaagcctaaaatcgtagcgctagactgtgtagttttcgtttattttagttgggattttgttattttatatggttttatttttacgtttatatgcttgagtatttttgcatgttttttttcatgaacagaaaatttattttctattagtctaaagaagggactttgtttaaataaaggatgagaaaggtatgttttttttaaaaaaaaaacatacaagcacctacacttccaatatacttataccttatcatcgtaatatttagcactaattttgtcacaaggctatctttttttaaaaaagagcaaaagctttgccacatatatattgatacagaagagtcacaaggctatcatgagttttatacctcacaatatatcatttcatcaacttttgtttggtcagaatttacttctataacatgatctgtttgcaaataacaaggatatccatctcaagcaaatatatgtttagttctaatttacatcagaatggtcaattttcaattcattctatgtatttcgttatgaccaacaatggttatgtagagataaacaaggtttcgtggaaataatgttgccattaaacatcaatattttcataaggtatttgtaaaaaaattaatggaaaaaaataatgcattgtgggtctagattaaccgtgtagttgtgtacaacatgcaattgtgcc

SEQ ID NO: 49562 - DNA, 191 bp, Oryza sativa
atcggctccctctgacttgcttgttccattcgaacccatcccggcttgcacacatcgacctctccccacctcctctcgaacgatccagatggccaggcgaaccccgacgccaagggcggatctactatgggcacggaggggctcaagcccccacaagcatcgttagaactatgtaagccctcactgagttt

SEQ ID NO: 49563 - DNA, 1336 bp, Oryza sativa
  unsure (1)..(1336): unsure at all n locations
atcggctccctctgacttgcttgttccattcgaacccatcccggcttgcacacatcgacctctccccacctcctctcgaacgatccagatggccaggcgaaccccgacgccaagggcggatctactatgggcacggaggggctcaagcccccacaagcatcgttagaactatgtaagccctcactgagtttcttataaaatgagggttaaaattatgtctagtttgttcagccccacgtgttacttcttctatcctccattgtcagtgtttacaactgctctttttgcatcatgggcatcttcccgtccccggtcgtgtgggcagcatttcagcaacacgagtttgtcctggaactggtactcgcccaacatagtcgccggtgatgttcgagtactacactataccgcctgctgacgctggtcgtcgtggtgttattcttggtgatggcacacgcgctctctctctctctctctctctctctctctctctctctctctctctctctctctctctctntcatgaaagcggagtgtgcatccatcaccatttgcgaagatgacctttgattattattttgtgattagaaaaaaaggctcgtgcgttgaaacgggtgaaggctattttaatcgtattattgttattttttttatctaaaaagtatatgagatttctattttgatagtattgatatctaatttagaacctttgttgggattatggtcatatactgtacgttgctttcttagggcctgacaagaattctaaagcaattagcggtactcgttccaagttagctgtgagtgttttaaaaggatttcttatacgactcctggtgcattttcaaaagtgaacgaatttaataaccaactcaaatacggacaacgtacaaagtattggcggaaacattttcaatttttataataatagagaagagatgaacaattgattttgaagataattggttttgaagattttctgatgatgaattgacctgacgatgaacaatgagttttgttagtttgggtctggtcagaccgacgtgtgttgtgcagtcaaatcggccagcccgatggtctgatcggacggctctgtgtcggttctggtttcggattgtttttttatacttgtgattaatttatgtttatgaattctagatgaatattatgcatatgtaatgctgttgtgaactaatgttaagtcaagttggagaggacttgtgctcagatattgtatcttgtttgattcatatgtaggtgtctcttaatgcctggggagagtgttactagtgattgatcgggagtcaacttggaagaagatgatgtccagacgatcagg

SEQ ID NO: 49564 - DNA, 274 bp, Oryza sativa
gagggggcctagctagctagaaatgctagagagagctggagtcctagcgcatcaagcaaggaattgtgcttgcaattattcaagtgaaagatacgcttaagggggctaatcatgatcggtcacgagaaagtcgtttataattgggaaaacatgctgatctttcggcggatttcgatggaaaattaaaaaaaacaattaaaggtaacaggaatttttcttgcgctagctttcgcatcatatccacagttgttttttgttttccttcgtacgtagg

SEQ ID NO: 49565 - DNA, 1501 bp, Oryza sativa
aaaaaaacaattaaaggtaacaggaatttttcttgcgctagctttcgcatcatatccacagttgttttttgttttccttcgtacgtaggacggtcgatcgattatcatgagcgaaagaacttaatcatgattcgtcaaatgtctccttttcggccttctaaggacatgcatgcttaagaacataagtagtacttataaaggaccatgcatatgccatatatgattattgatgtgacatcatatatatcttgcatgttttatatatgcaagtgcaagtagtggcagtgtacaacaaaactacatatactgatgatgcatgcgaagaacatattcaaaggatggcttgacctatcgatcttccaaggtacaagtctagattattgtggcagcagtaaattaaaatgtgcgtaccttacatacttaagcacccttcttttgcaaaagaacaaaataataataataataataataatgtgccgtctttcgatttgcatggagactcctacgtctctcttttagtgtgtgttaagaggatgaggtgtgatagtgtatttcaacaaccttgtttgttataaaatgttgggttaattagattcatatcattatattttttatggttttgaaatatattattactattcagctatttagagagatgttattataatttcacaactattggatatgtgccactacttacatcttctagttattttctaaattttaccttatctcaatcttaataaaattagtccgggcttttctttctcaacgatccgacaaaaaaatataatcataaaataatttacctaatatattggcgtgcaattcttttacgcgttcatgaaaaaaaaagtaaaataatttacacactagtaagtacagcggtatagttgcatacatggattcctttgcgtttttcaatatatttcacttgcaaatttgtcatagtccaaacatggagaatggacagattgtaccaaaaaaaattaagaacaatggtacatgctgatgcagagaccattagcacacaaaggggtggtggcgcagttggctagcgcgtaggtctcatagctaaaataagcgagtgatcctgaggtcgagagttcgagcctctctcaccccaccaatttggagcagtgattaatatttgctacgtaatcggttgggtcagtcacatttgcctgatctcttgattagtccatagcacatgatgagctcttccttttcagccagtggatgatactgtactaatacctgatctgacaattgatgcatgacaaattaaaatcaaaagtacttcttttttcccctttcctcagctagcgcccttgtgtggatgctactaactgatatgacaattgatggatgacaaattaaatcagattctactctccaatttgtttttaagggtctcacaattgattacacttaatggcactgattaatagcaaagataaaacaataatggtcagtatgattaaggcgctggatgccaaat

SEQ ID NO: 49566 - DNA, 1167 bp, Oryza sativa
aatatgttattagtaacttctacgcacggccacatgattcacaaaggttttttgtccaacataaacaagctaacaagatgtaaaagaaaaatactgaatacatgtgaattgatatagttctccaacatggtaaaatcgtatccagagaagaactaggtctgtcacagaaagagccgaaaccagtagtccttagagtgtgcatatatatattaaggcaacaaatattgcaacactaacctacaacacaataatgtatatacatgtaaaaggtgctacttgagctagttcctgccaataaatgctgtaggtgcacctcccaacctgcatctcaacaagcataagcagaatttttttgtactatgaaaaggaaagatctagggaaggtcaataactaaaatatcaagacatattatcgatgaaaatatggttagctttcattcccccactctatagttatatttcctttgtttagatctgattagctgccccatctgtcatctcctgattaacattttcaggttagctactataattccttaatatttacaaaaatctcatcctgagtactgatccaccagcctaagagaagtgcaacagataatagcaccacaaactcgttagcttgccatgccataatgcacagaaatgcttccctagcttagaaaaacagaagaacttaactaagagtaagcctaaaaacagaaattggtcacctatcaggaacaaacgctttgactaccaataatgattcatgaccttttcgtaaccagcaatatgcagcgacatcgacatacactgagaaatgtatctatcaaactaaactcacatccatcaatcttgacattggaggataaccccattcctaataggcttaacacatgctgctaaaaatcattctcatggatataccgcggaatgggccgcagaataatgatgtcgctatcatcaggtgttgcaactaagattcttagctaagtgctcacacacatcaagctatcttactagttggtgatagtgcttgtttcccagagagagaaaaaaaattaaagcatatgcaaatcgccgcgagaaacattccacacccagggatggcatccccaccgatcacaattcatagaacccaatccgaccaatgccatcgccctcgtacacgcgcattaggttagg

SEQ ID NO: 49567 - DNA, 1501 bp, Oryza sativa
ttttccaatcaaccgatcaataggtcaaccttcccactccaatcggctaaaactggcaccccgctccaatccacctaaaccggcattgattggttaatcattagttccgggtattcttataaccggcactgattatccgccaaagtaccggttcttaatatgacttggcactaatatcttctctagatagcgcaagagtgttttgtggagcaggaacatcatcaatgccggttttgttaaatcggtactggcgactacggttcaattgcacatatatccttagtgattaataaatatactccatccgtcttaaaatagaaaaacttctaacctttaaaatttattctaaaatataacaacttatgcattaacattttcttcctaaccaataacaacccttcaccattcaattttccctcctcttatccaatcataatctctcatcatttaattttacctactttcttaataactaataaccatattcaattataaaaatatttatattttaggattgagggagtatcttcatttacgggcattttaggtttttcacagggatatttcctcgacaacctcaacctcacgtcacgatcaacaggcaccggtgatccacagacacacagaacatatctttagtggtatacgctgccggtgcgtgaatgtcgtcgaccattcaaccgacggtatcatccaacggttgggatcgatttctaatttgcaaggactagggtctgattaaggcacagattttattagcatgtttataaaattattaatcggtgcattctatataaaaactttctacactttaaaatatcatataaattattttaaaaaattcaaaataattaaacttaatttattataatgctaatagtttttctctttgtgcccaaatacccatacttaggccgtgtttagttgttttgataaatttttttttatgtatacgatcacacatttgaattattaaatatagactagtaacaaaacaaattacagattctgcatgtaaattgcgagacgaatctattaagcctaattaatccatcattagcaaatgtttactgtagcaccacattgtcaaatcatggcgtaattaggctcgaaagatttgtctcgcaatttacaagcaaactgtgcagttggttttttttgtctacatttaatactcaatgcatgtgtcaaatatttgatgtgatggaaaagttggaagtttgaggggaaaacacgttgaccttactaatccgagctagtctatgtcgaagtctcgttccctttataactagcttagcttgctcctttcatcaccttctcatattatcaagaaaccttgcgacctccaccaactccgatcgaacaggccaattgaccatgggcggcgccggcgcccgttccggggcgcattcgccatcgttcgcctcctcgctcgggcggtgcagggttcttccagtcgtggtggtgcgtcggccggcccgtgccccgaggccgtcaccgc

SEQ ID NO: 49568 - DNA, 1501 bp, Oryza sativa
  unsure (1)..(1501): unsure at all n locations
aaggcaaaattggttatatagcatcaaaagttcacgtttttggttaaattgtggctattaggcttgggcaactaccactgtgggttagagtgccttcatcgcatggctttagatttcctggtgtgtggtttaggccctgtttgtttcagcttaagattattgtaatctagattattgagccagattattataaactagattataataagccgacatagaataagtcctggtgtgtggtttaggccttgtttgtttcagcttaagattattgtaatctagattattgagccagattactataaactagattataataagcagacatagaataagcggtttgttgtttgtttctctatattattagctgttagctacccaataatctaaaaaaagcacgtttagagtggattaccagattatagtaatctagcttatagattgtaataatctatcataataagctatatgtttgttttagcttactcataataatccagattataataatcctaaactaaatcaaacagggccttaaagaagtttatgtgaggagaggattggagaagaccgagaatagacaaaacgagacgatccattagcatataattaattaaaatattaattattatttgtaaaatggattaatacgattttttaaagcaattttcgtatagtttttttttatattaaaggtacagttcaaaagtttgagaagcgtacgcgtgaaaaactaaagatctcttctccaaatgaaggaaaatatacacctgagatcccttatcttagtcgccgagttacaaaattatccttgaaccgaaaaccagatatatggcatccctcaacttaaaaacctaggtcactctagatccttcggtgtttttgtcccctatttcacgtgacgtgacaactgaatcaacgcgggacccacacgggacccacatggtagtgactattcccctcctctgtccacctctcttcctctcttcttggtgaccagcaatgggggaggtcacacgatggttgaccaaagtcaacttgaaatttcagcgaaagctacgtcacgtaggcaccacgacagttgtaccatcgaaaaatctcgttttgtaactcagtgatttccccgaacaaacgctccccagatgtggttgtgctgatttgcagatgagggccttgcactgtgcataaaaggctcgcagcatcacacagtaacacgtaaggcctccttgtatgggcctcaatcatggcctatgtgagaaagcccaacccacacagggatcgagtcttcaatcagacacactctctttcttcccttccaaggcgaagcaacctgcaaccaaactccatataaagagcgagccggccccactctctgacgcctcctccccaccccccacccccgcgcgacgccacgccacgccaccactcgccgcagcgccgcgcccaaatcccccaaaaccctagcgcggcgagcggagggagagagagagnaggcgcgccatgg

SEQ ID NO: 49569 - DNA, 1438 bp, Oryza sativa
tagcaatagggggtaagtacaaaattaccatcacatcgagatgcagaggggctatatgcaaaatgctacatacgtggagcggtcaactctggccaaatagtggtgtggaccagctatggttgattaaaacatgatcatgaagttcaatgtgcactttcaagtttatagacataagtgacaccttcgctcaagttgaaggaccaaccataaattttactcttgatagagaattaaatgatcttccacaaaatctgtatggaattcggaagcttaaaaaggtatagatcatggatatgtatttggaaattgaatggttttagatgcattgctctaaacttaacacagataagattgataggtattggcaaccttgaatgaaccaagtatcgttgattcaaattttaccacatttattgaaaggtataattattcttgtgcttcaaggtactggttgccaaataaacaggaggggctcgtgttgctagaagtggaagcctctagcatatatctgtttgatttgcaatgttgccttccatgtttcagttttggaggcatgggaatgttaacaaaccaacataagccgtgtgacactattttttcctatcttgagtagaacattattttatcttggacaatagggccgaatggttaatacagtttccacctgaatttcgatattcaagttcgagttttgccgccaagctttctagttggacccttgaccaatatgaaatcatgtgtgtttccagtagaacacagccagcaccgtaacctagtatgaaattttgatgattgcaacgtgcagggtaatataatctcagtagaattttcaaaaaaaaaatgattatgagatgaaattgttagttacagtatactagcataatacccgtgtgttgcaacggattctaaataacattcatcgacataaattaatattctgaaccacatatcaatattggacagaaagaagtatgattaaattaaaatcctaaccatatatcacaattggactgaaggaaatataatcatggaaataacaacatgaaactacaaataactttccagaatcataattcaatatcaggaaaattatgtaactaaatatgccattttttacatttagctgtaaataattcaatattataagttacaacaatttttaatagatcaaatagtgctaaaattaataatgtaaatggaaaaacaactaaaattagcagaaactaaaaatttattttagcacatagatgaaaatttgatccattaattctgaacaggtacccttttaattgacataaattagatttttttctatacataatcctatggtctcaatattaagtaaatggtctagtagcatggttaggctaaaccagaaaagaatagtgcattagttcatagatgttggaggttgataacaaagaaaatcagaacatca

SEQ ID NO: 49570 - DNA, 1501 bp, Oryza sativa
aacaccaggaagacatggccagtacaagtgatgaattactaggaaatgcagttgagacgttgccgtcgtgctggctacggcaagcagtgggtctgcgggaggtcgtacaaaattgttcgctaccaaacggagattatcaccgcaagcagagctgtcggctcttgctaactttataggcgcacttcagagcacgccaccccacaggcacaactatgtgcttgccagtgaactgtggtgaggatataataggagaatgtaattgcatctggtagttgtctaatgaaatttaacatatgtatgaccaaatgcatgacttgttagtagcgtattaacgatggaatggtctttttctcttagagtacaagattgaatgatctggatttggtacagtttttgagtcatgaaaacaaaaaattgaaattatgcataattggaagcaaggattacggtaaatatattgcaataacttacacggtaataatctaaaaccaatgtactctaaatagcaaataaataatatgccaaattgaattcgaggttaaaatactgtgtgaccactcaacagattcagggagaaacgaaatgattgactggaccaaaaagtggttgactggctaaccgaaggagctattgctccagattagaagggcaataagtattttgtttggttctttgcgtgtctggcggcagggctcagaaaaagcattatgtggcttgtatcgccaaataagggaggtatgtgaactttcacttgattataaatgcaaaagagggttaatgatgaaaaggaaatggtggaactgggttgaaagcaatgtaaggtattctttatccaacccctctctacaaagtagcaggacacagatatgatgctttatattcccgcttgagcttcagactgccctaccataatgaccatttgttcaagtccctcttctggatttagaaagatgttgagacgtatgaacttaccaagttaataggttataacataacttagcaggttgatggcagcgaaacagtgatcggtgataggttcatgtcagaagagtgcacatcttcatcatggtcaatgatcaaaattgtttaaactaacaatggtttcagaaatcagaagttgttgaattgttcagacatcagcaagtttcaaatttgttcattgtgattcaggcttcgtgtagggattattgtttcggaatatcagtttatgtttggaagatgcagtgatgcactcagccagacacaagcataacaaatgaagcatgcaatcagtagttatttagtagtgcataatccccatatacatccaacaaaatcttcagttaactcggaattacatatccctacttccagttgaagtactgcagaagattttatacggggtaccttttaggataactttgtggagttccaaaatgaagaaaagagtcaccacttgtgttttcccatcctctctctttttgccagggatttttttgaaattacaggggtgggggtattg

SEQ ID NO: 49571 - DNA, 1501 bp, Oryza sativa
ccccaatcggttcaaagttccagacttctccaaattttcgggacaagatggtatgtcaacttatgagcacattagccgatttttagctcagtgtggtgaagcatcggctgtggacgctctgagggttaggttgttccggttatctttgtctggatcggcttttacttggttttcttctttgctgtatgggtcgatcaatagttgggccgatttggagaagcaattccacagctatttctacagtggggttcatgagatgaagttatctgacttgacagcgattaagcagcggcatgatgaacccgtgcacgagtatattcagagattcagggagatgaggaacaagtgcttcagcttgagtttaactgacgctcagttagccgatctagcctttcagggtatgattgctccgattacggagaaattctcatctgaagactttgatagcttgtcacatctgatataaaaggtaaccttgcacgagcataggtctgcggaggctaggaaaagctctaaaaggttaatcatgtttgcccttacatgtatgggtcagatgatgatgaggatgactctgagatagctacagccgaatgggtgaggagtaaaaaggtcataccgtgccaatgggtaaagagttctggaaaggaagagaagtatgattttgatattattaaagttgacaagatttttgatctgctactccgagagaagcaaattcaactccctgctggtcatacgattccatcggctgaggaattaggcaaaaagagatattgcaaatggcataattctgggtcccattctactaacgattgcaaggtgtttagacaacagattcaggtggccattgagggaggcaagattaagtttgatgattccaaaaagccgatgagggtcgatggtaacccatttcccgttaacatggtacacacagctggccgaacaaccgatacggggcgcatgaggggttatcaagtaagttcggctagaattataaacaaatatcaaaggaaatacgacaagcaacaggaaaggcatcatgaagaagataatggtggctttgatcctcattggggctgtgagttctttaggttctgttggaatgaaggtatgaggttaccatctatcgaggattgtcctggatgcagtgatgttgcagggggttcaagccgattatacgatggaggcaattggccaaaacagacaagagtgcatgtccatcagagattgggcccagtaaaccaacatggtgatttggaagatgacgaaaataagaagactcaatggtgtcctcctggtatttttacgaagaatcagaaaagaagggttcaaagattgaggagtagggaacgcttccaggaggtcgagcaagaaattaatcatcggctgaagaaagcaaaaccgaggcaggagtggcgtgttaagaatcaggctcctgtagccgacgatgttgcaactgatgaggcaaagaggttggcaaaaggaaagagtgttgtgacgg

SEQ ID NO: 49572 - DNA, 1501 bp, Oryza sativa
cctgcccaactgggatgtagaaagttttgggcatactgtagctgtcttatatagaccacagacagaagccaggttttgtgcaaacttttccatgcaggttttagcattagcagagtctttggaaaaattgtccaaattgcccatgctggataaatgccagttccgttatcgttcctatgtgtgcagtaaggacatctgtttgagtgaataatgataatgatttgaccatatttatgtggaattctaaagaagtaaaacactgcttggactaaatcctgattcattgttttcaatctgcaaaaagtctcctggtgttttcttatgttattagacataataacagtgaaacccagttcagaataatggtgaaaacccagtgcaaaaagtgtgtgaagttttgatattcttctctttatgttgttgactcagtgggcctttagacctctatatttattaacattaatgccataacagagaaaatctgatgtattttttatgaacctttcaatctttgtagtggccttcaggtagagcttgcataaaagagactctcgatgttttatactctttaagatttttttagggcaaagaaactgttttcgtgactttgacagagttacatgttgcattgcctgtctggactgacgtatcacggcaaagatgtcttgatgatgtgcgaaatcaggccgtgtttaatggactatgtctcttctacattctgcagccagtttgtttccccatgatttatcagtagggaaacattatgcagcatgctaagcagtagaatgaccaaagcatgtgctccaacagtttaaagtcagaatagcatttctttttctttttctttttgtttctagtcagcagaacaagacttgagaaaaagaaattgggtgacaattccagcaaataacacagaagctttggcatagcttgtcggtttggtgtttcactgatcatcagcgttaaattttagtagtggcattgtggtcctcacggtctcacttgaccgtgaacagcactcacttgatttgtacttttacacaagtttatatttgagttgttgtgcattggtttctagaccgtatggcggcctcacctctctgtttacatgctgttaaaaaattctgatatttcgactacaataccttacttgtactgatcctatgtatgaatatatcaattgttttcacatcctcgtaaattgatcaaattgccatttggagtgcagtgacgggctcattcctttgaaagtatgctgttcaaaagataattgtgctgtttattgtcctttcaggtttgctgtcattttctcgggaaaaaaaaaactttgctccaggttcctgcaatgtaccagtcctacaaagctgataggtcgaaggcaagaataaagaagttaattgtggaggaagcaatcaagcaacgaagagatgtacatttacagttcaccagattttccatgtttctccaaatatggcaaaagactggaatgagtgcttcggtg

SEQ ID NO: 49573 - DNA, 804 bp, Oryza sativa
cgtcccgttggatgacggcgccagccactccggcgccccaaaaaggaccatttctgggataagttttttcaggagtctatttgcgaaataagtttttcaaaaggatcaaaatgtgaaaaatccagtgtaatcgtgttgcctacttgccagcccccacgagaaaacgtcgtcttgccctatttctgggcgcagaatcgcagatagcgtggtgccgtggtggcacagggcaggcacatcaagtcatcgaggaggtcaagtcatcaaagacagagtccagctcgctctcctccatccaacgggggaggttgactgatcgcccttgtccaggtccaggctgcagtgtgccatcggagctactacgcagcttcacactcagcagtcagcacatgtaagttcacaaaacttgcagccttctgaagcaaaaactacaccgtactccctccgtcccataaaaaattaacctaatgctaaatgtagcacatcctagtactacgaatctggacatacctctgtccagatttattgtactagaatatgtgttcagttttagttttagattcgtttttctctggacgaagggagtatgtccatatatcagggtcaagcaatcctaataactgaactaaactgcacatagattttaatattttacttgcactgtttgatcacttaaaaaattgtgcaaatataaaaatgaaaagttgtgcttaaggtattttggataataaagtaagtcaaaaaaaataaataataattctaatattttttaaataagacgaatggtcaaacagtacaagcaaaata

SEQ ID NO: 49574 - DNA, 1501 bp, Oryza sativa
aattttaattaatctcatattgggttcttatatggattattctttcaatgttgcttatttttaattccgaatttcagctaattttaaattgtattactacttgagctcttcttttattttcttttactaatttcggatttatttctatttttattctgaatttaattaatctcgtattgagttcttatatggactcttcttttaatattccttatttttaattttgaatttcagctatttttaaattgtattcctacttggaatctcctttccttttctaattttggattttattttatttttatttcgaattttgattaatctcgtattgtgttcttatatggaaacttctttcaatattgcttatttttaattccgaatttcagttaattttaaattgtattcctacttggactctccttttattttcttttgctaattttggttttatttttatttttattctgaattttaattaatctcgtattcggttcttctatggactatcttttaatattccttatttttagttccgaattttagctatttttaaattgtattcctacttggactctcctttccttttcttattttggattttattttatttttatttttatttttaattaatctcgtattgggttcttatatggaaacttcttttaatattgcttatttttaatttcgaatttcaactattttaaaattgtattcctacttacactctcctttcctttaataattttggattttattttatttttatttcggattttgattaatctcgtattgggttcttatatggaaatttctttcaatattgcttatttttaattccgaatttcagctattttaaaattgtatttctacttggactctccttttctttttctccgattaatgtgggaatttctaacccccacagcgaacgtggtgtctcctttcaaagctgttttaataacataatagatagatacccgcgcaattgcgcggctagcaccgatataaaattatctaatttttaatatagttttacttaaaattttgttaaatagatatctcgttgtcttaagactttgaaaaaccaaaccttatcatccctgtgtttctagttttattttttaaaaagttatatcagttgcaaatcctaaattctttgtcacccctcatttatttgctttctcgatcaccactacgtctatttgttctcactaaaaacctctaaaaattagacttatagtttttagagtttattgtctcgtttgggttttgtttttataattttcagaagtctcatcaaatgctgccactatactactctacggtccatccactgcctcttctctttattttcattgggattttaaaaatcaaacgtaattaccatttgggttctttttttactttctagaagttccaccaagctgtcagcacctttaccactgtacacatgtactgctcgcccgctgccccctctttattgtctttgagattttaaaat

SEQ ID NO: 49575 - DNA, 1501 bp, Oryza sativa
tacgtggaaagttcaaatgagagctaattatcatgttcatgttcacacttgattgcgaacattattgaattttctgatatttctacgacacgcaattgctacattgctataagggatacaaagataatacctgtgaatcgtgcacaccgagaaaatggcatgaaatattcactcgagtattactgcaacagtttattaattttgaaatgttttttttacgtgtgttgtgaacggggcctgaagtatggatacccttagccatagtccaactctaatgtgcaatcgaagtattcaccacaagtcgagacaaacaatgtataaattgatcatgggacacaatgacaaggaaaaaagaactactatcttcatcctaaaatatactactaagacatactcctactcctagtactacgaatctggataaactcttagtctagattcgtagtactataatatgtcctatccaacctaaattctttatattttgtgatggagggagtaaaaatttcatttcttattcagatggagcagagtctaatagacagacatcattaatagaataatttcaagaaagaaaaagacaataaaataatttccaattcagatgattccactcgaaaatatggtagtactataatttttcattaaacagtagtccctccatctgcttttgatagtcatatttccaaatctgaaaaaattatttttgataggcatatttcaatccaacaacctatcatcttaatgactttctcggatttaatgcatgactcttcattcttccacacatgattggctacatgggcattgaaaaatgtaaatattaatgaatcgcttgtttacgagaaatgactagtagcatgtttaaatagatgataagtagaattacttatcattggtctgtgtgccaagatgaaatatgactatcaaacatagatggagggagtagcaatttaactcgacgccgttgatttgatttgtttttttatgggactaagaaaatacaccgaagatggcattaggtcaataggccttgggggctagggagtggatgccccactcttgtttccgatctggccgacggtatgccatccgacggagcagatgcgctcgaggactcggcctcgagcgcccaaccgccgattcgaaattcaaacagccggggaacgacaaagcggtggatggaaaagccgttggctcgagccgaccgttggctgcctcccctaccccacctgtcagacaaccccaccgccgcttcgcttcactctcgcgttcgagtcacacagcagcagagttgaacgacgcgtccgcatcgagccgcagatctttctaccgccaccgatgggcagcggcgaatccacggcggcggcggcggcgacgatggcgtggccgcgctggcgccgccgccacggctggcagctccccctccaccctctccaggtccccccgccgcttctctcccacctttcttccccccggattggattctttgaggtgacgg

SEQ ID NO: 49576 - DNA, 1501 bp, Oryza sativa
aaaataataaaataatgcctcgagtgtccagcagctaattaccatatttttacagtgtccacaagcaaatacacaatttttgggtgtctcacagcaaatgccacaatctttgagtgtcctgtagcaaattttgcatttacttttgtagttacaacacttattcgatagaagctctttgtgttgaagatagttttagcaatgcgtgtgatcccattgatatgggcgaccaaaggcctttgatcaacatcttttacagaacatgattcatccaagctctgtaaatgtgtaaagaaaaagcaaaggacatcttcaccatccagtgactaatgatgattgtagttttcagatttgtttgtgtggcaaattttgttgggtgcatctagctagatatagctattacggttcttggtcctctttctgttatattaaattgagaatgaaaagcttgtctcttcgagtttcttagcgattgtgtttaggaggaactattaaaagatgaggtaattcaaattctattactgcaaagcaacaatttagtttgttctctgatgttagtatttagggcaattaggggaaaattcagtagataataaagaaagttatgtaacaaattgttgtggcaaaagaaacagagttttcaggccagccattggctctgccaatcagtgagaaagcaagtgattacagatctagagatgaccgagcggtgagggcagggtcgagcgggcgaacatgatctcgcgggagggtggggttggaagtttcctaggggcccaccttttaatatttaggaagcctattttagctaatcttttggaggaatgaaaattttaacacttcaaattttgtttaggattcgtaaaactaaaagtttggggataaaattttaggatgtacttagtgatactctcacatagacacacttttatcttatataagttaaaagagcctcatcggccatgcaaatccaacggccccagcatattcacaaataaaaaataatttgtgaataaaacttttatatacgtgttcttagcgatctaaaagcaaagactgaaaaatattaaaaaacaccaaaatcaactccaaattttaggttcaaaattcaaattttggctgataagtataaacataagcgaaaagatgatgtatcaaacattgttctttacctactccctccatctcaaacaacgatgctagaaactggatgtgacatatcgtcctggatgtgacatatcgtctgtgcagatttgttctactgagatatatcaatgtcatgttcagtactacttatattttgtttctttttaccgagaagtagcccttacccagtcaacagtgattatttattggagtacgattgagacccttggtacgacaacagtagaacaggacgacgcgctcgttcatataggccacaaatcgcagtaagctttgtgaagtgcacgatagcgtcgtccgttgtgtgactcatcagatcgagcagagccatacatggcca

SEQ ID NO: 49577 - DNA, 633 bp, Oryza sativa
cgggtggagctcggggcggagatgatgaccgacggtgaggcagttcgatgagcgccatatctgctcttctacaagggccccaaggtctgttcgtcccaggtcgatgctaaggaatctgaccacctatgttgctttcttgccgctgccatcaagacaccaagtcgagcttcaagaagggcgtgagtgttttccccttttttcctgagataagctgattagttgctttcatgtcatattactgagcttgttgaagttcttttttttctatttagatttttgtatagtgcaaactgcttggtggtgtgtcactgaggttcctacagacgtactggatggatgcagatgtggtaacagccttcgagctaagccgggccatcgacgatggagtgctgcagcctttgccctttggttcgctgacatgctgttccttctatgtgaggttgccagtaccacggactcgccgtcagcactgtgcaacgtcatccttctgcgctagactgactccaccctctgctgagtgaggtgatgctaatcactcattgccctacaagtgtttgttgaaatgcatgctctgtgttgtgacttgtgcagttgtgctaatgatggatttttcctggtgacgattgatgcaga

SEQ ID NO: 49578 - DNA, 1501 bp, Oryza sativa
  unsure (1)..(1501): unsure at all n locations
tatataaaaatatttattgaaaagtgatatatgtatatttttatgaaagtatttttcaggacaaatctattcatataatttttttatattttcaaactcgacaacttgagagttacccattatttatattcccaaggtttgacttaaacattgtcctaaacgacttcctttacgagtacggagggagtacgataattgctttaagaaaaactgtcccagagtttttaggtgactataacataatattagtgtaactataccataattgtaatgcgagtgaagtataattgtaatatattgtaagagtaaatttaactacatatgctttgatcaaattatcgcaaaactaagcccctgtttgttttagcttaggattattataatcgggatatttaggagtaaactgaaacatacatatagcttatttgatagattattacaatctataagacatattagtataatatagtaatccactctaaaagtgttttttttagattattgggttgctaacacctaacaaccagctaataatctagagaaacaaacaactaacaacttattatatgtcagcttattataatccagcttatagtaatctgtctcaataatctaaattacaataatgttaagctgaaacaaacaggacctaaggaattatcgtgttatcacacaactataaatttaacatgagatttcttacaaaggctaaaaatttaaaacataatgtcaaaaatagatattaggggttgggtttggtttgagcctatattggccttactaatatttggcaattttaatagtgtttattttctatttggtttggagccaaattttggcatgcgtaagaaaataggccatttcaacagttaatttaggctatttcggcttcaatccaaacacaatttttcctttgccaaaattagccatgccaaaagttgncaaaatttaacantnacaaaaantggtaagnncnanntagnnnncnaaccaaaccagccctaggtgacaatttatcacaaaactataggtttagtgtcaatttaatcacaaaactataatgtttatagctccaacataatggtagtatcatttaaattctattgtgacttgatttatcgtcaaatgttcatttaagtatggcttaatttttttatatttacataaaagttttgaataagaagagtaatcaaatgtttattaaaaagtaataacgtcatatattaaaaaagacgtctttagcacatagctatattaaaaaagtatatttttgtctttacaaatttgttgctagaatatgtcacaccccaatccggcaccgccgcacaacggcacctgataggagcgtgtcgtaggaaaaacggcgcgaatcgcttcctacgaaaccgcgatctcggtaccagtcccaggacatagtgctggtacccacggtgacaaatatgaatcattgcaaatccttaaaatagatagaggacttatttaccttaacttaggttgcagc

SEQ ID NO: 49579 - DNA, 991 bp, Oryza sativa
ctttaatgtctgacattttttagtttaaacattaagaaaaacaaacagagtagttatttaggtaaaaaataatcttattgtactgctcattgaaaatgtaattgagcccactatggtgctctatactataaaagtagaaatcaatatgatctattatctattttgatcgatgggttatctattcgtactattatcctaattaacggtaatagaaacatggaggaacattattataaaaaatcgtaatttagtagtgactaaacattttttttctcttttatatatatatatatgggggaaaaggtaaattaacttgtgctacatggagtatgggatccaagattcaaattgagtatatacccaatttgaatgagtatgaattttttttaaatgtttagatatgaacattaacttctttactaacaaggagtttgaacttttttttttgttagattttgattctaggtatataacatccaaacatataatttgttaggtatgtaataatgaattgtgaaacaaagttgagtttgagttgttttgttgttaggtatttgtatgaatcaaattcatatacctgatatctacttacaatttgtaaatttttaaaaatttgagagaatttgtgtgttttataccttggagcctgggcaccatgtctcccaggtgtacgtactcccggttgcatccatcgtccatctgtagcaggcgacgatcgaggcatcgagccaattatcggatccatccaccgaacccgttttgattttttttcacgaaaaaatattcagtaatcgttaatttttccaagactaatcggtgaaattcagcaagaaaccgatatatatccctgattcccagcaagaaatggcaacaactcgttctccccacccaatttacggatctagcgcgatttactggcggctcagaggtagggatgaaactggtttggatagtttccgtccgtccggatcatttttcggattcggatagt

SEQ ID NO: 49580 - DNA, 296 bp, Oryza sativa
tgcatcagaatgtcagtataaattgtcctatatgcatgcaaaatcaacttgaccccaactgcaaagcctgatcttcaccatcatcagcagttcagtacatgtacggatatcgtggtttgcagtaaacaatatactagtacatttctgaattttgcaaactggtcagtatattaattaatcattatacaccatgattagaagtcctttgggaggacagaaactcacaagaattgcaagaaaggctgcccctgtggctatgcacagtactacgttgtttgttccaatcttttttcaga

SEQ ID NO: 49581 - DNA, 1501 bp, Oryza sativa
agcaggagttgagcttctcggacggtgacagctgcggctctgccacctcccacaggtcctccaccctgtgcccgatctccgcctccgggggttctccattgatggagataagtaggttgagaggtggtgcgggcgacaaacctggaagcgcggcttgtctcgtttattacctgtggcttcgagggacgacggtggctgctcgaactgctccatccgtgctcgcaccttcgtggccagcgtcgatctgctccacccgaggccgccccttccatgtggtcgggggacacggatctgaccgccccctcgccggatccgaacgccggcagcccgataaggcggtcgacagcagcggaggttgtgcgctcagcgacggtaacggcgtgccgcacgggaggtggccggtaacagcggaggcggcagtggcgcgaggcggacacggagcggagatggagacggcgacggcggtggtcggaaacggaggcggcgaacggtggactggcggcgggagagggaggcggaggtgttggacacggcgacgcgatggcggtgttgacgctttttcatggccaacacaagatcacctaacgacttgcggtgtaaacaatagagtcgccaaaatcgatagatcaaaatcggctagtgaaaccgatttcgagattaattcactttcgcggaatcacatgactaatttacaagcaaattagcaaagaggataaatatcgtacttacgtgacgacgaacgactagtttccgagcaaactagcaaaggataatcttctcgctttcgtggagaagcacgaccgtttttcagcgcaaaacggcaaagattaactaaattctagggatgccagaacttagccataaaaacaaaatagaaaataacatgaaagtaaagaacaggaaaataatagattggtaattttgttcggggcccttcaaaactaacctaatacactaatatttataggagcaccagaacccccagccgcaccgcttgagcgtacatggaaactccaacaaattagctaacagaatccgactccatctaaatattaacaaacggaatatatagttctcatgcaatctactaatgccagtcctccagtcccgtgcggcaacagcagcacatctcggcaaattaatcatcaatcaagcattgatccccgtcgccaaatctctcctaggctgcatccatgtgacaagtccaaaccaaataaattgctgctgcacccagcattatacacaaatcatccaagcagggcatcacaaattcctgcacacatatatatttcagaactctcgagcaaacctctagataaatgtaccaactcctctaaataatttggcctgctcagataaactaattttaagccaaattatggtacaaacaggcggcgacggtggcgacggaggtggaggctgtagctacagtcttctctgctgtgctgtagagaggaactggatccaccacatctacgtcctgctccggccggagatgtca

SEQ ID NO: 49582 - DNA, 772 bp, Oryza sativa
gtactggcgaagaaattgacaaatagacaacccaaaatacaattaattggggctggatggtagtaggtgcatgcgttggctacacttggggtgggtcggtgtattggaggtggggatagtactgtgtgtaggaaggacaaaagaagcgtgcatgcgtggggatcaatgtattgaaacaagtatctagaatacagcaagtacatactacggggtgggtgtatgtatcatccctgcataccatcaccaccacaccacgttctacccggagccctgcctatctatcaaccttagccataggtatcgccatcgtctcgtctcctccggggaccatgcatgcaagtttgcaacctccatcgatggaggtatcgcttctctctctctctctctatctatctatctatctatctctctaagctataagcttaggagtatagtgtgtactatggctaatatacggggtatatatcatcgcaaaacatagcatgtattattgcatgattaattaagtaataactaatatttttaaaaaaatagattaatatgtttttaaacaactttcgtatattttttttataaattaaaaacacattgtttagtagattgaaaaacatgcgcgtggaaaatgatcgagagaggtgagttggaaaaactaagagaagaacactagtagagcaagtttaatagtatagcccactaatagctctaattcatctatagccaatctaatagcactggtggagaaactgtctttactcccggtttataacccccc

SEQ ID NO: 49583 - DNA, 1501 bp, Oryza sativa
ctagagaaccgccggtagcacctttgtcactcagttgagccgagccatctggagcttgtttcccgtcttcacctttggaagaactggtcctaggatcattggcaactacctttactttatacttctgaactaatgttcccttgcgggtctgcatgaatgagtttaagaactgatcccgggctttctgcaacattgcttcaaaatccttcttctgctcaggtgtgaatttctctggatcgatgggcacgacgtttccttcattgacgtcagtcaaccccaacttctggatcttttctttaacaaggcttgggctagtcgaggatggcgacagcggtggcttctcggccatgaggaagaattgcttgctgacttctaatcggtcccaccaggagtgccaaaagcgtgttgaaagaaaacacggggcctgtgagatctgcttaactccagtgcaggtccaaagctcgccttcgactccaccttgatctaatctcctttttcgatgctaatattaccaaatttggtcgttaacactatgacaatacatgtcatgcatatatcatcgttactttcgtatttgaaaatatttttatatgatgttaagtcatagctgataatatgttagaaatgaaagttgttgataatatgtcatgaataaaaccaatgggtcaaggtatactcttagacaccgtgtagaaaaaactaatacttctatgttttacgcaatttagaacggaggaagtaaccagaaatccatggcgcagcgaagtggccgaccttcatgaatcgtcaaatttgaatgatgctaacctgttctaaaggagaattttgctgtgagcctgtgatacgagaattttgctccagttctaaaggagattgaactattttcttggaaattccacataaattaagtgaaatcaggcgaaaaatgtgcgtgatgtgttctttcttgtgggtttccaacaaggtaataaatagcgtatagcgggttgttagcggattagtgtctgtatagcggattgcgaatagcggacgctattacggacgctaagttccaatagcaaatataagaaaataaccataaatatatctatattaacatcaatttcacgtaaaaattagaatttataatacattttttattactcatatatttcataacataaaaaatataaaataacatatagatatataagataaataagataaataatgaaaagttctacaatccatatatgaaaaacaacatttaagcgttatagcggtccaacaaagtcaatagcggactgttatagctatcgtgaagcgctataatagactaatatagcgggcgctaagttacaacatgctatcttcagtccgctaccttgtagcagcagcggtagaggtccgctaccgctattgtggccgctactgcggccgctacgaacgttatttattagcttggtttctaacccatttccctcgttttccgcgtgcatatttttcaaacggttaaacggta

SEQ ID NO: 49584 - DNA, 1501 bp, Oryza sativa
agtgatgtgatcatgtgagtacttgatggattggtctgtttggttggttggttaggattctttgctgaagcccgtcacgaaggtgatgattggtgtggcagctatgacagcagttgctgcagtattgctgaaggagggcaagatgcccgagtggcttaaggaatccaagctcggcaatctgaacttcccaccatgggtactggcttgcatggtcattgtgttcatgaggctccggaagagaaccaaggatgccatgaaaaagtttggctggtcttcatgaggtaccaaaagttttaccccttttccccagatttgtgatcgaacagtttccaatttggttttaatctcttgtgagtatagcatgatgcacaaacggttactaccaaaactcagtgctgttctatatgtgcagtagtataatgaatgaaacttgtaggtagttgtgacatggttattctagaatgttaagtgtgctttaaggtttcttgtactataacagcatagtttattaatcgtcgtatcatggcagtgttattttttctattctacaaagcatatatagacaaaaatacccactactcctgagttttgattattaaacagaataactatccgctcctagttacccctctccagtctccaaagcgtgtcgttttggacatatatctcatcaaacttttgaaactttgaatatcaatacatttttaatatttagatttgatacatggaaataatgtgcatatttgtctcttaagtactctatgatactataatatctatcaacatttgtaaatatattcaaaatttgcaatagaaattagtggtgaaagatgcattttgataccatgtcaatgttccaaacatgttttcgcaaccagacggagcattacaacacaaaacctccgtagagtactaattagtctattcaaaacattattcatgtatcatgagttcttggcgaaagggcatgtagtctagtagttacagtgacctgagtaacaccccaaggtcctgagttcaaattttaataggagcgaatttcagattgggttgtttgaggagctaagttcccaatttaaatggttgcatatatctggttggatgtagaggccgggtaaaaaatacccatctctaaaaaaagagtatcatgagttcttgtcattcataatttctgctgaaatatacttataggctgttcctagaggaaccaaagtaagtatgtcacgcatgtgcttccgcctcattcattgtattattaggatatgggaaactaactgcatctctgagttcttttactgaattttatctaagctgtatttcaatattccacaggttcgtaatgacaaatgtgtgtttttggctgctgcttcaaatttgttgccaatactggagatgtaccaagcgggtgacacgctaagtgaagaactattacacaaaaaacactagttttaccctttatttgcatactcgatgccggaaactcgatagatttttacttgta

SEQ ID NO: 49585 - DNA, 1501 bp, Oryza sativa
tttggagaaacatggaaaatctggtgaactgtaaatgtacatctcttcgttgcttgattgcttcctccacaattaacttctttattcttgccttcgacctatcagctttgtaggactggtacattgcaggaacctggagcaaagttttttttttcccgagaaaatgacagcaaacctgaaaggacaataaacagcacaattatcttttgaacagcatactttcaaaggaatgagcccgtcactgcactccaaatggcaatttgatcaatttacgaggatgtgaaaacaattgatatattcatacataggatcagtacaagtaaggtattgtagtcgaaatatcagaattttttaacagcatgtaaacagagaggtgaggccgccatacggtctagaaaccaatgcacaacaactcaaatataaacttgtgtaaaagtacaaatcaagtgagtgctgttcacggtcaagtgagaccgtgaggaccacaatgccactactaaaatttaacgctgatgatcagtgaaacaccaaaccgacaagctatgccaaagcttctgtgttatttgctggaattgtcacccaatttctttttctcaagtcttgttctgctgactagaaacaaaaagaaaaagaaaaagaaatgctattctgactttaaactgttggagcacatgctttggtcattctactgcttagcatgctgcataatgtttccctactgataaatcatggggaaacaaactggctgcagaatgtagaagagacatagtccattaaacacggcctgatttcgcacatcatcaagacatctttgccgtgatacgtcagtccagacaggcaatgcaacatgtaactctgtcaaagtcacgaaaacagtttctttgccctaaaaaaatcttaaagagtataaaacatcgagagtctcttttatgcaagctctacctgaaggccactacaaagattgaaaggttcataaaaaatacatcagattttctctgttatggcattaatgttaataaatatagaggtctaaaggcccactgagtcaacaacataaagagaagaatatcaaaacttcacacactttttgcactgggttttcaccattattctgaactgggtttcactgttattatgtctaataacataagaaaacaccaggagactttttgcagattgaaaacaatgaatcaggatttagtccaagcagtgttttacttctttagaattccacataaatatggtcaaatcattatcattattcactcaaacagatgtccttactgcacacataggaacgataacggaactggcatttatccagcatgggcaatttggacaatttttccaaagactctgctaatgctaaaacctgcatggaaaagtttgcacaaaacctggcttctgtctgtggtctatataagacagctacagtatgcccaaaactttctacatcccagttgggcaggagagttggagtgttcttcaggttcatccatta

SEQ ID NO: 49586 - DNA, 1501 bp, Oryza sativa
aacatgtgcaattttttaagtcattgtagaatgtattgattttagaggattaagaaatacccaagctcacaatatggctagttagttctgaacgcgcaaagatgtagcctagaggggggggatgaataggctttcctgaaaattacaaacaaatcgcagcggtaaaattcaacaggctcggaacctccaggtgtagaacaccggaacttccgggttgtctgaacagaccggaacttccgaaaaacctaataaactaacagggacttgagctgattttgacgagatgaactacgtgataatagagcagtagcacaatcacagtagcatgcacagaaacatcacagaggagaaaaagacgattttttcccgaagttcagattttgcaatcctactcttcgttgaggtgctccaaggagccgggtctcgattaaccctttgcttcacttatgcaaagatcctagaagaagtccacggccttcaactcaacacccctagcttattttcaagaattgagtgaccaccaagatccaactcacaattccttctagagaagaccacaagtacaagttgctctacctaggacaacctctgaaaactcagcacaagaatctttactcacttacctcgtttccttgcggaggtgaggagtaccttcacaaactttcctgggacatccacaagatctttggaagctcagggtgacacctaaccgtctaggagaagatctccaagagtaataagcccaagtcacagcccacaagatatccaaagtgctcaatcaaacctaatcttcaaaccttctccaaatcactcatgcactctcatctattctctcaatctcacaagataggctctagatttgagtggaggaagcaaatggatcttgggagaggctagaaaaccctagggcatgaaagaactgaagtgaaatggccaaagggtgagctggggacgatctggatatatataatggctaggtgatgtcatctagccgttactcacatttttgaactggaaagggtccggaacttcctgaccaccggaagttccggtcaacacttaggaaaatttcgccacacaaggtccggaacttccggctagccatctctgtccggggtagggctatttccaaaaatagcccccaaaaatattttagcacttggatctcactaagagcacttgttgtatcccagaaccacaccttgaacccctcttaatagtacggtttttcctaaaactcgattgcaaatattacactatcctatgcacccttcgagctccaactccgcttgcatgtttgttgggggggggggggtctcgatcacttacaaacatcttgggactaaacacctgagtatcctcaataaaactcattagtcccttaaccctatttgtcattaatcaccaaaacccactagggggataaatgcaacttcaagttctaataaaaaacaatataggatggtcttaggaagataaaatggatcatctaacaaagtgt

SEQ ID NO: 49587 - DNA, 1501 bp, Oryza sativa
tgtgtgtagaaaagttttgatgtgatggaaaagttgaaagtttgaaaaaaaaagtttggaactaaacacggtgttagtcaaacttgaagctatttgattttggctaaagtcaaaacatcttataatacatgtgttactgtacggtaactggtattagtcggtttctgtatggtattgattgaaaattcatcgggttttacctttttctcttgggttttccgtaatccggtgaactcgtacgaagaacagtcggactcggtgggacccacttaaaacaaacgagcggtgggtttagcactttagcctttagccgctcctcctccgatccgtctcggctctgcgatcttaatttccccgcgccgccgccgccgacgccgccgccgatctcgcgcgccgccgctcccgccgttcccggcgaacgtcgcgcctgatacttctcgagagcctcgatcgccccaggctccttccccctcttgggagattcatcgttttgtactaagcagcggccatatggagatactggaggtgcccgtccagccgccgccgcgaataggtaagcctcctcctgtcccccacccctcgtagctgatcaaatcacccgctagatttaggttcgattacctgttgttcctttggaagggctcccacggcttccctggtgggtaaaatcaatcaaactggttggattcagccgcttcggcggattcttctaactagctaggttcaaatctcaagtgcacatttgttctgcacttctctgcatcatcaggtggcctaaatctcaagtgactttgctcaaattttgatttcaatgatgattctctgattttctatgttagttgaaaacccttatttaattaggtcccttctccttctttttccgattaagatatttccgttgggcacgcttttcaaactattatatttcgtactgaaactttttatgcagaatagaagttgcattaatatcagataaatatttttttaattttaaaataattaaaacttaattaatcatgagctaatggttttcttgttttaagtgcccgtacttaatcttcatatttagtaatctcaagcacaaaaatatgtctttgttgtattatagttatctttaaattatgtccaactatccatctttggtatatgcgtgcaaacaaaatgctcccttctgcatcatgacctagttagttgcaggtaatggagctacttcttcagcttctgaaatagacaactccccttgtcaatgtggcgatgattctcaatctgccagtacagtggaatccaagatgcagcttccagaggtacggaactcagcagtgcatccatgttcaatttgaaaatgttcttttagcatattgatagtttcctctactattcattcccaaaaagcagtatgccagttattattatagtggtaataaaacattttctaatgtttttatcctctcctgttggcttgtgcaggacatcctttatcacatacacactctcatgccta

SEQ ID NO: 49588 - DNA, 1085 bp, Oryza sativa
cctcgcaggtgccgttgaccccttccggctagccggcgaggcgggcggcggcgcggtggggtggtggcggcggggatcgcgcgaggacggggtggcggcggcgtgcgatatgaatcggtggggaggaggagaggagttaggttaaaagggtctgcacgaatcttaaagcatatccaatggtccaaaattcgaatgatatggggtgggattttctgtcacaatatgtataaacagcccaaaaaaaatagcagccgaacagaagcttaatttaaaacaaaagaatgcaactacgtggcgctcgttaaattcttagcatacatgagttctggaggaaaacaacaccaaaaacactattcatctcttaaggaagtaatttgataatttctatgttttttcgcatggagctagcatccaaatagttgttcattgtttgctatcggtcgggcgcctacaatattgcaatttgtcagtctatcatcgttggatacgcatcaagatccatgcacaaaaccaggcttggcctgatgcaatgagtaacgggctgcatctgccctggcccgttaagccgtgggccatcaatttttttggataatggatttttcattaatttggcctctatatccatatatatccgtaaagaatatacatagccaaaaacatacacaagggcaatacacacaaacacacacaaaaaaaaaaaagctagaagacttagcttcaaccttcatcgatgacttattctattcatcccagcatgagaggggtatgaggagaaacaaaactagtttgtgctactcgtcgccgcaccatctccacctctatggaactcaaccataaactgctgcaaactgctatgtccgctttccaccgtcgccatccaaaaacccccttatgcagttgttgcattttgaacgcctatagagtaccacgaagccgcttgccgtcccaccaccatcttccgtggactatcaaactcaccgtagctcctagagcatcatggaaccatccagcatgatatacaccttgtctttactgtcatgagctttgccgaagatgcaccgctaccattcacatctatccgcagc

SEQ ID NO: 49589 - DNA, 1501 bp, Oryza sativa
gtctctatatacaaccaaattaaaatcaagttttcttaaattatttactaaatggtcgtgtttctagaaaacaaattacatttccagattctttgatggcctccacgagcttcagctggaacatgaggttgtgtctgcagaagtggacgcgggacatgacatctccggccggagcaggacgtagatgtggtggatccagttcctctctacagcacagcagagaagactgtagctacagcctccacctccgtcgccaccgtcgccgcctgtttgtaccataatttggcttaaaattagtttatctgagcaggccaaattatttagaggagttggtacatttatctagaggtttgctcgagagttctgaaatatatatgtgtgcaggaatttgtgatgccctgcttggatgatttgtgtataatgctgggtgcagcagcaatttatttggtttggacttgtcacatggatgcagcctaggagagatttggcgacggggatcaatgcttgattgatgattaatttgccgagatgtgctgctgttgccgcacgggactggaggactggcattagtagattgcatgagaactatatattccgtttgttaatatttagatggagtcggattctgttagctaatttgttggagtttccatgtacgctcaagcggtgcggctgggggttctggtgctcctataaatattagtgtattaggttagttttgaagggccccgaacaaaattaccaatctattattttcctgttctttactttcatgttattttctattttgtttttatggctaagttctggcatccctagaatttagttaatctttgccgttttgcgctgaaaaacggtcgtgcttctccacgaaagcgagaagattatcctttgctagtttgctcggaaactagtcgttcgtcgtcacgtaagtacgatatttatcctctttgctaatttgcttgtaaattagtcatgtgattccgcgaaagtgaattaatctcgaaatcggtttcactagccgattttgatctatcgattttggcgactctattgtttacaccgcaagtcgttaggtgatcttgtgttggccatgaaaaagcgtcaacaccgccatcgcgtcgccgtgtccaacacctccgcctccctctcccgccgccagtccaccgttcgccgcctccgtttccgaccaccgccgtcgccgtctccatctccgctccgtgtccgcctcgcgccactgccgcctccgctgttaccggccacctcccgtgcggcacgccgttaccgtcgctgagcgcacaacctccgctgctgtcgaccgccttatcgggctgccggcgttcggatccggcgagggggcggtcagatccgtgtcccccgaccacatggaaggggcggcctcgggtggagcagatcgacgctggccacgaaggtgcgagcacggatggagcagttcgagcagccaccgtcgtccctcgaagccacaggtaataaacgagac

SEQ ID NO: 49590 - DNA, 1501 bp, Oryza sativa
accgaatatagtaggaatccaactattggcgatgcgatgattctccttggggcttaccaaattttggcgttaacacatgccccccagttttggagtatgaaaactcatgcttcaaaattatcttatttcttgtcttgataactccaaaactgatcttcctttgcttcttgcaatcggctttcatgagctaggactttttgcattagatgagccaggctgccaaacttgtggcaaaagaatctctcttatagatgctgataatccttggaatccgagatctgctagtttctcatcacttaggctcaaaccataacatcggctgcggacattacgaaatctttgaatatattccatagccaattctccttcttgctgctcaaccgatattaagtctgaaagcttcaattcatcgattctagcaaagaaatactcgtggaattgcttctcaagatcggcccatccttggatagaatctgatggtagtgatgaaacccacgtgaaggccgatccagtcaaagacaatggaaaaaatctaacttttagagtttcttcaaccgatgcctctccacattgtgctaagaatcagctgatgttccattgtagacatatcatcttgccctgaaaacttggagaaatctagaaccttgtatcggtgtggcaatggaaccctatcaaaccactcaggatatggcagccgatacacaaaagtatgttccttaggtttgattccaaactgctcctctatcatctttgcaattctatcggccaaatcatcattatattgatattcttcaccatgcccatactgatgaagttcctctgaccgatattcatatgactcatcatactgctattgatatgcttgccccccgagccgatattgttgctgctgatgatgctgaagttgttcaccgatttgccccccaagttgatttctttgagcaactatttcaggaactatcttcttgatcacatcttgtagtgtatgcatcaaaaccccagactgatcaaacaaggcacgatgaactgtttcattaaatttatcttgagatgtttcaaccatcggctcaggagattgcccctccatggcattgacttcctcctcaaacatgttgggtgcaaaattcgcgtcccaccaggcgtgccaaagaagtgttgacgcgaaaaacacacattggcctgggagatctgcttagctccagtgcaggtccaaaggtttatgatatgtgggcgtgctaatcagtttgatcctgcaactgataagatatgcaaacaatagatcaaatagccgatcggctaacaagccaatggagtagtcccagccgatgccgattccagccgatgtcgatagggttttgagcaatcacctatatgtccaatgtagataatgatataaagacaatctgctagtgataataagatataacaataatataatcctagtagagaccaattggctaacaatgacaagatagaataagcactgatccgaaggttaaag

SEQ ID NO: 49591 - DNA, 1501 bp, Oryza sativa
ccttcaagaatctagaaggatggtactacgagtgcggagatcggctaccgtcttcttcacctccggtcgccgtcgccattgtcgatttcgcctcctccggtgaaccattgtccgattcttcgcgtatacaccatccctgggacctcactaaccccatgaaaacacatgcatgtcaattcgatgagtggatcgagccgttgccgtcttcccggagctctacaccgtcgccggaccatcttcttcaccgttgccgcagtccagactttcccgcgtctcgttcaaggttcggtgagcacccttgagcccataggattgcattcatgcatttcattcacttagaatcgagcaccaactcaacaagcaatagcagcctaagcacagccgccgctcggactcgccgccggcgttactccgatgtccactgaccgataaaagtagaggaatggaatcgcaatagcatgatcttcattttgtcttttggtcgcaccctcaaacgagccaccgtttgccgctggcaaacttgaaatcgagctcagccatggcttgatctgcttcagctcgaaccagggacctcctcacaagaatttaggttaatgtagggtcctttatgcaaaagctcatgacacacagaacaggcataggactgcggtttgatttcctgaaaccctaggggccttttgcatattggcatgagaccgacaggtggaccccataagtttaaaatctgaaaatgtaaaagataatactaaaagcctttactttttaacagcaaaacacctaaacttgtaaaatccatataaaatcaaatataacttattttgagatgattcaaatttctataggttaacaaaactatgaactttaatgtgataacaataagcttggcaccctcagcacagaccttgtctctaaaatgggtctaagataaatcatacataaagcatacacaaacttataaaatacatacaaagtacatctcaactcattttggagcaaactcagtttctacagatccaccaacttatgttctcctataaagcaaaatgaaatagtatacatactatacatcaaatgcctctaaaactattacctttaaatgactagttttagataagctgaattttagaagttcatataaaattcatcttagatcctttttgaataaacccaagttctgtagaatcaccaaaacatgtccttccaagttataaaataaaattacatacttattgtatgataaaagcctctaaatacttatgtaagtaataaccaatatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaactttaaatttataggataggtgctaatcacatagtattgattgagcaatatgtatatatataaatgtatatagaaatacac

SEQ ID NO: 49592 - DNA, 1422 bp, Oryza sativa
atttatgagacattgaaaggtagctggggcattggtgagaccaaagggaatcacacgaaattgaaaatgtccatgatgagttttaaaggcagttttatactcatcagattcttgtctcctaatctgataatacccactgcgcagatctaatttagaaaagtaagtggtaccagccaactcatcaagtaactcatcaaccacaggtaagggaaacttatttttgacagtaagatcattcaacctgtggtaatcaacacaaaagcgccaggaattgtcctttttcttcactaaaataacaggagatgcaaagggactgcagctgggagagattaacccagcagccaacatgccagaaacttgcctttctatctcatctttttgagcaggagaataccgatatggtcgagcattaactggcacaggattgggcaccaatgcaatagcatgattcagaactctgtgggggaggcaaggaattggattcctgaaaaacagactgagattctcgtaataacaactgaatttcagaatcctgagaagaagaagatggcactgtaacagatggttccatagcagccatggcccaaacatcattgcctttagtccatttcagaacctgaacagcataaacttcactgacaagactgaatttaggaggaatctgcataccctgcagagaaatcactgagcctttataacagaactgcaactgcttggctgcccaatcacaggtcatagggctgaattgagataaccaatccatccctaacaccacatcataaccacccataggtaaaaccctcaaagggaaagaaaactcatgcccttgaatccaccaagcaaactagggaacttgagctgaacaagagagagtctcccgattagccatcttaacagcagtagactgaagagctatagtaggcaattgtaggcgctgacacaaaccagtatcaataaaactatgaatgctacctgaatccacaagaataatgatgacttgattttgaaccaaagcacgcaactgaatagtattagaaggacaagtcccagctaaagcatgcaatgatacattcacctcagtgccagacatatccagggtcatgacaacatccaacagggcatcagacaatacctcagactcctcctgtaactgaatagcctttaactggacattgtcagtcttagcacaagtatgaccaggaacatatttctcaccacatttaaaacaaagtccctgagctcgcgatactccttgagttgctgagccttccaaagttccccaggggccaacttaggcttatcaaaactcttgacagcagaatgctctttcttagaggccatctcttcacaccagccccattctgagcagattcatgtgcaagagccactaaataagcttgagttactgtagtaggctgttgt

SEQ ID NO: 49593 - DNA, 1296 bp, Oryza sativa
tcatggtgctgctcaaactaattgatgtcatgcattcgctgcaatgaattttttttgtcccaagtaactttcaatacaatggtctaatttcctccaacgccatcaaggacattggggagaaaaggcatgcctgccaaaggcacacaactacgaaacctacagaagaacgaaagatcacagcgtgcaaaattatacaatcattctactgatggtagtagttgtcacttgtcagcatggaaactcactcaatcagcgtagaacctgatgtggttctcagcattcaggaccacaaaatcagtatcaattgcaattatacatttgtttttttttcccacaaccatatcagcatataactgtccaccggcagcgatttagtttggatcgttagcttaagcatcacatggctccaattcccctgaataaaatcaaaagcctgcaccacaaacaggagtgcgcacgcaatcgagtggcaatcggcaagccgcaagcgcagccgtaccaaaaaccctaaaccctagccaaatatcaccaaacaaatcctagctcaccaaatccctcgcggattatgcgcgacactaactggtaaatcacacgcaaaccgaccaaaaatagcgcacaaaaccctaccgagaagttcaaactcgagctcacgcccaaaaaaaaaatagaagtacaaagggagatctcacagcgctgtgggccgtggccggggttgccggcatcggcgagggagtcgaagcggtcgcggttggaggcgagcacggaggtgctgcggccgaggaggcggccgcgcgagcgcatcacgccctgggagacgatgtggggtacgggtagcgcgcgcccgccgcggccaccgccccgatcgtcctcgtccatggcgtcctcctcctcctcctcgtcgcggtcgtagtcgacgaactccacgtcctccgccgccgccgccattgggatgggagtgggagacagcgaggaggaggaggagagcgtgtactgtttgcgccgcggaagtggcgacgtccgacgtggtggttttataggcggtaacgacggattagcgcgtgattacgagggccgacagtccgtaattaaggagggagatttgcgtaatgatcccttgagatttcgttaattaactcgaagcgaactactgctaagctgctggcttacatgtgggcccactggtcggatcagcccagccgtctgatctctgatcggtaaccgacggtccagatcgcatctagttcgcacccggggggcttctccggacagagatggcggcggcggcgacctctccct

SEQ ID NO: 49594 - DNA, 1501 bp, Oryza sativa
caaggcagtagcaaaaggagcaagcgcggaagaccagcgattgccagattggtctcactatggaccagatctggtttcttctaagagaaacttcctctgctactgtagacaggtgtttttggcctttatatacatgccacaaaatgatctttactttaatcatgaactcagtgccatgtatgattagttatattgttcaaattatgctttctagaagttaggcaaggtgctttgggaatattttcctccatcgaggaaattaaacttgggtggtgtacatattaaatgattaaactgttaatctataagtttccgttcctatagtttgttagttgctaccatttttcttggtttcttcggttcatcaaattgtctatttcctataaatttcaattctcaccagtcaccgtgtgactgcataacatttctatagttacatagccaactatttaatttcaaatcagcatctagcaaccattcttgatacctagaatttatttgcgatcattctatctgttcactatatggtgcgttacttcactatcatttcttccatttccttttcttttacaattcttttttttttgacaccttcttttacaattcttttgagaacaataaacttgattagtgccctttttttattaaagatgggcatatatctatacatcgttttgtgttttatcataagaaaactaatatgacgacatctcactatcaatcagattttttccttcatacatattctaggatgaaaatttcacaggaagatctcgactgttttgctattatacctagaaaaaattgcatattatagtagtagcttgactatttgattgcttttttggtcaatcagagtgttacaaatatgtaactacactcataatctctatttgccacatatccattgcacaccttccttttttttttttagaattctgaagaaaaaacatgaaatttttcagtgggacatcgccgcattgccaatcatctatcctgattgttaggctaatggtggggcatcaggtataggttcatgttgttaggtgctctcagaccatatacgttctttcatccatttttggttccagccattgttttatacttttgatgctaataatggtcacatatacccatcttcaactcaagcgatgaaaggtgtttacttttgcattgctactgtattttatttagcgctttccactaacagaatatcatcttcacattgacagtcaatttgatttacacacattttctttgctttagtgtaggaaaaaggaaaacataattattacttaattatcctgtaaatttcttacccttcatgcttaatttcgtatcaatctaaattctagggttcttttactctcgctgcattcccatgtaataaacacaaatctgtaatatcgtgttgtatcacttgatataactatcctcattgtgaaatggtgtacatgctggtttttgaatctcaataatttgggttgctttttcacatgat

SEQ ID NO: 49595 - DNA, 1501 bp, Oryza sativa
tgtaggagttgtgtatagcagaaatatgatataatacaatgttcggaaacaggtctgaacgtgaacatgataattaagtttcatttgaactttccacgtaccccgatcaacttgatggtaaaacagagtatatttgaactggcttgcgtacagtacaaataccatcaagcatggtgttattgaattctcatatctagagagaatttgatttatcgaagcaagctgccaaactgtaaacccaacataattacttataagatttaggtttactccgttagagatagcgtttcaggaattcgtccatgcaggtgtactgaacctctgggtagagcagagttgcttcggcaccatggtccccaatgtcgaagtttgtcaagcaaccgtcatagaaaatgtggtagtaatgtgttactgccacttgaatagcaaaattcaaatctgcttgcatcaaaaattgcttatcaacgacaagttaggttaatactatgatatatgtagtttgaaatttaacccctagagtaatggtattaaagaaacatagttaaaaattggcaatatcaatttgaaaattgatagaaaacagcatcgtttgtggggtggtgttggagttgtagatctacgattccaaccaccaaaaatacttaagtcttggttccatgatatatacatatcaataagcagtttatggttacctttcattgcagccaaaaattcatcgctgggtatgtggactttctcaagacttttccctgtaagttcttcctacttcgctatcagctcgttttgggtgaggcaattatcttgtggtcttatgtagattgtcttgttcaaggtgcgaggatcatcgattgatttgattgtgtatgttccaatatcatcttcatccaaaaaaacgctgcatataatattgcagcttttggttagtatagttgaaattcatcaaaactaatattctgcactctacagtatatgcaatatatgtatactcggacacaattactgttagtaatattactgaagaataatgagtagtgaaaaggtagctatacaaattatttattattatttttttcaaaaaagcatgcaaataccttcataggacatgctatttttcactagctatacactaaaaaaaatcattatttacaacagattaaattgtgctcatggtataggaatctggcatgtggatgcaacaaattggctagttttttgtgtgtgtgtgttttaagaaaagtactccctctacttatacttacgtgctagtttaatgataatacataattcttataggaaaatagatctatttgcaaaacaaacaaaggggatataattatttgacaacaaatttttttaaaaaaactattttttttaaatttgaacccaataaataaataattttggttcataatttctagctaaaactcttacatggattttgtcaaaaaaataaatttgttcaataatttaaattttatttttcaaattttacaatcaataa

SEQ ID NO: 49596 - DNA, 326 bp, Oryza sativa
  unsure (1)..(326): unsure at all n locations
cttttcagctgaaaatatatgccccagcttttgcaagacaggtagatcgagtagcttctctctctctcctgatatactttcgagctannnnnnnnnnnnnnnnnnnnnnnggtcaggactagtggctacagaagcagctccattgtatgttggcttctcaaccatagctaaaatttaagttttgtaacataattgtaaagttgattttgaggttttttctaatcgtagtttattttcaacatcagcttttaaatagctaaaaacataaagataaaagttttacatttaaatcatttttaagttatttgtttattttttttcacagc

SEQ ID NO: 49597 - DNA, 1501 bp, Oryza sativa
gaaaaaggaaaaaacagagagaaataaaacgaaacagttcgcggagaccccaaccgagatttacttgatctacttctgatcggacggtcgaccatgcagcgttatatggagccctccaacgtcatgctccactacatagagaagattttcgctcctcttatctactttatttttaacgtttgaaacaatttttttctaaactacttatccaatttatattacgtttacattgtaatatttgttacaattaaatttttacaacaacatatcgtatgattatattctaataaaaatatatatgtttcaaccattgaaatttaatgtttcaaccgtaaccaaactatgttgtacatttttagtttttaatattgcaatatgtattttttttcaatgttgtgcatggtgtcatctggatgttttcaataaatattttctgatatttcattagttctttgcaaacttagcgtcatgttcattagatgttttagcgaatatttggtgttgttcatgcttcatgtgttatataaaattgtttcaagtagaaatataatcgtatatattttttatcaaaatataattatatgagatatcatttaattatataataaatataatgatgtaattaaagattggataattattttaaaaaatatatatttaaagcttgagagtactagagatagagagagaagagagaacccaggaaaatagttgcatgtatgagaagagaatagagaacaaaccgagagagagggattggttacacggcatgcacgtatgcacggaagaaagaaaaggcaacccatgcaaaagaataatcgggggcccgatgactagtatcatccgacctcaactcctctgtcctctactacgcatctctctctctcaggggaaaaaaaaatctcctctcggccgagatcgtctccaccgccggcgagccttcgaaaccggagctaaccagcgccaccgccgtcgctcgtcatggtaatccggtcgtgatccgattctcttccctcctacatttggttgattcttctcgtctctattctcgaatatcaatggtctctctctgtttttttccttcttctgttcctgaaatttttttcccaacagttttcgatggcaatttaatgtgagggaagttcgtccactcgttcatgatccgtagcccattcctgaattattacagttagattgatttgggctagggctagaatttcgcccaaatgtgcgtcagattgcatgatttgggattacataaacaaatgccgtacagttggatgcagctgggaacttgggatcatatatccgtggccataccattagcttgccttgataacattatcataccattagcttgtcttgatgtgcaccatatcatcattagtagtggtgtgatcctcgaattgaactttggttcagcattagtttttgatgattcttttgatgctggagagcagacaagaggattccatatgacatcgccatttgttgtgttgtc

SEQ ID NO: 49598 - DNA, 821 bp, Oryza sativa
agttcaaacaatgagagccacgtcactagatttttcagttcatgcatgtagttatacgattctaaaaaaaaaaatacatgctactcaacaccatagtgagatatagatttatcaatggtttaggttttatctcttccaaaacgtaaaagtagtaggacggcatatatatatatgaacaatggcaccatgatggatatatacccattaaacctttttgaactgaagaaaggagtagtacttgtctaccacgctctgtttcgtgcatcgtgttatccagcaaaagtagctgtagatcagtacatcatcttgccgggaaaagtgactttttatttttatttttgcaacaagcgtgtttttttttaccactgacaacaatggtactctctcctacagtactagggagaatgtctgtctcttcttttgagcatggcgagatcgaatgaatgtgatcagtgatgagagccacatacacaaacacacatgctgctgatgaagtgatcgatgagcagctaagcacacacgatccaaggacagatcagcagctttatcataatggtagcagctctggacattcatactccaaaaatccctttcccttttcccctgtctttttgctgcaggccggccagcatatgaatgatcaggagaggcaaggagacatggcaaagcattggcagcagtagactctctggagatctctcctccttgctagtacttgtgtagtactccctctgtttcataatagttatcgttctagattgttaaggatagattaaaatttaatttaaaaattataatacctcttattgaataatgcatga

SEQ ID NO: 49599 - DNA, 1501 bp, Oryza sativa
ctgatttaactttgttttatggttgaattttccaaatcttctaatcagtggctgagcttcactacaatcctgaggggctaatgtgtaaaagtgttttcaaacaaaggctattatacattttgttttttgctataatacaatttttttcttcactgaaagagaggggatttcaatgtaacatcctaaagctggaggaggccatgacactctttgatcttgatgaagctccacccgaccaccctactcctaatttcaatgccaatcaatttcattccttttaaaattatctttaaaacaatctagaattaaacttgtaataaatcaattatcggacaaagtggtggggcatctaggttccggtgcagaggaggatctggtgagccatgagcggcagtgaagtggacgtggctaatgggagatccctgacggaggctataaatgttaatgaggaagggtgcgccatggcgcattatcgacttaccttgtttgggatgcatcgatggccgcaggtaggtgtggtgattgtcttgagtttttttatcctgaaaaatttaaagattggatctaaagcatgatggaattattttttttatacattttcacctaaaatatatgagggttacatagggttgtaaagcattcatgagtctctcgacccattaccactcttagctagaggtgagtgttacttccttcgtttcacaatgtaagactttctaacattgttcacattcatatagatgctaatgaatctatatatataataatgtctagattcattagcatctttataaatgtgggcaatgctagaaagtcttacattgtgaaacggatggagtagagtatagggtagttaaagtcatattaggatatgacagatttgtgtgaactccttccatatctgtaatccttccttatctcctccccatgtactcttatatataccggccccctgaggctcaatacaatcaatccactttacgcagtattcccctctccctatactatccaacatggtatcagagcgggcgatctagcatccctctctctgcttccgcctccgccgccgccgggagtagcgatctcccgggggcggtcaccccttttttttcctttttcgtcttcgcatcagatcgatctggttcagttcccagattggtcgttcgtggttcgtcgccgagaagatcgatcccgatcccctctggcggcctcatctttttcgttcgttgtcatcgttgagttggagagatcgatttccaggagtcctgcatcttctcctcacgtcgtcatcaattcaagcatcagcagctgtaatgtcgtcgcatgaatctaccggtcgtcgcggccatgtcacggccatggtcctcgtcgagccatcctcgccggtcgctgcctccaccgccgtcgtgtagcctcggtcgccgccgatgccacccaagcctcccacgcaggactggcggcgacgtcgtccgccccgccggctttccgcgactccacttca

SEQ ID NO: 49600 - DNA, 1493 bp, Oryza sativa
agaggggacaaagggtccccctgcctaagccctctatgggtcttaaaaaaagggatattgatactcactctgccaccttctgttatctttttcacccaaccaataaactaatcactaaaattcttctttctcatcacctcatacaaaaagttccaattaactctatcatatgccttgtcaaaatcaatcttaaagataatccccatgtcaccctctctttgcaacttatgcaggatgacacaccgctcaagaatattcctcccaggaatgaatgttgtttgagtccattgattgtctttgtcaagattttcaaaataacattctgcaaacagataggcctatattgtttgatggttttagcctcaacaacctttggcaataaaaatatcacaccatagtttatcctatcagtgttgagagagcccacatgtaaatcatccaacatttccttgattaaccctccaaattcagtccttataaaaccccactgggaagccatcaagcccaggggaagtattagctttcatctcctttatatttttgcctagtttctcaagagagaaaggtctgatcatgttttccttttcagcatcagttaatctaagaaaagcactccaaacattccccaaatgtacatttctgcactcttccttaccaaaaagttcttatagtaactatacacatgctccagtatatccttaaactcagaaattgtttgatccccctttgcaaagagaaaccccaaatgtacatttctgcactcttccttaccaaaaagtttcttatagtaactatacacatgctcctgtatatccttaaactcagaaattgtttaatccccactttgcaaagagaaaatgtgtctttttctgagtcccccatcagctactccatgattgcaaagagaaaatgtgtctttttctgagtcccccatcagctacttcatgaaaaaaagaagtattagcatcaccttgtagcagccatttctccccacatctcttctgccaccaaatttattcttgcaaataaatgctttccacctctttttctactcatgttcaaaaagatctctctcctcagctctgctatcaatctcccccaatttctgttctaacaccttactttttttccctgaacttactaaccttatttgctccccagccgctaagccaccttttaaccagccgctaagtcactttttaagaaaaggcatcagtaaataacagaaatcaacttatccctttatatgccacatcatcttttttaaatgttctaaaaacactcatgttgaagctaacccatctctctctagtatccaacacaacccaccacagttaaatgatgcttctattcccaagtactataaacaaaaaatttgtccaaggcaattctcacagtctgtaactgcatattagaccaagtaaatctccctccagcctataaaactccagtaaactattcttatttaattataagatcgtgtctcttctagg

SEQ ID NO: 49601 - DNA, 296 bp, Oryza sativa
tggttggtgaagattttatatggcatacgatggaggtattgtgtgcgtataggatgcggagtcgaatttgaaggagtccaaatttggtatgattggttatgtaaagtttgtttcttgtacgagaaggtttcctatggggattaggacttctagtatgagtttagttcgtggctttaggctgcctacctcatgtataaatagagagggagcgtgaggcttcccggtatcgcttttgagagcattgagttgctagtttagttagggtttcgagtttagttgagatttttgtaagaagt

SEQ ID NO: 49602 - DNA, 1501 bp, Oryza sativa
aggacacctgcggtcagaccggtggcatcgaggtcagaccggcggagcaacggtggtcagaccggtggcagcgacaggagctggcaggcaatctcggcggttcgaccgatcgatctatatcggtcagatcgacgttcttcaggtggtcagaccggcgctgctactttggtcagaccgcgatccttcgaatttgagggtaacttttaatttcgcaaaaagtttgggtttttgggcataccaaccattcaccccccctctggttggcttagttcttgtgattcgatcctacatatactagtcctatttggttacagttggatttaaagttgtaataggtgttagcggtggagttagagtcccacaatgtaaccatggcgactacaatgtagcgtagacacgcagggagataatggaggcgtggccatagactcgtagctgctaggtgctatattggttgggaggagcgcccataatcagagccccgaggatgtaggcttcggctgaacctcgttaacaaatatcgtgtgttcttgtgtcgtcatctggtgtgtcttgggtgatcaatgactaaagcgatcagaaaggttagtcgtcgttccactatatcgaccaacttttataatagtaaatgagaagatgttgcttgagatgttcaaacaagatttttttaaaaaaactgcatcattcgttgcatgcgaaaaaatgtgcaaagtatttccatcacccagctctttctgagcgctggcacaagagatgacaggaaaagattctctgaagtgtaaagtaagaaatacagaacaatgaagcagaaaaacactcggtcaaaaattggaatttcttatctatctttctttacccatacataaaatattgctaaactaaatttgagtgagttctctccaatccagagcaaacacatcacataaagtaaactatatgtctatatactaaaaaactaaggagattctctgaattgtaaaaaaacaaatacagaagaatgaagcagaaaaatcgtagcgtgttccctcattgaaaaaaacacatgacagaaactacaactcgaatatatcacaaaagcaatggaactcgttatctgtactaaagaacttatatgtgcagaccgactcaaatatgaaagatactctcggaatccaacacgcgattaaactcctccatgagttcaacaatgttacctagaagagacacgatcttataattaaataagaatagtttactggagttttataggctggagggagatttacttggtctaatatgcagttacagactgtgagaattgccttggacaaattttttgtttatagtacttgggaatagaagcatcatttaactgtggtgggttgtgttggatactagagagagatgggttagcttcaacatgagtgtttttagaacatttaaaaaagatgatgtggcatataaagggataagttgatttctgttatttactgatgccttttcttaaaaagtgacttagcgg

SEQ ID NO: 49603 - DNA, 494 bp, Oryza sativa
ggggcgagcagcagcagctagcagaacaagtggtgagtcctcgccccgtgcctctgttcataatctttgtctctgatttcagtaatgcatctagatgatgtgatttacaagaattgagcttcatgatcatagttttgatttattcatagattttcaatggagaagaaaataacattgttaaattattattcaagcaattcaagtagtacccatcaaactgatgatagcagaacggaatttttgctgattgtgcacaaattaagaataacaatagacaattttttcatgaaattagagatgaaataaggatggtatatttgttggtaaggctatggaagcaattgcatgatgctgctgttgcaaatgaaaacttgaaaatgtgactacattgcttattttagtgctggatctgccaattttacattcctccgctgttgctacgcatccatttgtgctagatcgcctcttccttctcagtccacatgcagagacaa

SEQ ID NO: 49604 - DNA, 278 bp, Oryza sativa
tgctcccctgagccaacgccgacgcattcctcccgcctcgaagccgacactggcctccccgtgtttccccgccgtcgtcaccgcgttcctcccgcctcgccgccggatttggacttgggaggagctcaccggcctccccgcgcctccgccggccgcgcgtgtggctccaactctaccgccgctcctcctctccgccgcttcttccccgtcggccgcgccgaccctcttctccaccgcgtcggtgccgccgccgcatcggccctcctctccgcgtcagt

SEQ ID NO: 49605 - DNA, 850 bp, Oryza sativa
tttcaattgccggccaacgtgaacctttgtttcacagccaacttcattcccagccaacgggatgaagttaatatatgtcaggtacctaacagaactaatctatttgatgttttgtcaggaacctaacagaactaatctattcatgtcttttgtatccgtgtattgagtggacacatccaacctaaacacattagaagttgtttggtggatggcttcgcttggtgctataagtgtatatgtgatgaatcatgcatgcagggctgttcttagcttctgaaaacaatagaagaactaggatgatctgtagatgtgcacatgtggcctagagtcagcttaggtgtcgcattctctgacaaacgattgctttggtaaaccaagactggtgttttttattagtactaatttggtttgtttgattagttgtatatacaatcaattgtttcctgtaaataattttgactgaacgttacaatggaagttattctatgtcctccatggcattcagatggtaactgaaaatatatgatcgctggtaggagtatgtgctttcaactatgtagcttgcagcagttctcttggtaaaaacgagccaaaaattctctaataagcttaatccacacgatcaacaattcataagcctcttgatcaacgttttgccacttatccctgatatgtaccaccaaatgcccatttagatttcccatgagcttgcacttgcattaatttttggcttttcagcctgcaagcatcaccatgtcctgtgcaatgctcagttgctcatagcctcatactatgagtcaatccactaaggcatgcctactcatagtgcatatatatggcaaattttggt

SEQ ID NO: 49606 - DNA, 1501 bp, Oryza sativa
ttaacacggaaactcatagctatacttaaaatgtgacgggggagtacatccaagattttaaaaacttaggttgagtttagatatagggatgaaaagttttgttgtgtcacatcggatatacggatatacatttgaagtataaaacgtagtctaataacaaaacaaattataaattttgcctgtaaactatgagatgaatttattaagcctaattaatccgtcattagcaaatatttactatagcaccccattatcaaatcatggagcaattaggcttaaaagattcatctcgcaatttacacgcaatctgtgtaattagttttttttctatatttaatacttcatgtatgtgtccaaatattcgatgtgatagggtgaaaagttttgccaggggatctaagcatgcccttagttttaatttaactgttgattttgattatttatcgtagttcaatttctagattggcttatgtttttttcaaacaattacattgccttttaaatcacttatgaatacaatagatataaaagttttatgcataaattattcttattaattaattcacttttctaccggttactagccatagataaaaactactccacctcattaccagaatccccatttgcctcaacgacggcccctggtgattagagaccctgtcatacctcctacggcagaggggcacatcaacggatagtagctcaagatatccaccatttattttgtcaatcaatgatttaggtctggtttagttcccaaaatttttttccaaaaacatcacatcgaatctttgaacacatgtatgaagcattaaatatagataaaaagaaaaactaattgcacagttatggaggaaaccgcgagacgaatcctttaagcctaattagtccgtgattagccataagtgctacagtaacccacatatgctaatgacggcataattagtctcaaaaaattcgtctcgcggtttccaggcgaattctgaaattagtttttttattcgtgtccgaaaaccccttccgacatccggtcaaacgttcgatgtgacacccaaaaatttccttttccccaactaaacacacccttagtttccaaaaattttttttaccaaaaacatcacatcgaatctttagacacatgcatggagtattaaatatagattaaaacaaaaactgactgcacagtttgcatggaaatcgcgagacgaatctttcgagcatgattagttcatgattagccacagtaacccacatgtgctaatgacggcttaattaggctcgaaatattcgtctcgcagtttccaagcgagttatgaaattagttttttcattcgtgcccgaaaactctttccgacatccggtcaaacatcccatgagaaccaaaagttttcttttcacgaagtaaacacatccttaatgaacttataaagtctcgtttgagggccctttgaatcacaggaatagaaaaacgcaggattctgacaggaatgtaagtgta

SEQ ID NO: 49607 - DNA, 281 bp, Oryza sativa
aagcaatcgattggattggaagttattttcgaacgtcctaagctcctagctgtgcactatccctctatatgatctcttattaacttgtctactcagttaagtaatccatgtatgagcaacaaggacagttctaattaagaacagaagccatattcgtcattttctccgaaggagaaaacacggcctcaatacattgttgcctacactgctaagtaatccctccatgagaacaacctgttgactgaagttccatcgctggcttaccggttactactacgcaa

SEQ ID NO: 49608 - DNA, 1501 bp, Oryza sativa
gcttcgccttcctcgccgtcgaagcggagatggagccgatcaatatcacctcggttcgcgagttggaggaggctataggcaagtacggcgccggggagagcgtacgggtcaccatcaacgtggccaacgttttcgaggccgatgagctgcttcggctcatcggcgatcgggagctcgaggttcgttgggagctgagtcccgggggcatggatatgctgagatccgcggcggactactacctcaatctcgacctcctctacgagttcatggaccttatgcggctggatctgcgcgacggcgtccctgtcaagaaatcgttgttcgattggatccggaccgcctccacggatgtgcttacttcttctcacccatcgtcgactcgtcgcatcctggaacaaatcacgctggaggcacagctaatcgggcgagtggccaagggattgggcttcggggcggatgacgtgcagcagtatctcatcaccccgcacgaaatgtcatggtatctggaagaggatgcagttgcggtaagaaagaggagagcaagtttgagttcgggtgatgccgccacgagtgatgttgctgcgggagcgagtgatcctgtggagttgctcaaaaaccacaagcagaggctgctggacaaggttgcgcatctgcaacaggtgatatcttcatcgaaatctgccccttacatctcacagttagagcagtagaaatcacaagaactagaatgcatttcaaagagtctcacatggcatggtacgcataggccattagaagtagagctctgagtacaccaggatcaggatgcacttgcaagacttccacatgacacagcagaaatcaactagtagtacggctttacttcagtgtggagttgcagtttttcgtttgacttgactattgtaaacagctggtttatgtcaacaaataagaccaccagtttctggttttacttgcagaagaaagtattgtgcactgataccatcaagtattacattccctctgcatgtttatagttttggatacagaattagccacggaataaaaataaaaccatgaaacagatacagggaaaccttcttttcttgcatgcacattacatgtttacaacctggtcttagaatgacagtattgattgttgaagcgcctatcgtgtgaagccaatacatagcatcttgatacttgattgttgaagcgaggccaatagtagctgtagaatacagtggaaggacaaatgcataagtaaacacaatgaagtatcaggcaagacaaagatctgtagaaagctattctaggatcagaaattccattggcttggtgattgaatggtgaaccaatgaataacgatggcttatgtctgaaagattatttaaactcaggctcaccattcacaggtattaatccaaaccataaattatactgaggttttccgagaagaaatttacatggctatggcttagtgatccaacgattgaagaatttaatagtctttacttggaag

SEQ ID NO: 49609 - DNA, 1501 bp, Oryza sativa
cagagtttatcaaagctgcacatctatctgatgatgacacttcaatatatggttttatagcatccaagcccacatggccatcatggctgctgattgcaacagtggtactgacattagcagcagttacatccattatccctgtgaagtatgttgttgagttgagggctttgtatgcattgggggttggaattacccttggcatctacatatctgttcagtacttcttccaggcagttgttctgtatcctcttcttgttgcaacaattgtcttggctgctgtctttatagtattcactcatctgccatctgaatccagcacaagggttttgccatgggtgttctctttcttggtagttctatttccaatcacatatcttcttgaagggcatctaagagctaaaaattttgtggatgatgaggaagcagagaacttcaccaacatgttggctatagaaggggccagaatgtcacttttgggtctatatgctgccattttcatgattattgcattagaaattaagtttgaactggctttgctattgcgtgagaaagctgcagacaaaggtgtaacacatggtccacctggtcggagttctgcctttccaccaaaggcaaggctacttcagcagcgaagagctcatgctgcgccaactttcactatcaagagattggcagcagaagcagcttggatgcctgcaattggcaacttttcaactgtgctgtgcttcatcatctgccttattctcaacgttactcttaccggtggctcaaatcgtgctattttcttcctggcacctatccttctgctcttgaaccaggattcagatatcattgcaggatttggtgacaggcaacgttacttccctgtaacaatctccatttctgtttatttagtattgacagcattgtatcgtttatgggaggagacttggcctggcagtggcgggtgggcacttgatattgggggcccaggctggttctttgctgtgaaaaatgttgcccttctcatgatgacattacctaatcacatactcttcaatcgcttcatgtgggattatgtcaggcagacagatgcgaagctacttctgacgctgcccctcaacttgccgtcaattataatgacagacatacttactgtgcgggtactaggactgttaggtgctatttattctctatcacagtatgttatatcaaggcggataagacttgctgggatgaaatacatttaaactaggacatgcaacttcttttgaggtaaatcttgtatgccctgcgtcaatggttgtgaataagagtctccagcttctgatgctaatatttcggtgcttgcttgcaggctttcaaccatatacgacggcgattgctttcaaaggctcttgcttgaagtcacatttgtctggtgaactgtgaacaaaattgcgccttgaagtagagaaacaatggtcagtagtcaccagttttgcccttagatgatctttatactggtaacctaaggtgttgt

SEQ ID NO: 49610 - DNA, 1501 bp, Oryza sativa
tcgtaaaacgatggcactcatcacttaacaaatgatcatctttttttgttgtggatctgctctacaatatataaattttgtatctttagcatttgaagttacctcaccaaacacaaaattacatagtaagcactacatcatcatttgccccgtcaacgacgactcgagtggatcaaatattaggcaaattaaataaaaaaaaatggtcgtttcggtgacccatagagctgctttgtgtcatgtcatctctccaatttatatacatatgttcaattagaataggaactctcaggaaaccacttggtactttcttgactagtgataacaatgttaacatcctccaaagatgcatagatagaccaaaggaccaccactagcactttttctagtttgaagagataatattatgtcaaagtacaagctcaaaatcttgtcctgaggaccacaaggcattagtgagatctcactattctcatgcttcccattaggatgcaattgtatgggtattaaccatactcaaagcttgatgaactaatgaaatgctagcaaagtacaactgactttttagttggaaaacttatcttgcacattatatgtatgttgtattacttttcaataactagctagtagctagggtcgctatagactgctaactgtaagatgttttatttcattaatccaacaggccaaataatatcattcctaataacatcatgatttcgaattttcaatatggtttacttgcttatgtagttatgtgcaacaaaaatccctattggaggattaattttcaaactaacgtactatgaagaaaacccattttccttgttattaacacgctccaaaattccaaaactaattagttttcaaaaattctgtgaaagccaacgaagcacagggacatatggctggttattacctagtctggtcctggtacacttcacacaacaacacagtcacactctagtcagtagttcagtattttttttcccctgaaacaagtgttgtctctgaatctaatcattttgacaggatgggcgcggcgaccgaagtgcagcagatccaagaaatgagtggtcctaagacaaaagaggagggggatagaaaaatatgaacaaggcacaacttgtgctttgtgaaaccttgcaagatcaccatgggagacaggccacatgaactcaagtgctgctctcaactgatggaataagccatcacatggcgcaatgccgataaactaaccatccctttgcatttctccaagcaagaaatggtcactattctagctcctgaaaccctcccttcaaggggctccacatgagctatgcacatggattattctttggtcagccatcactctttgcacagctagcatgatatatatgttattgcagctagctcacataactgtcttgcgctcaccgaccaaatcttcagttattgtgcttgatcagatgcagcatctgggataaatttagctgtgatctagccatctagaaaagaa

SEQ ID NO: 49611 - DNA, 1501 bp, Oryza sativa
cgccgcagtggcagtagcggacgcgcgcgccgccgccgccaccaccgccgccgacgacgactccctcctcctccgccgccgcggcctgcgccgctggcaacggtagcggcagcgagccggccgtgaaccctcctcggcgcaccaggaccgccgtgttgcgcgcgtcgtcgtagacgacgagcccgatgtgcggccggccatcgaacggcagccacgccatcgcgaccgcctcctccggcgagagtgtcgccgccgccgaagccgaacacttccggcttgacgtcgtcgttgttccccttgtggccgccggcgtcaattaggcttaataacgtattaattaatagattaattctaaggtgtgagtatataggcacggctttatcatctcatccatattaactgatttatagaaagaatcgagcaagaataggagagagaccggccggtatacgagcgtgaaaaattattactctccaggtattttaataaatatataacctcattgactttttaactaacgtttgactatttattttatttattaaaatttttatacaaatagaaaaaatatttgcgtcatatttaaaagaatatttgatgataaatcaaatcacagtaaaataaatgataattacataattttcttttgagaaaaataaatagtcgaacatatcataaaaaaaaagttaacgatatcatacattaaaacatggagggagtaatatcctggttcttaggtgctcttaagggtacaagttgaccacttacaaaactaaatgctaatatctgactcaagtacgtactaaggattggctcgatataaaaagtaaatgctattatcttcacatgaattccctcgataaaaactctcgaacaagaattcaagtacatatataggattggctcgacaaaaggtaaaggagttgttttaacctaaatccatacctattaaaaagcatatcaaagctaatgataattcatgtctacattagagcaatagagcctgcgttcttattatgttttgaaataaattatagagtgaacttcggagaaccttgggctgtacaattgaggtatgaaaaatatcagatgttataacttgttgtgatataactatgagttttatggttgaatattcagaatcacctaatttcaactattttacaaaacaatacagaaccaaattgataatattaatcaattgatcaacaatggcttgttgatatataactaaattccacatagattttatgacataaagatatactatcttcattatcctctatatcttcatcccaaggttctaagttcaaatatccatatgagcgaatttcagattatgttagattagattgtttaagaggctaagtacccaatttaaatggctgcatatatctggttggacataaaggccgggtaaaaaatataaaatatattttattttcttaatagatgacgctgttgattttgacatatgtttaatcattcgtcttatatttac

SEQ ID NO: 49612 - DNA, 1501 bp, Oryza sativa
atgtgttacctggataaaaaagattcgtataaatttatttgatccattattggagataaaacaatgctcaactattgtgtacagattgcatataaatgatgacatgtcacatgcttaataattttggtcaagtatcatatatatgtaaatttttttgagcaagtgtatctcatgatttttttagcctccatagggcgtctccgccgcatcgggagagaccggctcccctcacaggtctggtggtagcggacctctccctcgtggatctgatggcagttacctcgggagtagcggatctgcgccactggccttaggtgcagcagggtctcgacgatgcgacggtggactgcatcgacgatgacgacagtggccctctccctcacggatccgccaccgtcaacctcgggtgagatgaggtctcaatgacgacgacaacggcggcagattgcatcgacaacgatggcaacaaccctctgcctcatggatccaacagtggttaccacctccctcgcggatctgacaacgactagggtggatttgaactagggtttcaaaaagcttttttttttgcgatttttgtttttgctcgcggacgacataacacccgcccgcgaaaatactttttgcaagttgttgtgctacctgcctgcaaaaattccttttttcacaaacacttgggggctccgcctatgaaaatatgatttagccacatgaaaaaaaaccctttttagtagtgtacttcatctttgtattaaaaatagcccccaaagttgggggcgacttaaaggacctattctaaagttcattttgaaacggatgattagccgcacgcaacaacatataaacttttagtatataatcaattgagtattaattattaaaaacatcaaaaatacatttatttgaatttttaaagcaatttctatgtaagttttcatatggaaaacaccgtttagcagtttgaaaagtatgcttatataaattgaggaattagccaaaccaaaagaacgcattttctgtggaaagaatacctagggaaggtagccaaaacaaaggaacttccatgtgtgaattatgatattaagggtggatccagcttaggaactccctgctggatcatcattgaagagggccgaagaaaaaaaggagatgagtctccctgtcttggatccgtcctggtatggcattgctacgacaaacttggcaccatctacgctagacaaatgcttttagcagatgtttggatctatgttacccagatacggctgaaaagccacgtatccgtatcggatacgctccgatacgtatcccgtacgtatcgttatttacttcgattttcgaaaaaataaattaaatcggatacttcgttgatacgtcccctcccgtcgctcctgatacgcccaaacccatccatggaagacgaagcgccgatccaatccgtcgccgtgccgcctgctattgctccaatccctgatgcagttcccacgggccacgtcctccc

SEQ ID NO: 49613 - DNA, 1501 bp, Oryza sativa
tcaatttgctcaagaataatttgctgctggacactaacaccattaaactattattttcattcgagccagagagagaatttaacaaaatggcactgttgccctctcttcttcaccatggagattgggggggcagggggagaggtttggagattgggattgtgtcgtcggtggaggagggaggagcgggcgtgggtcccggacagccgttgctagaggtgagtgttagagtatatggtagttagagtcatattaggatatgattgatttgtgtggactccttccatatgtgtaatccttccttatctcctccctaagtactcttatatataccggtcccctgactcaatacaatagatccacgttatgcagtattcctctcgtctctatgctatccaacatggtatcagagcgggcgacctaggactgccgctcaccgcttccgctgccgtcgccccctagggggctgccacctttttttttttaccgtgttgctcccgatctgctagccaccataggcagcagggccggtagcttcgagctgtgccacataccgctacggggaacaaggtcatccgtgccatctgcagcagagacggcgaagggcagcgctggtggagcagaagacaaggcacgatttgttgaggttgtagcccatcttctccaggcatgggcacaccatgcactcgaccatcgccggtggccttcacacgatgcgagcgtctcgccatcacctgacgacaggtgctctctgagcgtccgcttgttcaccctccgcacgtcataattccacccgtcctctttgccgcaccaccttgctcaccatttaccacaccttgagccgtgtcaggtgcatcgtcgcccaccgggcatctcgtcctccgtcctattgcccacaggtgctacgcagggatctcgtcgtcctattgccggaagatgactgtgagaatgggggagaagatagggggtaaaactaacattttgcatgttttctctctcatcaatgagatgtatattatattttaatgcatacgtgtcctagggtaaaatgccacatttttaaagtgttattgggcaaattcatgtttttggggtgtctggcaacaaaactatatattttaaatgccatgtaacaaattttgccatcttccttatgtccccttatgtagacaacccttcagttgctcttcctcctaccttccgcagtcaaaattttaaatttaattttaacttactatagtataatttattttttaaaagctaccaaaatactacatcgtgacctccattgtagagctagtgattcgatagtgtcccaattcaaagtgacgtaatttatttttttttcatgagggcactcatagctcaactcaagtagaccaatgccaaacccacaggtctgtagtcgccttcggtaagtgtaaaactttcgtaaatctgcgacacagttacaaagccacagcgtgataggctgatagctcgtccaagttattagcacaaaaac

SEQ ID NO: 49614 - DNA, 439 bp, Oryza sativa
aaaagttaataaggtaaaaaatgataattgaattaaatgatggagaaccaaaagcggttcattaggaatcttgtcctgctctaataaatttgtacattaaaatatcaataaattaatatttttaaatgaaaagtcggtagatgaaatgaactttacgaagtggcaacaaaacgtgcaactaaaaatggctgaaaaagaaaaggaaataccaataatgaagaattgaaaacaggttatttgcagcacagaatctggatcgaatgggaccactgacaatgagaaaaaaaaagatggacgtacacttcgatccaaagataaatctcaactttctaaaaagagaagaaaaagtacaaatctaactttccatgagaaaaagacaaacattctcctgaaaattaaagcaatgaagcaacagtttatagataagtaattaactttt

SEQ ID NO: 49615 - DNA, 1501 bp, Oryza sativa
tatggtttaattttgcatatacattaccaatttaacttgctgtatgttggttcaatttgttttttttttggatctgagagaatacaccgtaaaggacattaggctggttcggtttgatgcctaaaagagtctcaccaaattttggccatagacacaaattttggtatggccatagtttggaaatgttaaattgtgtttggttagtagccaaattttggctaaaccaaatttggttgtgtgccttcagatggctacgccattctttcttgtctcctcaccttctcacccacggatcgccgtttaaaagatgagagttttcatgttgcagctctaattaattactttccttttgcttcattcaaggtcggattattatatttttttaattcttgaataatgtattatattttgaatatttacaaattttctgctaatataagaatgaacgaagctgcagatgaatgctgtcgggtgataattaagtattggggaatggatggagtattcaactatgtacggaacaagagatcaaagcaaacaatgagcagaagtgtgagcaggaaatagaattaagccatcaataaccacaaatatgtagtcaacaaagaagataataaaaggagaatagattgcagattttttttagacaaagattgcagattaattaagctagcattacacttctggcagctaccacaaagctaagacgcatgggaccgcgcacatttctgatagctacagcaatctgctacaatgtgttcaacgtaagcaactagtgcctcctttcgacactctggagtgttctcctttcccctagggcccctttgatttataggaaaagtgtaggaaatttaaaggatttcaatcctatagaaaaaattactatgaaaccgtttgaaacaaaggattgaatcctatactatcctttaaattcctatggaatgggtaatctatagagattttggaggaaagtagaggtccatcctcttggaaaaattcatttgagtctatctctctcttccgattcctgcgtttttcctgtggtccaatcaaacggtcattcctgtgtttttcctgtattttccaatcctctgttttacacttacattcctgtcagaatcctgcgtttttctattcctgtgattcaaagggccctcaaacgagactttataagttcattaaggatgtgtttacttcgtgaaaagaaaacttttggttctcatgggatgtttgaccggatgtcggaaagagttttcgggcacgaatgaaaaaactaatttcataactcgcttggaaactgcgagacgaatatttcgagcctaattaagccgtcattagcacatgtgggttactgtggctaatcatgaactaatcatgctcgaaagattcgtctcgcgatttccatgcaaactgtgcagtcagtttttgttttaatctatatttaatactccatgcatgtgtctaaagattcgatgtgatgtttttggtaaaaaaaattttt

SEQ ID NO: 49616 - DNA, 547 bp, Oryza sativa
tttggctgttgattttgattcggatatccggaaaaaaagtccggatagtttccgaccgaatccgagttccgacggataccatcgctactgtattcgaatccgtttccgagaaaaactatccgaattcgtatccgaatccgaaaatatccgaaaaaaatccgaccgaagtgaattcggaaattatccgtaccactttcatcccgcaatgctgccgtggtccagaacttagcgtgttggggttctcttcctgctgctttggccacctgggaggatgctgacgttgttcgcaccagatttccggacgctgtcccttggggacaagctccaattccagggggggcaactgttatgcctatgccggatgagctactggcaacgaccgaaggaggtgtgtcgaactgaagacgtactgcgaaaagacgttttcgagtggctatagcatattgagtctatgtactgatttctgacactggcttgtggggctaacggttgttgagtcgggtgtgtggtgtataaatcgccagcccgtaggcacgtgacatctatc

SEQ ID NO: 49617 - DNA, 207 bp, Oryza sativa
ccatggctgagctccaccgcccgtgccccccgagccatcgccccgatccaccgcccgcctcccgtgaccaagtttcccgctccatcgcatgtggcaaccctaccaccccgagcccttggatccactgcctagccccagatccatcgactgtcggatctaggagaggagagggggtttgagtagccgctggaaccttttgttaacagt

SEQ ID NO: 49618 - DNA, 1501 bp, Oryza sativa
tcttacttttatagatattgttggcaaagtagcatctcgaaaaccgtgtcagggtccaaaaatgcttatattttgaggtggatggagtaacaagtttcccaaacaattaagcttttcgtccagattctaagaagttgaagtcagagtctaaaaaacaaactagaagtataaggtgtgaaacctagttttttagattatcagaagatgactatcaaatgctccctccgtcaaaaaaaaaaagcaacctagagccacatctccttctagtagtacaacgaatctgaacaaccctcctagatccacatctcctcctaaattgtctttttttttggacgaatcagggagtactccatatgtcaaaaaagaattcaactctacggatgaatctgaacatatagattttcttttaatagaaagagtataattactccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctc

SEQ ID NO: 49619 - DNA, 1501 bp, Oryza sativa
cagcaccgaatataaattaaagaataatcacccacattaatgcccaaatcacaggagatgtgccacagcccaaagcctcaaatatgaggccagaaaaagaaaaagaaaaataattggagcatatagtttggagtttcctgtgtatctttaactactggaggaaatacagaaacatctaagtacagccaccaatacaaatttcaaacacctgtgtactcagcaacaaaacttacgttgttctgggttttaacttgatcgagtgaattgaagaaagcattatatgcctctttgtctttcaacagcctctgcaactcatcaacactgcagaaaaaaggacagtattatatacagcagttttgcattccaaacaagcatgctcacaaggaatagtgtgaaaaacacatgtagtaaaggtggcgattataaaaagcaacccaaccatacataatcacttcttttagcatttatatacatcccttctgaattgcacaaattgtcgtgccctctgaaaagctagggattcttcattcattaccaattgatagaatatagaatatcagccatgatatcattattgcaattaaaaattcattactctaatattattagttagattctagtgactctcttttagtactaatataaacactagaatatgtaaaataccatggtaaaaagtaacaaggctgttgcaattttaacccacagtatagataagataaggcataatacaatgaaacttcgtatacaggaagctacaagcaacttatcaaaaaaaggttagctgctgaccttttgtcctttaaccgagcaattatccctgcagcctcagctggagatggttgagcacgcgatgaagactgggaattatcagaagctctttgatgtggaccaacattggaagagcttggtgtggatggatgtgaagatgaaccaactacagactgagggtaccaaggttgcgtagggttgtcctggaaatttggatcaggttgctgctgctgcgagttgctgctggcaagcattcagcagaaacaaagacagtaagccagaggagctcgtttttcaggaaagcttaaggcaataagtgaatcatattaaatagccacgttaatttacttatgctaaaaattaaattcagcgtaactgaagacccaaccataagaaataacagagtagctgagtggtggacactgttcggatgataaaataaacttttggaacaaaagcaaagcaattttttgagcatcaatatctgaaggctttttagtatagaaagaaactaaggattacgaatcacatcaagcctgctggctggcactgatcaacaaatacaatactttctaccaaataaaagaggaagctcagtttatagaatacaaatgctatgcgaggaaaggttaggaacagacataagaagaacaaacgaaaaaagtattgctttcagtaaaaataacatacccaaaaagaggaaatctccagctcattgtactagagcaat

SEQ ID NO: 49620 - DNA, 545 bp, Oryza sativa
agaaaaaagtgaatgtgcacatggcctttctagaaagaacacgatttgcctctgagatgagaaaatactattgtaattgtacctcattagtttctttttagaaaatggaataaacccgacctctacatccaaccggatgtacacggccaacctcattagtactgcattgtaatatgtttgcctgcttttctaatgatgatttgtcccattatcatctcttggggtgaacaatgcataactggtaatatatagattgcagttcctgtgccaggctctagcacgtgtactagttttggcatcaattgttttcttaaaatctgtggtttattttgacacctgaaaattgagttatcttttgtagcaactagccccattcaacgcaagccagtagcagcccacattgcacagcttatggagtacagtccctccctggcgaactcaactgaacaaccatgaatacatgaatcatgcgccatgtcaataatgcatgacatgatgcctgattttgattttagtagttggttttccatttttgtaaactacga

SEQ ID NO: 49621 - DNA, 1501 bp, Oryza sativa
gaagtaaaagatgcaaggctcaagtatgcgattattttgatcacatgtagatgaagaatcatagtgtatttctttgtaactcatatatgtgtcagacagttcaatttatgtgcaacatatcataattgcagccttaatccaatacaattttcttataagagtgattagcaaaccacctagagaccttgttcatgtatgacagaaaacaaagtgatctcttttacctctactgttgcatacttgctaaaaacaggtaggaataaaccaacaattttctttgatagagaaaaaaattgctacttatggtctaactcaattttaacagaaaatgttgcgaaacaccaaaggaccatttggaggtcgcaagctaaccagatttaaattgcaagtcataacataacacttcaagttaaacaaacatgcctgaagccccaaatagagtctgttctccttgtggtacaaccatccttaagtaaagaacccagtcccagttcgtcaaacactacatggaagaactcatatggagtcccaacatatgaaggcagtgcagctgaaagagtattaaacgtcatatgctattccgtaaatgaaacttaccatgagaacctaaaagaaaagctaagtgaaagaattatactgtttaagcactaaatcactggtactactgaactcaacccaacatgtccattcacaaagatcattggtttagaagtaaaatcattggtctagaagtacctaatatacatacgaaatgcctaaagcaacctctccaagcttaataacatccttgaccatgacagatcaacccaatgaaactgggggctctacggagtattcaacgccatatgctattctgtaaatgaaacttgcccatgagaacctaaagaaatgctaggtgaaagaaggataatgtttaagtgccaatcactggtgctaacgaactcaacccaacaaagatcattggtttagaagtacctaccatacatacgaaatgcataaagcagcctctccaagcttaaaaacatccttgacagtgacagatcaactcaacgaatctgggggctctatggagtttcatgcaaacttggctaaatacaaggcgaacactcagattatcatgtcgaattatttagccgattggatcaccggtttcaaaggcaaagtactacctaatacgggcaccattatacaccactaaagctaattaaataacctaccagcttatcactacagctacaaggataaaacttttatcataccaaagtttagctacaacaacacacatcgtgacttcgcgagtcatcaataaagcaagaaactttttttcgcggccaaaaacagcgagaggccggccacgattgacaaccgaatcgcaaccctcaccttgttgatctcgagctgcggcgcccacgagtggagcagggcgaagaagtagtcgaacatctcgacgcccgtggcgaactccttgggtcccagcttcaccggcttcgcctcctcttcc

SEQ ID NO: 49622 - DNA, 297 bp, Oryza sativa
ataagtgagcacagctgtgctcacctaacagcatttattgcagtctggtcaagcgtgtcacgctgcatgcaacgcagtacagcgcgttcctttatccggtctgtgaccagtcacagaccggtcagatcacgggttaggtggcggctggcggtctgacgcacgccttgccccatcccgtcaagacgaaagcctctaggcactcgtctcaagccggagctagggtgttatctcttagagatggcacgttagccctggtcagatttataccaggcttcatcctaaccattacaggcaaga

SEQ ID NO: 49623 - DNA, 1501 bp, Oryza sativa
gaaacaaccagcccagtgccatcgatcttattcatgatcttatccaaattgctttttagcaaataaaaaatcatttgctagtaaaacttttatacacttgtcagactcaaaaataaatactgtaaaatatattatgatgaacaaatacttgtacttggttctgccgtcaacacatgtgggccctacctttttaacctttttatatactttctccgtttcacaatgtaagtcattctagcattttccacattcacaatgagggagtattttttattgctgactgactaccacgtgtgcgctacgtaggatcaaaaccactctaaagttggttaggagggtaattcgttcaatataaaaagttgatgatgaaaaatgtctggtttttgaattgaggaggttaattcgtacttctacagtagcaggggtaattttgattttctttcctatcaaatgatatatataatgaaattaatttggtgttgtagatgttgctaaatcttttgataaatttgatcaaacttaaaagaaaagtcaaaacatcttataatataaaatagatgagtactattcatagtaaattgcatagtgactgctatcaatgtaacgaacgcctcctcgtttgccaaaaaataactagttgttctcaaaatttaaatttagagttaaatttaagatatttccaatctaaatatctttttcaaatattgccttttaagtcggtatataatataaattttacttactcccttcatttcagattacaagtctttttaattttagttaaagttaaactgctccaagtttaaccaagattgtagaaaatagtaataatattttcaacccaatataaatatattacgaaaatatattcaattatatatttaataaaattaatttggtgttgtatatttatctataaatttggtaaaacttggagcaatttaatttgggtcaaaatcaagacgacttataaattactccctccgtccctataatataagggattttgagtttttgcttgcactgtttgaccactcgtcttattcaaaaaagtttgtgcaaatataaaaaacgaaaagttgtgcttaaaatacattggataataaagtaagtaaaaaaaataattccaaattttttttgaataatacgagtgttcaaacaatacaagcaaaaaattaaaatcccttatattatgggacggagggagtataatctaaaatggaaggagtattttttttaataaacccgaaaagaaaaaagaaaaaaaaaagcagacatcacctgagtacacccgcggcagccgtcacgcttcggtcactcatccactcccaccgcagccatccaacgaaaaaccctaaaaacccctctctctccccttcgcttccatccatggcggaccacccttcgtcttcccctacggcggccacgtctccgccgccgcgcaagaggccgcgggacgcctcgccgtcggaggaggaggagggcggcctccccggcgggc

SEQ ID NO: 49624 - DNA, 1501 bp, Oryza sativa
catttaagaggaccgcacatttttcccatgtggttcacaacctagcgccagtcaattcgggggcatggaaccaaaagggggcaacgtctaggaaaaccaattcagtagtagtgacatgagagaggtttatcttcttcttccaattgatttctcttcaacctattaagatcatagagtgttgtcttttatgcaaattgaggtgttgtttattatcatggctactttgtattataccatagtataaccattacaacaagttaccgataacaacataaacaaatatgataacaaaggagagatcggggtcccacctgtcaaaaggagagatctgaagcttaccgatagcctagattataaggctacagctcaacgacattaggagcatatttagaaccgtgtaagcgccataatttgagggtctgttcactttaatgtaaaaaaaaaaccttaccaaattttggtaatatcaaaattttggtaacttgctaaaattttggcatagtttttgatatagttaccaaaatttagcggcaaactaaatatagccatttttttagcaactttatcaaaatttagcaatgttaaaaatgacatcaaagtgaacaggccctgaattatataagatatatcgtcgactctctcaaactaaaactagagccgtagcacatgcatggtcggcaaaattagctcatgatgtacatatcaagttagcatgtttatgctacataaaaaagcattgctggacatacgttgtagggcttgtttttgattcgactaatttaattcgaagaatggcgcatgagttcgcgtgaagaggggagggatgtttgacgcctttgataatatttcaagtatgcttaaagagcaaacatgcatatatatgcatttagtgatgcgcgtggattgtgttcatccaaattgcactatacgtgaaaaaaaataattttggctttttagctattttgggggagcaactccattacttctcgaattgctatacaatgtattttttttaaaaaaatttatattgaagtttcttttttaaaaataaataaatcaatttctaaacccatattagtaaatagtcaattaatcatgtaccgatcaaatgaattagtacgtggtagggacgtagggtttactgtttagctcatcggaacatctagatcgaacggaccctaaaaaaagtctcatacgcaacaagaccccaatccacaaatcgaggaaactcgaatggccatactgaaaattcactcaataaccgcgataaaagctaggtagctgacgtggcacagcgcgcaactacccgcccggcacgccgcggccgcgagcccttgtgtcaccgacaggtgggccccaccaccccgctccgcttcttcttcttagctcactccaccccccggcctcaccgcggccggccgcaacgacctccatccaccacctcccttctccaccttccacgccccttctagaagcttcgggaagaggcccatgggcgcct

SEQ ID NO: 49625 - DNA, 199 bp, Oryza sativa
caaaacccgcatatgttatcctgttcgaaatctattgtgtacttgcatacatgcatgcatgctgccattgagataggaacgaagtattcaaggagtaacgaggagttgatctaggaacaataacaacatcaatgcacaagggcaatctcatcccatacgtgagaaaaatgctccaacgacagattttctcatccacagc

SEQ ID NO: 49626 - DNA, 1501 bp, Oryza sativa
ataggaaaagaattaataattacttaaattttttgaataagacgaacggttaaacttatgctaaaaagtcaactgcgtcaaacatttcgaaacggagggagtatatgttacctgctcaacatagacgaacttgcggttctcatccttgagcagcgctggcacgagcgaatccagcacattctgcacgcacgccccctgcaaccaaaaacacccagaaaaaaaaatccaattcaaaacaagcaacgtgacgagaaacgagataatccgtttccaaaattcagcgcatcaatcatgcctaaactagctcccccaaacccgtagaaatttctccccccacaaaaaacggggaaaaaatcgcggaaattccgaggactgcgccgcgcagctcgcgctctcgatcgaaagcgcaagtagtagtagcaacctggatggagttgttggatccgacgtagtactggtcgacggtcttgagccacccgacgtcgtcgtgggtgtgcggcaccacgtgcacgttgagcttcccccccaccacccccgccgacgtgttgtaggggatgtacacgcactccccgacggcagcggcggcggcgaggaggagcaggagcagcgccgcgaggcgggcggcggaggcgcccatgggcctcttcccgaagcttctagaaggggcgtggaaggtggagaagggaggtggtggatggaggtcgttgcggccggccgcggtgaggccggggggtggagtgagctaagaagaagaagcggagcggggtggtggggcccacctgtcggtgacacaagggctcgcggccgcggcgtgccgggcgggtagttgcgcgctgtgccacgtcagctacctagcttttatcgcggttattgagtgaattttcagtatggccattcgagtttcctcgatttgtggattggggtcttgttgcgtatgagactttttttagggtccgttcgatctagatgttccgatgagctaaacagtaaaccctacgtccctaccacgtactaattcatttgatcggtacatgattaattgactatttactaatatgggtttagaaattgatttatttatttttaaaaaagaaacttcaatataaatttttttaaaaaaaatacattgtatagcaattcgagaagtaatggagttgctcccccaaaatagctaaaaagccaaaattattttttttcacgtatagtgcaatttggatgaacacaatccacgcgcatcactaaatgcatatatatgcatgtttgctctttaagcatacttgaaatattatcaaaggcgtcaaacatccctcccctcttcacgcgaactcatgcgccattcttcgaattaaattagtcgaatcaaaaacaagccctacaacgtatgtccagcaatgcttttttatgtagcataaacatgctaacttgatatgtacatcatgagctaattttgccgaccatgcatgtgctacggctctagttttagtttgagagagtcgacgat

SEQ ID NO: 49627 - DNA, 1501 bp, Oryza sativa
cgacgttttggaccacttctccctacacattctcctatccggggcccagtgatgcaaacacaaacaaaacccaagtcgcagaggttacacggcccaacagaaagcccacctatcctctccccacggcccagtccgcgtccgactccgcgtcgcctctcgcctcctctctctcttcttcttctcccccaaatcccaattgcttattctccttcgacaagccggccaccgtccatcgctgcttcgcttgctcccacccgaagcaacgcgaacgcgacgcgctcccctccccgccacctcggggcggtgagaccaggcctccgcgaccctcgccggccgtccctgagcgccgcccgcaccggcaactcggtttcgaggctgatctcggcaggtttgtgtctgccctcgatccaaaaccggtgctgtggtttgtttcacgatcccgttaaagttgtcgaatccgttcggcgattgtgattcaggtagaggaattagttttgcaagacaggttttacaaggaattttttgggggggagtgggggacacgtttttatgctgttgttctgatgacttcttgaaagtcacacccaagttagttagttatcagcagctcatggtaatcttcagtgatggattaaccgctctacggtatctaggcaatttgagagtagaagcaagccgtagcctacagaacattttgccatccaaatgcttggcattttgatttgattacgcaggcagtaattttggagtagaaaacgcgtcctaccgaacatgagacttatcacaagtatatcgttttttgacaatagtcaataggaactctgcgttgaggggtttgatttcaatttgttctagatttgatccattcttcttccttttatttttctgatgcaaccaacaattagtctggcattggcgttagcgattaccatctactagttattttccgttagaatctatatgcatgtacagcttattgattaccaccaactgttggaacatatgtaacctgctatttctttttatgcagattgctctagtacaatgagctggagatttcctctttttgggtatgttatttttactgaaagcaatacttttttcgtttgttcttcttatgtctgttcctaacctttcctcgcatagcatttgtattctataaactgagcttcctcttttatttggtagaaagtattgtatttgttgatcagtgccagccagcaggcttgatgtgattcgtaatccttagtttctttctatactaaaaagccttcagatattgatgctcaaaaaattgctttgcttttgttccaaaagtttattttatcatccgaacagtgtccaccactcagctactctgttatttcttatggttgggtcttcagttacgctgaatttaatttttagcataagtaaattaacgtggctatttaatatgattcacttattgccttaagctttcctgaaaaacgagctcctctggcttactgtctttgtttct

SEQ ID NO: 49628 - DNA, 1501 bp, Oryza sativa; identical to SEQ ID NO: 49257

SEQ ID NO: 49629 - DNA, 214 bp, Oryza sativa
ctattaaaataatggaggtagtatatataaattgcaagcatcactagttctcctctattttggtaatattgacggtcgaaactgatcgataacgaccgtcaacaacagcaggcagcccagtgctgacggcagcggcgaccgggcggacggtcggtcatcgcgcgcgcgcgtgaaaatcgaacgacgcggccggattttgggtggcgtcggcagg

SEQ ID NO: 49630 - DNA, 262 bp, Oryza sativa
agtcttccgctgcaaatagatgaaattgatgaaaattagtgtttctaaaattaaatttcgaaccaacgggagaatttaattttaggaacattaattatgtgctatgatgttgtaattttctgaccaacgttgttaaatgcaatattatagttatggttatatgtgttatgtctaattctgcccaacggtgatgtaggcttaatgcataatattttaatgttaattttgttctcaccgcacatgattatttcaggtggctact

SEQ ID NO: 49631 - DNA, 329 bp, Oryza sativa
aaagaatatatagaaatttagtttatttgctaaagaaggttttataaaaaagttgagaaggaaaatatagtgaaagttaatcttgaataatagaaaccaaagtaaaatgccaaattaaaataagtccaacacattaatattagtttaaaactttataaatagtaaatatataattattcggtgtaatatttcataatatttgtaggaataatgatatgtcattattgtgtgactgttgaaagagtttgtaattattttataattattgtatgactgtcattattgtacgaataattatgtgtgtacgattttttttcatgttatgtaga

SEQ ID NO: 49632 - DNA, 356 bp, Oryza sativa
gtccgcatattttgattgagtttaattagcatttcgtcgccatctgatgattccgaatgattttctttgtgtatatatctcgaaatttgaaattcggtagaatcatgaggtgtgtaattacatatgcaagtaagttgatgggcgtgatcgtcgtgtcctaatcttcgaatttaaaccatgcacaaggtagttggtggtggtgcatctattctgttagcgatatggaatttgaacgtgtttcttatatacactttagtgtcgttgtagagcactaaaattcagttgtgtgctactggtattttactgtcctgattttttgtcgtagtttacccactcacatatatcatcactgaaac

SEQ ID NO: 49633 - DNA, 1501 bp, Oryza sativa
ttggtcactgattccaacatataaaattcttttattctaaacaatttagaattgaaacaattgtaaaaaaaaagcttagaaagggaattgaaacaatttagaatctactaaaatttagccaattaacctttaaattttaagctttgctaaacaaactaaagatgcttatatttaataatattgggaataaggccatgtttagttcctacacaaaaattttataccatatcacattaaacgtttaaacacctatatgaagtattaaatataggctaaaaaaataaataattgcacagattgcgactaatttgcgagacgaatcttttgagcctaattgctccatgattcgataatgtggtactacagtaaatatttgttaatggcggattaattatgcttaataaatttgtctcgcggtttaccgacggaatctgtaattaggccctgtttagttccaaagttttttttccaaactttcaactttccatcacatcaaacatttcatacacacacacaacttttcagtcacatcgtttcaatttcaaccaaacttccaaacttcagtatgaactaaatacagccttagttttttattagtgtccaaacactctatacaacactatataatattcgatatgacacgacaaaactttataacctagatataaatgcacgccacgaccagtcaatatcttggaatctgtggtcaatcatgcattcatgccgctcgtcgtacggtactctcgtcgtccactcgtctccgctcatcagctcagctcacagcctcacaggctcgctcccgtgattgcctggaaagaacaacaaagaggcggtgttcggacctctaggttcctaaccatctctctcattttctacacctacgcttttcaaacagttaaacagtgtattttttaaaaaaaatttatatacaaaagttgcttaaaaattatattaatttatttttttaaaaaaatagctaatacttaattaatcaagcgctaatgtattgtttcgtttttcgtacgcactgttcctgctggaacgagcaccagcgcatttttttcttctaatatattgacgtgcaatccttttacgcgttcgcgaaaaaaaaagcaccagcgaacacagccttaacttttcttcactttaatctaataaccatttaaaagtgattggcttttggaaaacaaaacgaaggaagcatatgcggggataagtccattttacaccctttaactcttcattttgtttcaaattcatcctcaagctcccgaaccaagcatttaacaccgtccaactatcgatacttggtaaattacatttctgagcggtttataggctagttttggtaccgtaggatgccacatatcagggactcagggctaactttcttctcttctcttcttactctctcgcacgggcgcacctggtaggcgcattgcctcggtgaactcgcatggcgtgtgccaatgagcggccgctcaccaccggcatggaggaa

SEQ ID NO: 49634 - DNA, 1501 bp, Oryza sativa
ttgcgatatacagtaatcattctgcttccgattacacctcagctatgttcggcacccattttcccaacccctctccctcgttttccgcgtgcacgtttttcaaactgctaaacggtgtattttttacaaaaagtttatacgaaagttgcttaaaaaatcaaattaatctatttatttttttaaaaaatagctaatacttaattaatcacgcgctaatagaccactctgtttttcgtgcataatgttccctcgggaaccaagaatcgtgaacacagcctcaatccttttttattctgtcggccaagtgagggctcataagggcatctataatgtaagctactcctagagtgtcctcactaactgaggatactcataggggaactcagctcgtaatagaggatacctctggatagtctcctcaaaatctgaagcaacttaatagagacactccaacccacaatgggtatcccagcccacaaagtcccatatttattttttctaccctacccctaatctctctctctcccaccccctcttctctttttttcgctgccgcactcgcctctccctcaagccgcagttgcctctccctctctccgccgccaccgctcgcctctcccgtcaccggcgtccaccgccgctcttctttctccctctctctcgttgccgcccgtcgccgctcgggggtgccagatccctccgctcatcgcggggtcgtcgccgctgccgacgggggagccatgcgcggatatggcatgccgacgcggtggtcaacggcgagccagatccctccgctcgtcgcggggttgtcgccgtcgcagggccatcgccgctgacgacaggggagccacgcgcggatctggcatgtcgacgcagtggtcaacggcaagctgtggccagatgtggtcttcttctttccctctcgccgctgccgtttacctctccctgtccctttccctctctttcccgtcacggtggtcaacggcgagccaccggcggcggcgcggcagatgaggacgaggagccggcggccagtggctgtggttaagggcgagggtacaaggggaaacatcggggtagggcgtcgtgtccacgagctccccacgcttcaacgtggtgcctggctcggaccccccacgaaaaagtaggcgaggcgcggagagagccgcgcccccctgcgaggcgccgtgctcccctgctggggaatggttcggcctcaaaaagcgacgggaggcagacggccgtgagcggagacacgggttaagagtacccattgctgatggcctaatagattcgtataacttcatacttagaatggtcaatgcccatatctgaacttttacatccgtgatcactgatcagctatcgtaatgctttgttttttcagcttatttatcagattattaacggattatttgcttttcaaaaaaaatataatctcttaaaatatttttttcctactgtattccttagccattttttaaaactagttgttatattt

SEQ ID NO: 49635 - DNA, 1501 bp, Oryza sativa
ctaatgtaggtgaatggctgcggggtcatgatctctctgactagttcgcttccagctaagaattttagcatgctgtaaaatgttttcgtgattttaaacttagtttcagcatgctctttgtctgttggtagtcttactaaagtagtactggaatacccagtgcttagaactctgagaacttatattttgaacatggctcctctgtgcagtgagggtttgtttatagtgcttgtaatgatatggccttgcatatcgaaaaagatcgtactcgcactactactaccttgtactcctcctagtacatgttgaaggacttcattttcagatacttaaactgcaaagttcttgggggagtgtgtgctctgggtgtcatatgggaatgggagtggggtgtatgttgctgcttctgtggcgcacgcggaatcaattgcggcattaagttgtttgcaccacttttctttatatctagctgctgctgttcacttcacatggagaacataacaattgtctaccacaatgattgttaggatacaagttgccgggccgcgcgcgtgcaaatatggcccatgtaaagcccataagaaatggcactcaaaacggggcccgtacacgagatgcagcaggggatactggcctggcctggcctgcgcagcctctgctgctcccttctgttgtgggcctgtgctgctagaatcttactacgacacttgctcgctagcaccagtagtgtactgctggttcagatgctcccgtgatgtttacgcccacctagaatcttactagtagtaggccctgtttagttgtcacaataaaaattttcacgcacatcaaatatttgaacacatgtatgaaatattaaatataggaaaaataaatcaattaaatatattgcatgtaaattgtgagacgaatcttttaagcctaattgtgacatgatttgacaatgtggtgctacaataaacatttgctaatgatggattaattaggctaaataaattcgtatcgcagtttcctggcgaaatttgtaatttattttgttattagactacttttaatacttcaaatatatgttcgtatatccgatgtgacaatcaaatttaaaaatttaccaactaaacgaggcttactatgctagcattccaaaaactgtgtaaaattcgccgaatctagccagctgctaagtgctaacggttaatttcgacggttcattcttctagtttagcttccgagtttatctgggcctgtttgagggagcttctagctgctatagcttcttctaaaatcagaaactttcccaatcagtctatcttttgatccagattctgagaagctgtagttgtagaatttataaaataaactagaagtcagaagccagattcttataaaccggctaccaatagctgcttctcaaagctatcccaggtcctttatggcacgtcgtacctgcagccgttttagccatttcgttgttgccgtgtcggggggccttgaccgaccatca

SEQ ID NO: 49636 - DNA, 273 bp, Oryza sativa
  unsure (1)..(273): unsure at all n locations
ccgtgcaatgaanatcaaatgtctnnnnnnnnnnnnnnnnnnnnnnnnnnnnnnnnnnnnnnnnnnnnnnnnnnnnnacttgataatttgttatagatccctggtccttagttctaacgttgtgcactcttacttagaggacctcttaagaaaacaatattctatatgaagaagcgaaaaaacggaaaattgaaccgcgctctgaaaactagaagtttaggggttgattttgcaaccctcacccctttccccaaaccctagccgccaccattc

SEQ ID NO: 49637 - DNA, 588 bp, Oryza sativa
catgggaaacagatggagattatttgtgccaaggttagttttcacttcttattgagttcaaaagttatttgatagaaaagtttgaaagtaaaatttcttaatatatataattttagcactgatttgttgccctcccctatagaacaagaaacctgacaatcaggacagccatatggtacatgcacataaagttggtggtgcatacaaggttgtttttttattcaccatgtttacaaatatcagtccattcaaactataacatgcatgattcactagtattatgattgaattggagaacaataattggctctgtttggtctttctttctttctatcttgtggttaaattgcaaaccatgatccaaatttttttttatagaaacaacagtgcagcaaaatggactttatcactgacaattcaatggaggtattttactgtgaaattatttatgatacttgaatttcttaaagtacattgataatattgatggatgtatttatgcacttcaggttggaactaaagtattcttaaaaagttggaaaaatcggaatacaaacatggctcttgccactattgtaagttgtgatc

SEQ ID NO: 49638 - DNA, 826 bp, Oryza sativa
ttatgattcttgttctttttctaatttatttttgcattgtattaatgtcgatattacgtagtgtaaaagatcaatatggtcaattaccggccgatcgagcgtcgttttcaaacagatgctaccgattccgaccgttttcacccctaagtaggtatcacttagtagtggatgagacgagaaatttgtgcaaggtcaaggacaattaatcaaacgtcctcgtagtttatgctttcgagcgcaacataaattttgatgaaatttgctgagttcttctaaatggtgtttggtgtgatcagttgtcttgcagatccggtcatgtcaatcaatcaggaataaattactggactgggtttctttaaagaagtttttttctttccccatgtctcttattccccaatatttaatatcgtctccaaacctgcttcaatattttttttattacagcccatgtttgccgaatagacgtgcagcttaccaactaccacgtaggttgagatagggctattattactcttgtttggattttacaaatatagtaggatcactgatttaaccatgtttgcagacttttgtccttgcgatcgggactattcttggtccaatgaccagactcaccgcacataaagctgtggcgctatgcctttctcttgcatttcttcttaaaattggttgtagtattaagtttgaaatcttcttgttatcttgagatgcataagagttctctcgacctttttgccgcggttgtcctttgctctcgccttatcctcaacacccaaagaactaatgatatcagtaacattgaactcttgcctctttgtgttttaga

SEQ ID NO: 49639 - DNA, 449 bp, Oryza sativa
ttataacaagatgtatgccggttgccacaatgcaaaaagtgaattctaagaatgcatactatctgcagaaatgctatgatagattgtccagaatagagctagcctaatactattgtgacaaataggacttgagtattttttcaagcttgcaaagcctcgggcagttgcttaatcatgggatcatagtgacatgtcgaacttttgtttacgaagtttgcaattggacaactctagattcctagagtttcttcggttcaagaacagaacccacacatcattgctatgatgctatctttttttaattgaaaactctgctatgtgaatttcatgacagtgttttggtttatctagcgatgaagtgcagaaatattattttcttgatgaactgtagtttctagaactcaaactcagatgtcatggtctaatgaaactttggtgtccatgtctaa

SEQ ID NO: 49640 - DNA, 1426 bp, Oryza sativa
ggctaagcacaatttaatcctaataaattttatgtgcccacaattaatattaagagattaatatcatcttaaaaaccaacgtggagggatctcaacttaaataggccgctataagagagcacaagttgcgcagttaatatggtggtgggattgccacacgtgcgtgcgtggtgagcttgagccaagggcatggcgtggctggctgctactctagctaacattatgttttgatggaaaacataaccgacggaggcactcattattccattactccttgattcttctgttcctgcggttaacagacagaaaattctatcgggttgattcaccgacggatgcgctcgttactctttgattcttttgttcctgcgctgcgcttaactgatcgggagttcaattggattgattcttctattcctgtattatgcatgcctctgtatctcattgttttttccattgctacgcttaacggccggggaagaattcaatcggattgattcttctgttcatgcgttgcgcttctatatctctggtaaccgcggcgttgctcttctgtatctctggtaaccgacggaggcgctcataactccagcagcaacggatgcggaattgaatcggattgattctgttgtcactcctgtaacggatgaagaattcaatctcgatttgattccttccggaatgttactctctcgcgcactatataactcctacctccgagatagacagagtagatacaactcctctcttcatcctctcactctattttcttcttggcaaaacactttgtgtcttctgttcctgtgttgcgcttctgtatctcggttccaagcacccgcccgcataggttctcaggacgagcgcctcgggatatccggccgcttgagtacctcccacagtttggcatgcgatcaagttcttggagagttcattgacacacgactgctctctgcactgcatcggttactttctttgcatcgacatgtcaaccggcgtcggcaatggttgaaatggcggcaaccggcacaatgctggaggtgatggcaccggcactagtggggccagaacggcaacaccgatggatgcatcaacactaacactgcctcatccagtaccatagcgttctcggggtatgtcaattttattattgtagtagtaaacatgcatgttactagatgatgcttattttattatcagtatattcatgtttagtactatcactagattattctactacatacacgtcatacttagtatgatgtttttctggattaaaatataccgattcatgactatatttccaacaatctaaaaacttgataggtctttcccgtacttggctttgctgcatcactaaaatttcatgcatttgatggttcaaactataagagattgaaaccacgtgcactactgtggttgataacca

SEQ ID NO: 49641 - DNA, 871 bp, Oryza sativa
ttatataggcatataagtttacatatctcataaaagtttttgaataagacgaacggtcaaacatatgctaaaaaatcaacggtgtcaaacatttcgaaacggagggagtaatatataagtgagggaatcccttatctcattgactagcttttggggtgggaaataccctttacgatcatataaaaacatacttagtactccaccagaagcatggccccataccacaaaatgtttgataataagcatcgtgatacatgaagcacatgaaaaacatggtgagcattactgctgatattcaaggcaaaacaaagaatataaaaatactccctggtttgatttgtgaaaaaggttaaaattcatggggggttgttctgcctgacatgtttagagattttggtttgcagtagctgggtcagtcttcgtcgtagtaattggtgtaggggtgttaaagattcaaggcccatatattcttccgtaatcatacctatccttgaaatattttagttaaaaagcatttaaaaattaaaaaaacccaccctattttggacccaaccctcaaattctatagtcctgccctatagtaaaggttgatgaggcacattaaattttatatagtcctcaaattttacgatattgcatgtactcatacacattaaatggaccggcgcttgagtatatttgcatagcctcgtcacgacctacgcagggcctgacaatctgtccgctcattggcaaataggcagcgataggtaaaacataatcatctcgcaaagacaaaaacaagaaaataaaaaaagaaaaacatatatattcagtgtccaagcgggttaattggagaagaataagaattaacggtgggcaatgcgagaca

SEQ ID NO: 49642 - DNA, 994 bp, Oryza sativa
acccaatttatcatttttttatatattttctatttttagcagcaattttcatttaagtccctgtgttttattcaatttagtataagcagttcatcagttatacaaattactatgtaatgttcctttagaccactgatgttatatgttccttaacatatgtgcttattaaataccctgctttactaaatttatttgttgtcttaataacatgccttttgcatattatttcaagacacgctctacttcctcgctttattaatttacaaaattctataaattttgtactttgatttagcaaattctcttaattatgtacaacatgattaatggaggatttaatgcgtgttcgactgcacattttgactcagaaattactcacatgtagatggagtcctacaaattggccacactggtcataacttagggagcgagtatctcgcccatcatcaagtggtctacattttgagatgattacccgatggagtcctacaaattggccgcactggtcataacctaggcagcgaacatctcgcccatctcacagaggtctacatctcacgatgattacccacatgtgttattttccgagaatatgttttgaaaaatgagattatttgaaatttggttgaacacaaggtagtggagtcctaaacattggctgcggtatattcaccagaatatatttgcctagagaccatgttctaggcagcaagtataacttgcccactattaagggatctactccactatttaattacttggagattatccatattgtgccacctaatttcgaattctaactcaaattgtcaggtctgtaacctacatcttcaaaacattacagaatatgaaatcttatatttcgcattgagattacaaccacaatatcatgtttttattaatttacatctgtaaattaataatgttaatcatgattatagggacatggcaactatagagttcgacgaactcgccctcgatgggagtaactacc

SEQ ID NO: 49643 - DNA, 671 bp, Oryza sativa
acctaatcagctagccatatctctaatttactccataatctttcttttgcaactagtgcccattgcatgactcttatttctgttccttgtgcccatagctggcatgtcaggagcaacagaacatagtggctttcccttatcttgctcttggcctttttccatgcaactggtggtgtttgctctctaagacatggtaggattacaaccatgttagatggctcaggttggttgaaaccagtaagtgttcttggtttgaaaatgagagttgtgaatatattgcatagagcgttcttcaaaaaaatatattgcatagagcaacataataccagcaaattgacataactaatctagttacttacctaactgatctacttgaacctgagctattgttccttgtcctactgtcctcaatgaaatgaatgttttggctatggaaaatgaatttttatgtacctaaccgatctaaatccattatagaataaaatagagaagtttggttaacctaggaggatatgacggttattaagtaccgattttgactgtcaactacctcaataaatgaagggagaactaacatttcttacatgtatattatgtagtcccacttgtcttggagaaatactatgtatgcaaggaataaacaaataaaataaagttgaaatgagccggca

SEQ ID NO: 49644 - DNA, 538 bp, Oryza sativa
tggtcggggggcatataagccccagcccgaccgttggtatgaaattccgacggtttctctctcataaacatccacaaaattaggggggaaggttttcgacctcaaatctttgattgggttccatataaaaggtgtagagcttgttctcctccttcatttgcttccatttttgtcagttttcatcggtggaatacgaagaaacttgcacttttataaatggaatagtgtaggcacctttttgttttttttatttttttagcaaatacataatgattccattacatgtttataaaagtatttagtacctacattgaaaagttgggtttgcctctattaaatttattttcatttggatgaaaggatgattttttttcattttttagaaatggacagtattttattaatgcttaaaatcactgtgcggctatttaaatagttcgtaaaactttaaattaccatgtgattcgttccctccaatttaaatacattcgtgtttgaatcgggcatggatgtattaatgacaagctttattgtaagt

SEQ ID NO: 49645 - DNA, 290 bp, Oryza sativa
  unsure (1)..(290): unsure at all n locations
tacccctaaataaagagtaacatattttcatgaaaagtatatattacccgcctttttttatagagaataccccttaatttaatttgaaatgtggttatccacttagatttagttgttatgcgatnnnnnnnnnnnnnnnnnnnnnnnnnnnnnnnnnnnnnnnnnnnnnnnnnnnnnnnnnnctgatgaatcccctaatgatttttatcaaaatcattaagttaaggtggatacacatcttgtcatatgatcaaatgggttcgccaaaaatcaataatcagacaacaaaa

SEQ ID NO: 49646 - DNA, 1501 bp, Oryza sativa
gccgtaggaacgtcagatgcgggaacgcgacctcaatgccgggagggagcgcgccggagagcctgttcccggcgaggtcgatggagcggagccggcggagcgacgcgaccgaggcggggaacggcccggagaagcggttgccggcgaggaagagcgccttgaggttctcgagcggggagaggtccgggatggggccgtggagcgcgttgctcttgaggctgagcacccggagctcgacgaggcgggagagcgtggcgggcgcgaacgtcccgttcagcccggacgactcgagcaccaggcgggtgatctggccgtcggcgctgcaggagacggccgggtgcgaacacggcgacaccgccagagggaaccgcagatgcgcggagggatccgccttggcgaggaatgccgcaagcagcgcccccggggtcgccgtcgagaccagcgtggcgggcggtggcacggcccgcaccggcgcgcgaggagggaacgtgggctgcgagtgcgacccgccgcctaccgccgcgggcggcggccgtacggcctgcaccgggggaacagcgggcagcgtaggctgcgagtacgacgaggcgacgtcgccggcggcataggcggcggcgacgagcacgacgaggaggaggcggaggcggtgccgcatcgtggtgggcgcttgggttggggggttttcgggggggttgggtgagcggtgggtttcagtggagtgcggccgcgtgatgtggagtggagtgaagtggcggaagcggccggggtggtgtggtgggtgtgtgtgtgtgtgaggctcgggaagggagaggaggggtcagagagcggtcgccacggcacgtgggtggtcactgcagcttagtttcccgtgcttcttttggcacttgatcggttgatcgtttggagagcctgcaacgctgcaacgggtggataaagaggcacactttcgagtttaaactcagatcacggcaaccaattgcacgcactcatgctcaaagttcaaacattcaaattctaggaaagaaaaaaaaaacaaatccattgcaggtaacatatcaggctctacagaaagttagtactccatactccagtagtgctaatattcaggagcattttggttatccatctctggatctaaacaaagtttgagtacctacctcctcacctgaaaaacattctaatgtgctaatggtaggaatgtaggattcgccggaaaataaaaatactcgggagaatgtttgaaaaagagccgttgatagcgagcagccatccagtactataccgaagtcgacgtagcggtccattgttaatttgactgtgctgctgctgcctcctgctgctgctgcatgggtgtgagggcccgatcgcagttgatacctggggccacgaaattcaatcagcccgtgggacccacgtgcctgtcctgctcctcctccccctcccacggtggagtaaaagttacagtgttcttttgtcggttgatgggagcttcgctgtgttt

SEQ ID NO: 49647 - DNA, 1501 bp, Oryza sativa
gtaactaaacatggtgtagctacttcctccgttccataaaaaaccaaccagatactaaaatactaaaagatactaaaagtgacacatcataatataataaatttagatatacatctatacagatttattgtactatgaatatattatattcagtcttatatttattttttttagacggaaggagtagtcaccagctgctgctttgggccagtttgctaccactctcgtgaagggaaatcgtgattagctttggcacggctgaaagctccgtttgtacgaacagatgcatactgctagtgcttttaatataatcgcctcgtgaaacacctcgcttttcgctgcagcgcggcctttaaaacgacacgatacggtaaactctctctttcaccgtgatgcatcaccgatcgtaattcaaccggggcgcaattaactatcgcagcttaaacaggagcaaaaaaacataacagtcaaaatcttgcagctccacgtaacctctctcgtcacctccttctacatgtctcgattgacacggtaccccaatcttccaaataaacaacccactataattgcctaggctacaggctagatagactaatacaggaagatgtcaccgtatttactagtaattattttttcgtgacaaacaacatatcgttgataagaatatgtttataatgattccgttttaaaatatggcagcccagtttccagaggtgctacgtagtgtgtacgtgtggaatctttataaggtcattttcaatgagagttttattttcattgaatagggtatcatgtcaatatttttgttaatatgataagtaattaataaagaaagagatgaaatgagtttacactgtttttaatgtgacttgtctctacatgtgttgcttataagattaaaaaaataaaaatgtgtcgtatgggctattttagcaatcgattaagtgttttgtttgtgtgggcaacactttttgaaaaataaaaatgaaacctctcattagaaggggatggacgtgcaaatgtgattagaaccagttttataaaaagatataggttgctatgatttttttcagtacaataaatctgggcagtaatatgtccagattcattgtacttagaaacatctcatttaatattagattgggtttttaagtacggagataatattagtttgggttttttttctagaggagagagtatgtgttttaaaaaatagattaagttgaaattaaccccaacccaatccaacctgtccacctcagtggcacctttattaaacgatcccaatacaaattcgaaaccaaaaaaaaaaaatatcctactggtggtcgactagattaatattggaagaaaattgcacgaatataatggaatctgggcccaccactcgtcctctccaattctataaagcgacccccgataccaccatcaaatccatctactcctcttctacctctcctcctcctcctcttcttggtcgtcttctcctagctcgccaaga

SEQ ID NO: 49648 - DNA, 1501 bp, Oryza sativa
gttcaagtgcagtcttcagcaatggccggtgagcgtcacactcacaccaccaagctgcgtaggtatggaaatgatatactagtatgtatccaagtatattaagtatctaacactgcctatgtcatgttcctttcaattcataattatgtgacaacatcctggtttagctagctctaagctttcatgtccattttcattgcattgcatgcacttcttcctcctcgtgtaatctctgtaatttgtttatatgtgtaggcatctaggtagatagttcagtacccatcaggtcgaacacgaggacaagcatacctgaataaaactgtagcagattcaacccaacctgtaccaatcggattattgtttcttcaagcttagttcaaaacatgattggttgtacactctcctaatcacttttcagatcatattatcaacttatcctgtactgcccgttcttgcagttgtttcgtgcaagagattcacagattcaccgtattgtgttctggactgaatgggacagtgtcttactgctcataaagctactttcttcagaatgaacaagaaatctgacacacatggcaatgcagaatgcaagacaagagtatggaactatgatcgagtgccggttctactccaatccgggattgacactgacattggcaggaaaacaaaatttggggagaaaaagaaaggattaagaaaatgacattacaggtcagaactccagaacgagcaagcagccaagcatccaatccatccatggccaaattggccatacgttggatcagttcagaattacggcagccagcatgggctgcctgccctttgcctgcacgtgagcaccatccctgatgaaagttcagggcgccgactagaaaaatcctgtagcagttttaacgctgcaagaagatgctgtactattggtagcttaaataaatctgtacaggcagtgcgtgcattaggcaacagccaaccccttttgttgttaatcaaacacatcttggtttagccaacgacaggaagcttactgtagtactactgtcccttgccatgttattaacggcagtacaacaaactagccaggcagcaccccggcttgtgacaacacagtgaaattcctgcaagagaaaaaaaaacagggaaacatcggtcgctgcagactgttcaaggatctgatcggcagcgagagagctcatgtctactgtccatagagttcctgcaaaaggatctggatggttgagaattgcttggagtgcaatagttctgttcacagcgacagtggtactgtaccgtaggggggagtattaataatggatgaaagatgcgaggggaagataattgagcggtgatttattgcgtggaaacaggaagatgaatgaatactgctccctcttcatagcagtatgtattttactaggcgacttttactgtcaactgtttaggtcagctcgcgtttacttcagataaccatacggagtagacagcttcaccaaccaaagtgaac

SEQ ID NO: 49649 - DNA, 1501 bp, Oryza sativa
gaagccatggatatttttatcagaagcaccgattatgggcaatttcttgtaatgaactgagtgagtgtcatctctgatgtcgcttctaagcaaaggactcaatcctgcattcgttttagctagtgctagtgtcttattttatgacacagatcaatgtgcaatcatgtttgatcaaatcttcagttgccatttttggtcggactgcatgaaatgaaactggaccaaaatggtggattgaagattaagctttcatcattccattcttttcaaaaacaaatcatagagagcatgatccgaggtccgaaagactaccagttggttgagctagaaactttgcaaaactgctagttaactaggcccggtattaactatgaagacccaaattctttggtttcttgtgtactaccagcacgcatcttggtcatttgtgcatgccatttcttcttttccaatttgatgcatgtgccagatcaatcagagcatgtctgcatgtgaagagtggagcagtgaactactaccagtagacagtagtacggagcaaagcaaacaacagtagcaaatcatacccggatgcaaattgcagagaccggcaaaaggaggaacaaccacaaagtgctgaagaaagtagtgcagattccgctctgccttttctgttagttgaatggaacctctcctatgatcatgattactcccctgaccacatgaattattgtgaaatcgtctccaaaactttatattacctttctgacagaattcacgcccgggcaacgcatgcctgcagatgctttcagcctttcatcacctgccattgctttgcttgttcacttccctccaacttttaggagtagcttacagtacagtcaccgttgtaactttgaacaagtaacaacccagagattcagtcacagtctcacaggagaggctgtgattcgctctgtttcgcttgagctgaaagcatgcatgcattcgtgcttaatttggctgggcacggatggcttctagtgtaaacgacaacgttgcaactactactccatccactgacgattaaactacataaagcaggtgctaatcaatacttaaacgccgcgaaagaaaaggactccacctaactgcaacctatacgtcgctattgccgatttagcgtcaggaaatgattaacctcatgagctgataattaagtagccacctgttacgcggtaattataattacatgtggcttaatcggccatcattaacaatttttaaagctgatgaaaaaaggaggagcataatgctactgtatactgttatgcaatcgctgtttatgtgcatgtttcaccgaacggccagtacggcagaccaggcacaacaaacattcagacttcgttgccagaaagaaatattcagacttcagagtgtgaagtccattttaaagttatcctttttctttaaagaacattttaactaaagttatatagagagacgaaaaggcaatcgtactgaattattaagaatgcagccc

SEQ ID NO: 49650 - DNA, 1501 bp, Oryza sativa
aagagccgagtccaatacacccgttcctacccgtttgcactcgacacctcgaggaacaacctaagatcatttcaaaatgaggaattattgtaaaaaatttactacagtaatatgccgcaaaggataaaaaactcacaggagaaatggatttcggccggatggacaaccaaacaaggccagcaagaatatcagttacggagagagcaagagtcagtatgtcagcccttgactgcgaactattgagatgaagatcaaattaaccaattggtcagtaatcataaatccaatccaagacgagcgcaaaatgggggcatttcttggggtggctctgcacccacaggatgacctggaggcgtcggcgacagctgcaatgccggaaaccgcacggttgaggaggacggcgagcagggaggcgccgccgccgaggatgggcaggccgcggactagcgtgtcgttgctccggacccactcccccacccaatcctgccgcggctgcagcgccctgatgtgcatttcctgctgctgctgctgaagaagaattgcgaactactgaatcattcaagcagggaacagaattagctgggggaggaagaaacatacgttcgaaggaggcgatggtgagaagagtgcaccgaagggaagccctcgccgcctccgccgccggcgacaggccgcggatgccggccggagcgtcgccgggagcggcacgagcgtaaggcttctggtcatctccatgcgtgcgacactcccaaagagctccgaacgccttctactagcacatgagcgggatcaccggcggcgccgggcgacggcggcagcggagtcgcgacgacgaccggaggccgcgcgcgagatgtagaacggccggtggccactcgccgtcgctgtggatgactcgtcggctacctgatttcttctgggccgaaccaccggcccatgtagtagtcttctcaggcccagcccattccgatcccactaactagaaacttttttcagttttaagtttacttattaaaatatttaacaatatttttttcagtgttttacaaatctacccatcggcgacaagtgactgcctgtaaactggttagacccgattgttttgcagacggcctagccctttgggaggccggtaaaagggctatctgcaaggtgaccgaccgcgggttggaaactctcacctttcgcaccaaaaatgaaatattagatcagtgcacaattggttaagcattaggtaaaaacacttaaaaagtgggttagtgtgaatttttaaaacaattttcctgtagaaatttattttaaaaaatacattgttaagccgtttgtaaaacatggccgatgagtgaggagaacgggacgccatccgccctttcacagggcatgagaggtcagatttgtaaaacttttaaaaaaatagttttaaatattttaataaaatttaaaaaattcttaactgtacggtataaatcaggagctcgccgccgacgccgcctccgttcct

SEQ ID NO: 49651 - DNA, 166 bp, Oryza sativa
aaaacatgtagggagtattgtctatctactgtacttcagtagtgtttaatacaggagaatttctctgacttcatgtcacccattgcgaagattagagatgtctatggttttctataactccagatttactgacatgttgacagggatggaaagtgctgcgtgaagg

SEQ ID NO: 49652 - DNA, 1501 bp, Oryza sativa
tgcttcagcgactcgccgacctgctcttctacgaggccttctatgtaggccttgtacaacatggagatctctctccactcaaacgccggctcgccggggatcgccgggaacgcgaccggaaacccatcgtcgcaccccacgggccgcttcaccaagcggcgaaagagcgagtgcggcacggcggtgccgagcacgccggagggcgtgaagacgaccctcgggacgccgatctcggcggcgagaggttgcatccacccgcagaagaagtcggatacgacggcgacgacggggtgcgcgggctgcgacctggcccacgcgaggatggggcggtggagcgcggcgagcgcgtggatgaacacggcgatgtagacgggagggcagttcatcgtgttctcgaggccggcggggagggaagggtgggaggggaaggggaggacgagcgggcggacggagtcggggtgcgcggcgaggagaggggcgagctgggcggcgttgcccggcgtggtgacgacggtgaggcggagcccccgcgccgcgaggagcgcggcgaggtcgtagagcggcagcgcgtggccctgcgccgggaaggggacaaggaggacgtgaggcgtggcggtcggcggcgccattgctgcggtggtgaggaacggaggcggcgtcggcggcgagctcctgatttataccgtacagttaagaattttttaaattttattaaaatatttaaaactatttttttaaaagttttacaaatctgacctctcatgccctgtgaaagggcggatggcgtcccgttctcctcactcatcggccatgttttacaaacggcttaacaatgtattttttaaaataaatttctacaggaaaattgttttaaaaattcacactaacccactttttaagtgtttttacctaatgcttaaccaattgtgcactgatctaatatttcatttttggtgcgaaaggtgagagtttccaacccgcggtcggtcaccttgcagatagcccttttaccggcctcccaaagggctaggccgtctgcaaaacaatcgggtctaaccagtttacaggcagtcacttgtcgccgatgggtagatttgtaaaacactgaaaaaaatattgttaaatattttaataagtaaacttaaaactgaaaaaagtttctagttagtgggatcggaatgggctgggcctgagaagactactacatgggccggtggttcggcccagaagaaatcaggtagccgacgagtcatccacagcgacggcgagtggccaccggccgttctacatctcgcgcgcggcctccggtcgtcgtcgcgactccgctgccgccgtcgcccggcgccgccggtgatcccgctcatgtgctagtagaaggcgttcggagctctttgggagtgtcgcacgcatggagatgaccagaagccttacgctcgtgccgctcccggcgacgctccggccggcatccgcggcctgtcgccggcggcggaggcggcgaggg

SEQ ID NO: 49653 - DNA, 1501 bp, Oryza sativa
tttttcttactttaacacattacctgcttttaattttttgcgataatacatcacctactttttttcgataatatatatgttcataaatcgctagtagacttgctagtgtttgtaaaccgtcggtaattgttggaaggtaatttttcaagaattttgcagggaaagataaatgcaggaatttctgcaaagtttgtaatgaaaaccactttttgcggttaacacctactctctctgtgaaaaaaaaacctagtactaaatatgatatattctagtacaacgaatatggatagaggtatgtccatattcgtaatgctaagatttgtcacgtctagtactaggttgatttttatggaaggaagtaagttgaaagcattataagtctaggggggtatgtccattgttttttattatttgtcttgaagttaacaatgtccgctaggcgtgcaatttatgatatactatacaattaacctctctaggtgctagcttcaagagtgtgtgtgtgtgaacacaaacacacaatttgtgcaaaaagtcactgtaccgtatgaactcaaaaccatggaacttgtatatcaattactcaaaatttgactcttccgtgtgacggtggcacaggttgatggtgccgtaccgactaggcgaggtagaatagcactgacacgatcgcgatgcaatggttggtttctctcatttctatatcagaaaacacaattcggctgacctgtcaggaagatgtcacattggcaattggcaagtgctagtttcaaattggaggcgcctccaatccattttgtcttgatggtccatgcatgtatgatggtcatacatatgtgttggaaccggttctcatagctttaggctgtgggtgcactaatctttcccctcctttccgaactcacttccctagttttttacgcgcacgctttccaagctattaaatggtgtgttttttaatttaaaaatttctatacaaaagcttctttaaaaaattatattaatttattttttaaaatagattagctaatacttaaattaatcaatcgtgtgctaatgagttactccgtttcacatgggtagggattagtcccaacaccaacgaaagaagacagcctaataagcaaagcattgccttctgaaagtatgagccttggataaagatacaatggcctactccctcggatttttaaattaatagatgacacaacattcatcttaaaaataatattaatattaaaactgtaagtcatactaaaagatttttaataaaaaaccaagtcagaacaaaataaataataatcacgtaactttttagtaataaaacatatgatcaaacgtatggcaaaaaataatagcgtcatctgctaaaaaacgaatggacaaacatatgtgttcatccgtgatgtcgaggctgaaaaaaaacgcataaactttttcgatactaagtagaaattctcactataggggcatatttggtttcttttgcttaatcaccgatcta

SEQ ID NO: 49654 - DNA, 384 bp, Oryza sativa
attatacagggtgatagagaacaatcatcaggaagcaagacaatggagaaaatctattgcagaacatcaagagcatccatacaaaaacattaggaccattgacagcaccaattgacaagaaggaaatgaaaagagcacccatacaaaaatttctgaaataaaatacatctggatcattaagagcatcaggagcatcgtacaaatcagtagcatcctgtatagaacacttcatatcatgcacacaccaaatttcatttccaccatacatacaaaacactgatgaatcccctaatgattttggtaaaaatcattaagttaaggtggatacacatcttgtcatatgatcaaatggtttcgcgaaaaatcaataatcagacaacaaga

SEQ ID NO: 49655 - DNA, 447 bp, Oryza sativa
ttaaacggctggacggttttatagcattgagcacatactaatacatgttcttttaagtaagtgatgtcattaacttttttatgatgtttgatcatcttatttttttaaaaaaaatgattcagtatcatttattttgttgttatttgttttatcattaacggaattcaagaatgactttttttaatggctgtagtaaatttttgaataactgaataagacaaatatttaaatttcaatcaaaagttaacaacgtcatctattaaaaatgagatggagtatcaatgacgtacctacatgtaactacccgatgtccttagacaccaggtagcttgtctatttctagctattttatatcatattaatcatcatataactcaaaaattagactataagtaatttttattttgagttcaccaacggaggatattatgtaggcacacgaattaa

SEQ ID NO: 49656 - DNA, 505 bp, Oryza sativa
gccccgaatcggaagcgcgggaaaggaacaggtgtgaacgctaaggcggggagggtgggcccaccgccaaccctatgcggattagtaaatggcgatagtgtgaacgggggcggcccgccgtggatccccaccctccgtatctcgtcatgacgtcaccccttgcatgcatgcatgccgttgttggtcgatcacggccgccggccgaccctaatccacctgggcatctcatgtctgatgtctcccttcctttctttcttttttttatttttctttcattttttttagaatatatctcatgtctccctcaacagccatttcttacaatgaaggttgttgacatgggtttgtcataaaaggatttatgtaactcacatgtgtggaggagaggaactcgttggatcgaaacacaataactaagttaaccagagggaggtgtgaatggttggtatacccaaaacctaaactttttgcgaaattaaaagttactctcaaattcgacggatca

SEQ ID NO: 49657 - DNA, 224 bp, Oryza sativa
atttgatttgattgtgaaccactatgatgtctgttaatctgtgatgtttttgtgtatttgatttggtttgatgttgaatctagatgggggaaatgggaggagaatgagaagctactgctaccggccgaaacggcggtgggcggtggctgcctattttttttaatgccaggtgctattttcgcaggcggaccagttgtccgtctacgaaaatcaactattttaac

SEQ ID NO: 49658 - DNA, 1501 bp, Oryza sativa
gaaaaaaaagcaaccaccgtgtaactgtggccgagagaaacatctttgggcatgttatttcccaatccctttatttttgcagttatgcttaattaaccggtgatggataatcgatcagttacatatgaaccaaacacgtaccttcgcatgggcacacatgctataaccggggaagaatacgtcacacacaagcattagcatgcatcaacgtagttatcggcacgagtaagaaatataatgcgcgtgcacgagtcgttaaattatttctttgtgccgccatttggttggagctgagcatgctacctcatcgtgttgaccaatagcaaagccggagataaggctaataagctggaggtaacactcacttcgtcagacaaagtaatcgcgttttgcgacacgggatcgagcacggacaagccgatcgctctgcgaatttgcgatgaggctggcacttacttggctgtgacacgtcagggatatgcttcagattgtccgcacccatccagaccagattgccacgcatgctcgtagtacagcatacagtacttgtttttttgctactctgtcagatggaaggtttgatttgtgtactggctgtgtaattgagcgtgtatctgactttgaactgtgacaatgtcagcgttgacacgagcagctaagctacgaagaacctggccatgacaggatggatatcaatcgcattaagaaatgcaagtgcacgcgtggattaggcgattggcacgggcgagattgcgagaatgctgggctccagcctccagatacgcctcagcttttgggttgtgcgatctgatcaggtccatggcgtcatcgatgatcttactattactaggttaggttttggaggccagctcagttcaacgcgtatgcctgcagcctgcctgcttccgacctccctagaatgctgactcgtcgattcatttcagccggttcgaagcaatcgacacgcgaaagaaatggatcggccggaacgtgaactcaatttgcattggatcactgcattaaactaaccaattcgatcccattttgctaactcagtggatataatactaaaatcaacaaatataaagattgtcactcggggccatttggccttttttcatatactaataataacttaattaatttgcagacctaactatatggacctgttttacataaaaagataggcttttaaagaagaaaatctcatttactacatggaccttatgtgggctgaacccactgatcgatttcacaaatttagccaaagcggcccagttaacgtgctgggccgtattttctacttacccaccgatcttcgcttgcggcagcaaagagaagggttttgttttatttttttccggcggttttctccgtgccgccacttcccgaccgccgccgccgccgcccacgagaacgagcggccgccgcaacccgcggtccccttgcttcctactcccttcccctgctcttccttgcttgtttccacgtggtcgtctaa

SEQ ID NO: 49659 - DNA, 1501 bp, Oryza sativa
gctatagctttagctaatgcggcgctaaacaaaaaattagtcggaccgaagattccaacacgactctttgcttgtttattgtatatggccacttgaggcagacaacaacaatcgcgtccatgtgcaatgtaactgtgccactccgcagtgagcccgaaacctctccttttcggcgtgcagatgtaatgcgaaatcgcgaatcgatcagccattcagccaagccggccgtcagattcccgtcttccaacggctccgcggccaccagcttgcgctgcgcggctgcggcgatcgcgatcgcccggcgcttctgtgttttgaccccgtgctgcgattcgcgaagcgatgcgtttgttgttgtgttatgtcgtcgcgcccccgcgcgcgcatcggcatcgggccgtggccgccgtcggtccagccagccaccaaccgcccactaagaatatctcgtctactttcttcgtcacataaaaaacgaatataaaacagatataacatattatatatatttagatttataatattaagatacgtcatattcgatacttgattgtttttttaaaggaatggaggcagtactcggctagggtgcgtgtgcgcgcgcgtggcccaccgttttttttttcctcttgagcacactgacgtggtggaccagaagtggtgctatttctcagagggaccggaccacctgcgtccgggcctcctgccattacgtgatgatgtgtaaaggacgaggctttttgagcacacaggggaggaaaaaacctcggcaaagtaggcggcgctgggtgcagatcttttccgttttgttggtaggagaagaatttgccttgcacggtttgcgcctcgctcgttcagcatagtagcataccacctaccgcagcaatggacgtaccaacaagcgtacgagtgttgctcaccagagctactactaccggtctgtcacgctcaccctagtataaggatcaatgagacttttcatcctcccaggagacttttccccttgccaatgtagcagcagctcagcaaatttgatcgtgtttgtgtgtatgtccaatctatcactgctaagccaaaatattacaatactacactactatgcagtaccctttttttgttacgaaatataataatttataattagatgaaacgtactttggtaccatgaaactagatagatcatctgttttgttatagtactacgatgatttgcaataccaactaggcagttttaaatttgccattttgctagtacttgaccagccaagcgagtgaccccaaatcggcctcctcaatcaaggttaggtaggtgccaatcaatttgatctctcacctcactctcgtgggctcaccacctcacctcgctataagtaaaagcgccgcacgcaacccaccaaagcccacccacatcgccgcctcctcctccttcctcggtttcccccaaaaaccccaaacccctcctcctcgccatggcggcgccgtcccagaccaccgccaccac

SEQ ID NO: 49660 - DNA, 1501 bp, Oryza sativa
gaacgtcgagatccgtcatgcaagctggatattgtccatatatatattcttaatgcttagagatattatagcaatataagatgggacccatagtcctatattcttttatgtatagcacaatatataatgtatatggttttcttttgatcttaagttagggctcactaagaaaagggaactctatttagcaggattaaaagagcaatatgttgcaaaggcttaaatttttttttatggtctagctttaagtttaaggttcgtcatagcaatattctctcatttgcttctctcccaatgtataaaggtagaaaaaatattactttattgcttgaggtactttttatgcaactagaaaggtagcccgcgcattcgcgcgggcatgtttttatttcgtttcgaaaacagatctatcaaaataagtttaaattaaagtgaggtattttgcttcttaactgaatgttcattgtattttttctttaaaagtcttgagaaactttcattgctcataaatatataatttttaccatcctactatctcctttttagttgatcaaatatacatatcttagatagtgcttcttatacataggaccctacaatatttttaagaaaaatacctagtccatatgagtcttaaaataaaaattagtaggaaatttataatcatatcgttatacgaaatgctattgattttgtattgacaccttagaggcatttacatgcaagtcgtggaatttagtgtattcatttaattattattgacctttgtctcttgatgtgtcaaagggaaatatgacttgtatgactaaaatagttcactgtgtaaaagcttcaacactatcttgtgggttaagtgctccactaaaatagttctgtgtaaaaacattacaaaagttatttctacaggtagcccatgagtccgaggcaaaaggcttatcacataggaggctgcacatttgaggaacatgtaaaaagtcttctcgtggaaatcatttgtttaggagtgtgctgaacataattgtatattcaattaaaaaagttggaaaagtggcttaaagttgtcatttcacattgattggttatgaaaataatggtatatacaaatctttgtgcccatatcattgtttcgcaacaatcaatagaacttgatagttacttttggtattccttttggtatgtagcaaattggctaaatattttacaacttattgtatcgtttacaaagatgcacctgctttatttctctgtatactggattgtctcattgtttattaatggatgccttgggcgcatgcgacactatatatatttggaaaaagtacgaagcttgcgcccgccccctgcaccgccctgcctcgccaccgctgccgcctcgcctcactactgcctctgccgtcgcctatgttggagagaagagagagagtgtgtgtgtgtgtgatagattgggaaagagatagaatagagactgacaggtggggtctatctatttttttataaaaga

SEQ ID NO: 49661 - DNA, 183 bp, Oryza sativa
atgttgaatttgcatgcgcaggtgatgtggcatgcacacgtggcatttttagtgggtccaaggactatatcaaatcacacaataaagtttagggacttatttggacaatacgaaacatgaaggactaaattgatccttaagtgaaagttcaaggtcatatttggttattcacccttctgttta

SEQ ID NO: 49662 - DNA, 1501 bp, Oryza sativa
atttgacgaggagattcgttgctgtttgattcaggattggtgcacacgtcgccgcttcttgccttcttgcagtggggagggaggactcacttcgttctcgctgtggttcggcaaatccccgaggtggggaggactgcaaatttctgcttcgtttggaacggatgaattttgcgggattcttggaggaattgaacaaattcatgtgaaaatcccgtagaatttgtgttttttattttgtcatgtgtaaatggaagagccaaccgcaaaaacgaatttgcacttcgacctagtgaagaaggaaatttcttccttattataaaatttccaatgatacattttctgttattacctttttacagtagtgcctctcaaggtttcaacttaggtttactaatttagtctcctgtgccaaatgcaggttcagagtagcccttccgtgttcataacgttcatggcttggagcatatctgaggtgtggcacaaaatgatactacatcattttctcctctttttgtggtttgccttgttctcataaaaacaatactgatgctttttgagtacattaaaaaatgattttctatgatgcaatctcatgatataacgagaaatttctggtggaaccttctcaggatgcacatattttgtttctattttactgcacaatgatctatgccaatggagctaatattatttcacctgtttcattcatattaaaatgtcaattacgtgttgaaagggatgatctgacaactacgtttagctgttaagaggataagttgagctggtactactgcctaaggaaatgctagcatgaatagaactgtctgtgcatgtaccaactgaaatccacgacagacaaatatgtttccaagttctatgacacgaaaatacccttttactaacctccgtgcatgtgaacgaaaagcattatttaggcatctacattttggtttaactcaatggtactcagtacttaccttattttgaaataattcgcaagacaatgctatttttgttcagtcttttatctgaagtctaatttcttcatggtgcaggtcatcagatactcacattatgctctgacaaccttaaaagtttgtccaccatggctaacatatctcaggtttgatttgcaaatgaactccagttcccacatccaaggatgcatccacagtattttcttagtagcttctcttaggctcggtgcccagtacacctcttgttttccactattttctggttgttttctattgtttttggtagaaagttacacaattctccattcttcaaaaatatttttggtcacaggtcatttttattttccgtttaaagacaccttgcactgaaaccagcataggaagcagaaagatggacacagtatcatggttgttttaccttctgtcttctaaaagaagttgtaaaattgcaaacttgttgttcaaattacaataaccgtattgagtaagctacagaaagatcactgagctggaactattaactg

SEQ ID NO: 49663 - DNA, 278 bp, Oryza sativa
caagaggcagatcatacggctaatggtagggcccaccataatagtatgattaatccggttcatacttcattaacccctttatatggtttaagttgtgcaaaactattaaagttaagcaagataagagaatcttaactgacatggctaaattttttttaataaaaagaatcttaatttcaagatttgatttgattttaagtatggtgaaataaagaacaattgatttacggcatgattttttaaagatatatgatcatggcatccggaatatcgtgtta

SEQ ID NO: 49664 - DNA, 1501 bp, Oryza sativa
tttaatgcaggcttcaagggaaggctgttgtttttgcaattgattttatttgaactcttttctgaaaacaactaagtgagtgcttctcaaacgacacggatgagacagtgcgtctcgtccggtcggagtatgtgcaatgtgtcaatctttaggattgcaacaaagttggcacccggccaacagctttttaaacggccacccgggccaacaacttttcaaacggccacccgggccaacaacttttcaaacggccactcgggcctagctgatcccatcagctgcagatttttcaaacatcgaaccccttttcacaacagcaatttcacaagcagtagacaaacaaaactacgctaggaatcacctcagatccgcccatgtccgtgggcacggctgttcgaacagtttgttaacctctgcagagggggtacactttacccacacgacattactaacccgggtcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaagctcccccgattagcaatttactcagccaggggcgtcccattccacccatgtggtcgtacttgtcttatgttcggatgaaattccaaggaaacggtccttaagtgcaagagcgggaaaccgtacacccggtaggatccccggtccgcggttttggaaattcatttggttcggaggcaccgacccaggtgtcgggttttccaagtcttttgtaaaactccagttttacccaagttgttactcagattttaaggttgaaggcgaccgtcgatacttgcacagagtgcacgagtatcgaggcgcaactgggtggttacaaggggacatggtatagcaattaacaaaggaaggatcaaatgcgacaaattaggtaggtccgccaatctgccttgtagacgggacaaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctctgaaactatacgcgaaatggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaaataaatcctttctggaaaagaaaaagaaaagaagggagggagggaatatagacttttctcggatggctagggcgcggcccaagagaaa

SEQ ID NO: 49665 - DNA, 463 bp, Oryza sativa
ccggcttgtggaggggggaaactgcaaaaagtggttccgcgagacggagagggaagacggagcacgtaacggtaacggccaccgcgacgacaagaaaggaatgggttcccacacgcgggaggggggtgtgggcccgagtgtgtctgggccgtcggatcgattccccccgggtggatttcgtacctaacttttggaatcgcgggaaaatgttattagcaagtttgttcttcttcccttttcttttttgttatgtgttcccgccaattaggtgtggggtcccataaagtgactggtgggtcccacgcggttgacgttgagggatttttcacatgaaagggattttatatatatatatatatatatatatatatatatatatatatatatatatatatatatctgcggttggtaattggaattggaaactattctaaggtaattggtgatttttattcgttttaga

SEQ ID NO: 49666 - DNA, 384 bp, Oryza sativa
ctttttataaaatcattttaactttttttatttcttaataattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttagaggatgtattttagagtcattttgggacgtgacagtggatcccgctgacgaggagttcttccaggagcaagtcggctacgatgagttttaaggtttcggcctagtttccaagtcgcgcctgtgataaatggtccaagtcttggcttccgctttccctttttaatgcatttgtgagctcggga

SEQ ID NO: 49667 - DNA, 196 bp, Oryza sativa
cctcctccctctagtcttgatcgggacgggcccgacccccaagcgcggaggggataaccgccactccaccccgggcgccatcccctcggggaagtgccatgtgggtctaggggcagcctccttcctccaaactcggtaccctaagctgggagggggcggcagccactccacccgagcgccacccttctcaagagac

SEQ ID NO: 49668 - DNA, 1501 bp, Oryza sativa
ttcattccctcgccaccaccgtgcccttgccgccttgctaccgccgtcctcgcttccctcctccatcgcgcgtgctggtgaagccggcgtgcgcgcgaggagctgacgcgggactccaggcgccgtctccttccccttccccggcccgaggccggagagctcgctcccgcgtcgtcggccgctcgtcacagcgtccgtctcgactctgtagtgcatctcccgttctccctccttgctccctctcctctccttagctctgggcagtagtgcgagtagccttccagtagcaagctggcgccgccccgaccgccgccgctgctcgccgtaggctcgccgccgtcgctgcccaaactcggtagtagccgctcgtcgccggccttcctcggtgtagctccacccaatccgactctagaaatgaactcaggaggtcgcgtagatgctcaagtccctaggaatcgagctctcatcgcgtcgtcgtcgtttccctcttttgccgccgccggcaagcgccgccgcgattcgtcgtcgccggcctccctccggcgaatccgatccggtggctcactccctctcgtccgtcccatcgttcaggtgtactccctctctctcgaatcgtcgcgacgagctccggtgaactcggctgccgtctgccgtccatctcggccgccccttctttctcctcccgccggcccgcgtggctgccacgtaggcgccatctcggcgccacctcggccttgaccgggccaagccagtcagccgccccctccctccgtcttccctcccgtgcgcgcggtccacggcaagccgtgcggctgcacgtgggcccgccgccatccgtccacccggcgcgccgcgcccgaaccgcgcgcacccgaaaccttagcgcccgcccccgtgtgcgccctccccaccgtgaacccaaccaccgccatgtgggtcccgcgcggtggaccgcgtccacccgcgtcggcctctctctccccgcgcccctaatgggctgaccacccgcgcccgcgctggcccaatggcctgaccgcgctgcgcatgaccccttgggccgagcctaagccgcctgagtaagtctaaatgacatccctccttccttttcttttccaagggatttgataaatccttttcctttagatagaaaatccaaataatcttaggaaatccatatctccccaaccgctcgtccgattgactccgttccacttgcaataattccgtaaattgagatctatttaatggcactactaattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgctgggcttcggtttgcg

SEQ ID NO: 49669 - DNA, 1501 bp, Oryza sativa; identical to SEQ ID NO: 27880

SEQ ID NO: 49670 - DNA, 1501 bp, Oryza sativa; identical to SEQ ID NO: 27892

SEQ ID NO: 49671 - DNA, 1074 bp, Oryza sativa
atgggttatggatgaaattgagttaaaagacaagttattcgaggacataaacgaaggaattaaatattaaaaagttgttcaaaaaatatttaagaaacgccaatgaagaaagtttttgtaacaactataccattcagaagttttgaaagcctagcatccataatacgtaagtggaaaagaacgtggagtcgagtcatggaatatcgtggaattgtatatgttatgctatataaatattgtcaaatattttgaaaaaaaaatcataaacatttgcatggtatttccctgacagtgagccatagatttgttgctacttgctagttcgagtagtttcttatggtgttgcccttgtttttctatcagatattagtgattcagacattcagtcttaccaaactaaggtgtagttagatgtgagataaaacaaagagagattggtagttcgaggggacaagtccaaaagcagaaaacaaggaccagttcccttccatattttactcatgttttgggtcatgaaagctgcaatgcaacagacaggatcatctatcctacatcaccattgcctgataatctgataaaaaccaattctgcaagacagcaatagggttttttttccccagaatttctcctcatggctaagcatcacatgatgtgaaactacaacagaataattcgataatttattaacacgtcaagctaatgattcccccataaagaacactgcttgtcagcatctaaccgtcctaaatcagatcaaaaggatcccactgaaggagaaaaataattccattcctctctgctttaagcggaaatctcgtaaagaaaatgcagaaacgaatagtccttagcgtccgcgtgccattgccaatcaaaggtaggaaagaaaaactaaagccaaagggaagcaattttagacaccaaattggtgttgctgagcactgcaggtatggctgataagcatgaactgaaacaagcattagtttatagtagcttaataccttcccggcatctccggtgcccacaaattgccaaagtttttctctctccttttttctgcattctttatttgcaaca

SEQ ID NO: 49672 - DNA, 331 bp, Oryza sativa
tggttagagtcataaatggttgaagtcttgatgtaaccaaaccaacaagagtttgactaccaaattgtgataatattactcgtattcaccaagtcatcataattgaatgtgtaaactgtaacctagttaaccatttttttttaatttttttacagctgtcaaatgcagaaaaaccttgtattcgttctagtcataaaaacataacacgcatgctgtcataagaagactgaaaagaaatggtgtgtcagcactcagcagtaggaatttgaaagatatatccacaaaaggtagctattaacataaatcagtcataagactgtaaaagaattag

SEQ ID NO: 49673 - DNA, 547 bp, Oryza sativa
tgctcaaatcccccgtcatttcttcctatatctgctaacttatgtaaattaaaggataaaacttttaaattctgtttcgtacatgtcatctaaatctaaatagttattataagatattcacttaaaatttgataatatacactataacgttacatcgttaattagagtgatttatatgttgtagtaggatttctctctctctctctctctcttcatatgcacacaggttgatccaatttatagataatagattatgtcccatattttaccagaaatatcatgttttttttacagccccatcggttggcctaataagccaaaaccaaagccaaaatttaaattttcaaacttgattttaatgtattttcaacgtagtattttttttagcaaaacacatgtaaaagtcttacctataaattaatttttattccccaataagccaaaatggtctattagataatatgagcaaccgatgaggctcttagaaatgacattgaaaaacgagagcatgtgactttaaggtgcttgcctttttcctctttttagt

SEQ ID NO: 49674 - DNA, 1501 bp, Oryza sativa
gacgagtacctgctaagcctatctcacacgaattctcccttgattttgatcgagcccatgcatgctccacagactgtttttttgttggccatttgcaatgcagtcatccaggatgatgatcaacagagtaacagactaccttcctcctcgtcaagtcactgtcttgcgagtcttttgttatttgctcaattgctcgtgcagtcgcttggcatgtaagaataaggttaggaaaacctatgctagctcagctagctgaagaaaagttgtggcctgactagcagtggatgcactgcaccagaggcggtcactcccttctctgaacttttcccaaaaattcctctctcaaagcaagaattcaactactgttgatttaacatgtttctgatgggttggagcgagagaaaaagtttcagataaaaccacactgttaattgatcaataatcactgttccttctcaagtagtcaatctaataatcctgtatatattttctgtttgttaagcacttttatggagctttaattgtgagctactgttgtggtgccgtcgttcggttccatcaatcaaatctagctaaccatgccggcatgcccaataatgctgttccaaatttagattttgcgtggtttccactacaatacataataagaaagtagtagaatttaatcttagaaatttaagtaagaggcttcagtctattcttcttcttttcttccttatcacaaaaagaatgtagtacctaattattgctgtgtttagttataggataattgcagcagagaaagattgtgcgtgatgattaaggcatgaaaatcttaaacaactattcaatgtgatgaagcagcatacaagtatacaactagtcatgcaccctgcaggttgactttagccacactccaaagctagctacagagaatgctttgcatggccaacctctcgagtctcgatcggctggtgcagctagctgcactgcatgcgacgttcaggcaacccagctcgtatcatgccatatccatccaaagataatcgatcgagtattaattcgagcaggccatcaccaaatgaaaggaactaaacaaagctagactaagtacagtattgaagccaacaagaatatgtagctatcttaccagaaaaaggttaatgaacttccttttgtgtagataactttgcatgcttctggccaacacactgccattgcaagcatagctcctcgatctcatgtatatatacacacctcgagttatggccataccatcacaagctgagctagctaagagcgagcttcattaacatacgagacagagaggtcagtgaaggtagcaatggcggcagcctcctctgttcttcgttgctgcctcctcgtcgcagcactgatgacgctgtccgcaatgggagctgaagccatcacaaggcagtacctattcgatgtaagtgcatgcatatccacggtgtggtgtatcacatcgatacacaagtttcgccaaaaaaaaccaacgcga

SEQ ID NO: 49675 - DNA, 1501 bp, Oryza sativa
actacttttcattttattatgtttattccgaattttagttagttttaaattcctatatagactctatactctacttctaatattcattattttttaattccgaatttctatttttttttcttaattgtatttctatactctacttataatattccttatttttcattccgaatttctattatttcctaattgtatttctataagtactctatactctacttctaatattcctaatttttttaattccaaattttagttatttcctaattgtatttctatatggactctagtctcctcttctaatattccttattttttaattccgaatttcaactatttctaagttgtatttctatatggactctagtcttctcttctaatattccttatttttttaattccgaattttaactatttcttctaattgtatttctatatggactctagtctcctcttctaatattccttattttttaattccgaaatttaactatttctaaattgtatttctatattgactctagtctcctcttctaatattccttattttttaattccgaatttcagctatttctaaattgtatttctatatggactctgacttttctttttctccgattaatgtgagaatttttagaccatgagagcgaacgtggaggctcctttttctattcctttaataatataatagatttgggactctctacaactttgtgtgcttaatatttgaacaaataattcaatagacaaaggcaaacaaagcaaagctagtacaatctcattgttatgtataggtgaattttcaatgttttgtcattagcttaattaatcgcttggctaaactggttggtgcacgtaatacagttcacttttggtcttcgcttccgctgctcttcgattgctatggaacacttgagatcttaacttttttgttgatcgattgatttttattttgtcagttatttccttttctcaaaggaagctctcgcattttttttccccaaacagactgaaacaaaggttatttagttacacgggaaatcatggcctcatgggtagcggagaattacgggagtttttatgttaccatgggagaaaattgcaaacttctcaagcagaccctaagtgaatttgttgtaggatcgagctctcgtcataggtccaatttaaatcaaaattgctttattatatgtgcatccacctttttattcaaaatagcagatcgctatctgccctcaaagtagctctgccagatttctgaaacgccattgaattcaattaatgattttcataataagggtagtagtagaaacttctggattaattacttacgggatttcgtcatataatagaccccgataacttatccagcttcataaccacgtcaaacgtcagattggaaggactctatctcgagacttctcgtcattgacatcatgaaatcacaatagccaacaacgaaaatgtccgaaagtctgttgaaaagctgacgccaggacaa

SEQ ID NO: 49676 - DNA, 390 bp, Oryza sativa
tgcttttgtagatgacattatatgtttaatcaactaattatactataaatttatttttttacttttgtttttatcttttataagatccgctgcaacgtatgggtctttagctagtactatatcacaaactgagagtggactaatgccagaaggacatcaaaacatgatttaccgaattcaacgataaagggctcagcttgggccacttcgttggcccatcttgttctctgaaatgtttcaggacaatcatgcacgaaccacgttcttgtttggaccggaaatcctaatcggcgattgatcgcctgggacgggggtagcgatcaatccccctccccctccctccacctggttttcttttttggcaccgcattacttttctattttactaaa

SEQ ID NO: 49677 - DNA, 1501 bp, Oryza sativa
ttaaaacttaatggcacttaaacaaaactaacctaagttgctaggcaaggtgaggagcaaggttaactaagcaactaagttaagttttgcaaacctaagtgatatgggctcaaatatgtctctatgaatgtaaatagtacaaatgtaaatgcaacaaataaatgagacaagagacaaggaatttttcaccgaggttcaaaaactcgccggtttcctaatccctgttaaggcgagcccaacttcacagctcaaccacgaagccaccgcacgcccccttcgtcaaggggtgggcaaggcgggagctggcccacggagaggactacccaagcctcgatcactcggggtagttcttccttcactccaaaggtggtgaactccaaaccactcacaaacggtgccgggcctcctccacaatctcctcggagaggtcaccgggcaacacctccacaagccgtctaggaggcgacaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaacttacccttgctggtggggagtgggtatatatacccccaaccaccaaaactagccgttggaaccgaaatccccaactttgtgctctgccggtcagaccgccgttgtgaggccagtcagaccggactactttgtaacggctagaaaactagccgttatagggcaatcattgagcccactcaacctggccggtctgaccgcagtgtagtagccggtcagaccgtccacgactcggaacagaccgccgtcggctcggtctgaccggttgcggctctggcggctctgtatcgccaccaaaaaccagaccagtgcaacagaccagtggggccggtcagaccagccttaccacgctaacagacccggtcagaccggcctaaggcccacggtcaaaccgcaggtcacttttaagctcaaccgaccgttagtaaaacggtgatatctcttgactcgggtctcggaatttggcgttcttggactctatggaaagcttattcaaagggccatccaacccatgaaaaatccatccaagaaacacaacttaagtcaaggataaagggctcacactccaaaggatatccaccggacatacctacaagatgtcactcactcctattggacatgcccacttctctcttggtttaggacttgagaaaactcatcacacttggttagacaagcccacaaaatgcacctacatgcatatgaactaatatgacactagatcatccacaagctcgcttcatagacccctcttgatagtacagcgcctatctagcaaatccggtctacaccaaacaccaagaccgggaaaagactaagaaaacattcttagctacattatacctttgcc

SEQ ID NO: 49678 - DNA, 1501 bp, Oryza sativa
ttttgtaaaaccccaagttttacccatcgttggattttttaaaatttgaggggaggtgttccgatgcgcgtgcctgagggcccgtgcatcgaagcacaacaggtgacaaaggaggtttaagtattcaataattcaaggagggtaattgcagcaattaggattggggccggcaggctatctcgcaagccgcggccgaaatactcgtgataatcctatttatgcaatatttttgtgcaaaagaaatacttagatttaaattataggtgcaagatgatcaaaggtgacttgccttgctcgagatcttgagcttgatcctcgaaatcctcgcactgcgggtctttcgggctccgaaactacacgcgaaacggaacaactcaacaaacggcgaaaacaaagccctattattgacctctaagcgtgccaatagatagatctcgagatttggggaattttggaagtcgaacggagtcaaacggacacacggttgagaagatattgaatttctaagattattggatttttgtctaaaggaaaaaggatttaattaaacccttttggaaaaagaaaaaggaagagggaggaggaatagacttccctcgggcagctaaggcgcggcccgagagaaaggggcggctcggccgagcttaatgggccggccggcccgagaaggcagcccaagggcacgcgggaggggaggagagagggagccggtggaccgggctcacctcgcgtggccccgagtgggacccgcttgtcggtgacacggttcaccgtgcggagggagcacgtggtggcgtgctagggttcgggggagggacgcggtgcacgcgcgcggctcacggtgggtgcggatgtggcgggcccacgcgtagcctcacggctcgcggtggaccgcgcgcgcgagcgaggcggaggggagcggcggaccggggtcagcttgacccggtcctggccgaggtggcgcctacgtggctgccacgcgggccggcgggaggttgaagaaggcgtcggccggaacggacggcggacggcggctgcgaacggcggggcgaaccacggcgatacaggcgaaagcgagcacactgggaggtagcgcgggactagaggagacgagctaacggctcagattcgccggagggagtgcgacggcggcggattgcggcggcggcaactagcggcgagagaaggggaaaagggtgacggcacgacgggagtttgattccttcgcactagagcatctacgcgactccgggaatccattccttgcgccggaataggaggaaacgcaccgagggaggccggcgacgatgtaggatcaaggaggccgactagaggggggtgaataggcggttttaaaacttaatggcacttaaacaaaactaacctaagttgctaggcaaggtgaggagcaaggttaactaagcaactaagttaagttttgcaaacctaagtgatatgggctcaaatatgtctctatgaatgtaaatagtacaaatgtaaa

SEQ ID NO: 49679 - DNA, 1501 bp, Oryza sativa
aataacctcagatgaactgtaattatgcagaaattaaacttgttgtttctgatgataagttgaacagagcttatcgatcgattgattcaacattttctgtccctagcatgtatggaactatggatcgacttgggtgattaatatagttgtatgcatgcagaggttggaccggaaaggtgggctggtggggttactgaagagttttccctgtctgaatatatggacaaactgtttcggagcttaccctgttgtgtgccattaatcattggaacacacatgataatctcataatcttgcccctagtaataatccaataaggtgatatatcaccttctgaaagcattatgcatgggaccttaactgtgagtgccaaaactctctaacctttttaaggctggttttactcatttttcttttccatagacgagtgctagataatactatcctgcttcatcaactctgcagaagaatgcgagttcctttgtgaacttctcaagtaaactatggaccccaacgtcaattcatgatcttttaaaactttttttttgccattttttctttcccaggataccaaaattgaaatgatactgttagggaagaaaaataaataaattgaagcacgaggtgtgtatggttctcggtgtgttgcttagagctgtggggttgttgcagtggagcttgttgctttgggcagattggatgtgtatgctaccttgtgatctgatatgatctgtcggttgggacccagttaaagtgtctcattatgtctgtcttagtaacaaagggaggctatggaggttagggaaccaacaactagtacatatctgaataacacacttaaatctcatgctttaaggcgagagaaccactttaaatgcatatatttgtattccatactgttttttttttgaaaagaagtattccatactgtagtttagaagagatactaccggtgacacagtaatccatctctttcttcaatggtatggctattgatttaaaaaagaaactaatgccctttcatttgtagaaaaaatataggaaaattgaaggattttaatcttgtagaaaaaaaatcctatgaatacatttgaaactatcctattctttcctttgaaattcctatgaaattgacaatcctatagaatttgatggaaagttaacaagagctcaaacctcttagaaaattccctacgagtctatctctcttatcccattgcaatgtttctatttctatttttttttgtgttttgcaattatctgttttacacttgtattcttgttaaaaatatgtgtttttcctattcctctcttttttcaacgcattgttttaaagaagccctaaaagatttgctattgttatttttttatgcagaagatctgctcttgcaataaatttagtttgatgttaggtttcataacccacaagaaaaatgcaaagagaagataaaggaaacaatgttgtatgatcgatttagccatttaggtgtcattgcactta

SEQ ID NO: 49680 - DNA, 755 bp, Oryza sativa
acggaaccggagcaaattaagctgctgcgttacactattgaccggctatattagtctatcacgaccgtccacatcgccactcaacaacaccatcgctgccgcgcgcggcacaaaggtggccgtcgccgactcgccggtgtgtgcggtgttggtgagcgttcggtgagaacgttctcggcttccctcccccctcacgcacgcgcaatccacagctagctagcgcgggcggcgcgcgcgtccaccacgaaacccccccgcacgtagccatcggtgtattactactacaaccggttcacatcacacctcgcccggttatttccaacgcgaggcataaatacgggagagggaaggggaaacccgacgcgacacgtctcctcgattccgctggttttttaagtttggtgaaactcgatcgcttaggttaaacctcggtagctgttgggtgcgaggttggccatcgatcatctctcgctggatcacgccactttttcgcatgcaaagcgtaggatttctctctttgtttttaggatttcttggtggttgcgagccgcttacctgaacccagaaccccccagttgccggtcaagccaaaccctgcccactgcgatcgcctcccatataacacatactctcttcctctttctcttcgcttcatcaagtagtagtcgtgttcattaatctgcatctctcgcttcacgtactttgaagtggtggtgaactgtgttttgtgtcatcgatggtgaccatgtcggcgt

SEQ ID NO: 49681 - DNA, 618 bp, Oryza sativa
agtttggaattattataatctaaattattgagtcatattactataagctagattgttataatttgtagtagaataaacggttagctgtttctttcctagattattagagcctagattattgagtttgcaagtctaaatagagagtgggggtggcatggtgggtaatttttcacccaataatctagaaaaaactcacctaaatgagcttatcaaattataataagttgggctccaaattataataagctacttcaataagttatctgtttctttcagcttactcccaataatctggattataataatcccaagctgaaagaaatagagcctaagaagttatgactttgtggatatcgaaagttaactcacctttgtctatcttttggcttgccctgtaaatatttccctatctgattttgttttgttttttctctatctctattaatatacgaggcaaagcttttgccctcctttaaaaaaaactcacctttgtctaagtataagcacttttggatacattatcaaagagacttaattagggtctattttgtttgtaactaaatttgtcacatctgacattagtcgttaggggtaaaaacggtatgaaaacttttcaga

SEQ ID NO: 49682 - DNA, 1501 bp, Oryza sativa
tgtggatatcttagttaatctaatctaacaagtaatttagccgataccagcataaaccctaaaacgaattctatccgatgttatcaaattaatatgctaagctagattaactaagatatatgataaccagaggctgtagaagatagattagaacatctaaaacgatgccctaatccaccaatgcaaaccgctaaaacaagtcatacctcttgtcagaagatcgaagctgatgcctaactcgaagcaagaactcgtcgaaaaagtagaaatgtaaaaggtggcgatatgccgaagttgtatttatcgaggatattttacaataaccccgggtgtatatatttatacccatgggtaaatactagtctttattggacatgatataaactttcctaaagataaaaagaaaaacataggccttatcgaatgctaaacacacttccctaaagatgaaacgaaactaatagactcttcctaattaatatataaactgtcgtgccgcatccttgataaacttactttaattgattaatttccttaaccaaatttaccaagaatccaactattgaagacttgataatttccattggatgattccaagacgctaaagccgatagtgactgtaagctgatgataactctggggcttgctaaattttgacgttaacagtactgtatgcgatatatcactattctgaagctagactgcaactacgtgcaacttgtgttgtctgagtttgacttcctaaaaatgctctgtagaaaaatcaggcttagttaattttcttggaagtcattatcgagaattaagagattggttgtactgtaaatcatcaccaccaaggatggtcatggtaagttcattattggagacggcacaatgcatggaattaaagacggagtccccgcgatgggtgcacttgctggagtcaagaaactatttactgttcgattttcttgtcatctgttcatttcagccgttttatgaacagcaccatctgaaggaatcgacttcagacaacacttgctgcgtttaaaaatacctgtttattttaaggataagataattaatccccacttgatactacacgggctgtttggaagcaattgatacttcaaggaacggaatatatttgtttatcatcagtttatctttcaagaacaaatttgtatggacttctataaatggtgtgttcggaccagcaagcaaaaaattatgtaggagagttgcagcgctgcggttgtacacccacaacccagttgaactgaacggcctcaatatatctgtgtgtatctttatttaaactagacttgtgatattaacatatattaacatatgacacatgtatatttctaacgcacacttttccatactgaaattttctataaaggtttttagataaaagtcctcaccataaaagtgttgggacataattaaggaagatatcgtcatggcagtaaatcaggttgctaatcacgacactcatagtctatggctattaaac

SEQ ID NO: 49683 - DNA, 179 bp, Oryza sativa
tgcatgcatattgatttccaaccaaactcaacaacaaaatcacccacattcacaaaaacatcatagaatcatccacaatttcaacaacaaaatcatccacaaatttacatcacaaaatcatccacaaatacctagattaattagatcatcaattatcagcttcattctccatctctaga

SEQ ID NO: 49684 - DNA, 410 bp, Oryza sativa
cctgcagccctgaaaagagtttgaagtttaaaaagataggcaaaactgaaaaagagtttgaaatttaaaattattttaagtgtacttttcaattacagcatgggactatctagagaactgtcgaaagttttttaagaagaaaactttcaaatctaactatagtataattacaatataatttcgtatataagtataatgtaactcatatataaatattaaaataatatatgtaacaatatatctaaattatatagagatgataatgttgttatattttagttacatagtagttacaatgtagttacaatgcagttacactgtagttacattatatctagggtgtaactggagtataactagaatataactcatctaacttctcaaaaacatgcgcatgcatgccttccagg

SEQ ID NO: 49685 - DNA, 261 bp, Oryza sativa
aggaatctcttattcagcaataccttgatttcttaaatgttgcaaacaagtatgtgctacatgttctctatttcactttctttacatagatgagttatatctcatatttgatatgttccacccttttctgattattcattctgtttatttgtggatgcagggaagaactacagaagttgaaagtatgttccttgcttctcatcataatctggaggctattatagcagcctgctctttctgactaatttttcctttgttagg

SEQ ID NO: 49686 - DNA, 386 bp, Oryza sativa
gggagtataaaatagtgatttgtcaatgtatatatattaaagttgagtaacttacaacctatcataaaaaaaactcttatagatcaatgacactattgagtaataaaacaatcttgttggtgcacggtaaaatggtggatagataggagtaagtcatcggtatcgaacaatgacactggctagtatgtagtgggttttacttaagttctcaaaataatctatgtctgacatcatttatacataaatccttttaatcacaagatttgaaattgacccactcttaaaataagcatataatgtgtcaatgttcgtagttggtagatttgtgagggacatagtgttcggtagtggggattaatggttgtgatcgcttcctaaaccacagg

SEQ ID NO: 49687 - DNA, 892 bp, Oryza sativa
ttgcctctcctttcgaataacctcatgtctacacatagtaagcctttagctagctagactttagctactattagcatcttttgtggcttgttagcggctaatatgttcagatgactatatacatctttcgatatagctagagggcaaaaatattgcatctattacttaggaacaattacaaaaataacatatatggcttttcagacacatatgcatgatcagtggcggagccactacttgacaggtcgagcggccaccgggtagagatgttcgatcttcatcgatcaaaccagactcaacggcgtacgtcgctggctccgccacagcatgattatgactgaggttaattaaataaaagagaagcaagtagcaatgagactaccactcacgaacgtccaacaagtagcaacgactactcatcaacgtctccaagtagctagggacgatcgagtagcaacgatacgccaaaatggcccaaagctagctagcaaagccgcccaagctaaagctagtgcacgctccagccacagaaaaagcaaggccgctgctgctgagactgagagcgaggcgcgggcccggaaaaatctccgcggccacctctccgccaatggggcggcggcgcccacgtgacatgcctccacgtccccctcctcccccaccacctcccctatttctatctcctctcttcttcttcttcttcttcccccatagtttagatagataagtaagcagtgagctacctagctagctagctaacagtgagctgaatcagcagcggctcctgtctcctggagcttgctgatccagtagtccagtactactctgccattagctaagctagctggagcttaattagtggtgatctctgtctctctcaagctaggcgccatgg

SEQ ID NO: 49688 - DNA, 1216 bp, Oryza sativa
agcttgtcgtttccgtcgttgcaaaggtttgtgagtgcgtcgaaagtgatcaagaagattattgaagatcgattatgcaaggcaagtcacagatcctaaacacaatccttgagcatgttgatcctatatttaattctctatttatttcaactgtgcatttattttcgaatgtcaccgggtggtgtgaacctattcctttgttatggccaatttgcattgaatgctctattccttgataccttgggtaataaattgattagcttgaaccttgtatattagattggttcagctaaatgctatatgtaagtttgcttagctatgcttagaaacattagctaactaaaggggttaattataaactatgttatattattattattaattatggttacattaaatggtagctcacgatggttaatcgtgtgatgttaattaattgataattaaaatctggttaaggtgggttgtgagcatatggttttgatggttgtgctcatgacaattaaggaccggttcgcgagctactgttgtgaaacatttatcgtgccaaccacaagccaccgtgggcaacagctttatcttttgtatagcgtgattcattatagtgcgccagactgagaagtggcgagaagtccacgggggtcgctggggagtccatgccttgtttataagggggtgattatgatccaggaacggtgcactgttttgagttgtgttgtgcaaagggtattgtcacgatttccccatttgcaatgccgtggtggtatttcggggcatggcaacatgtgtggaatcgtgtcttgtgggtacagtggtacacctctggccagagtaaaactattcgaatagccgtgcccgcggttatgggcgggttgagcaatgtttttcgtgattagtctcacacctctcacaataattatggatgttaatatctggtaataatttgcttagctcctggtttggagttagatctgtacagccgggtatggttgttcaggatggttgggcctgtgcagcatgggtgtgctgttcagtgttgattaaaattaatgattaattactctactgttttacttatcttaaatctttgctaaatgctgcttttgcaaatgagcctatattatgccatcctttggaatccttgtgcacttgcatacttgctgtgtggcttgttgagtatgtcatatgctcattcttgcaataatcatcaaacctc

SEQ ID NO: 49689 - DNA, 554 bp, Oryza sativa
gctgccccggaatcctcccagactcatttgcaggtactaaggcagctaattgagctaactaagtttctatcattttgttaaagctcagctggttttggaaagcagaagcgaagctatctagcttaacattaatgttttctaagatcttgtaattggcagctagctttttgcttaaagcatcagtggtcttagcttgcacaaaaacgagatctttcaaggagggttggttagaaaagttaccgttgttgttagctccttgataatatgggcatggctgattccacccctgacctccttgtggacgatacccattgttgttgttgcccatgtacatcgccaattcatgggtttccgggcaatcattcccagaatgacccgtgctgccgcagacttcacatgtaacgtgtgagtccaaggctttgacgatgccttgtggccttttgtcatggtcgtccaatcatttcatgaggaggtccatcttggcagcgagcatttccatctccttgacggtgtgcatgcctcgctgacgggtttggagtcgttcctcgctccaa

SEQ ID NO: 49690 - DNA, 1501 bp, Oryza sativa
tggaagagaaccgatatcaactcaaacgataaattaattggacgatgtcgagaatcagacttatgtccgaatgggccaagaactcagaattgacacgatcaattgggccaaaattcacaagtctgcgaagagaagcaacagaggaggcagccagccaaaacctgggctggttgggccggcacctggttcggccgaacccccctggcgccgttggatgcagggtttcttctagacggcgtggatcactccccaatgatggttggagggcagttccgaccattccaactgccacaaccgtcattggcagcctatttaaggagctcctcttctctctccacacacgcacctcaagcaagagctctctcatattcactcaagatagtttagtagtatcaagctagtggagtaggaatagagtagaaatcggagtccggaagccttcagaagagttcgggtatggctctagtagctcttctcttctcttttgtaagctctgtacttttattagaatactattctatatacatttatggtattgaaatactttccgagtacatgggtacctactttacattatgttcatgttatactgaatatacagctagcttatctgggagaagctgtggtgtgggtataatgtttgcttaagcaattactctatgtcatgatgatgatattagagtagtatctgttagtttaggcgtggtatctagatttggggatatcattatttggggttatatgctgcagatgagaggtgggccgctgatggtgacagctcagtacgggtattcctccgcgcgtgtatatagtcctaagttaattccctggggagggtactcctccatatttagccccggttgtatggtcatgatgggctgtcgtaaggaactcgacagttaggggtggcttctcaaagtaccaggagggcatcggatagagggtattagctagtatgtcagataactagaatgtatgtatactatgtatactagaagtataggaatagattttctttctcttttttttccacttagcttaggtaatttagtatgagaatgagtagcttcctgcttgtgtgtcattctacccttcgattatcttaacccctgcttagactatagttattacaactaacatataaattattagtcaggttctctctattatgatcttcccatgggattaaataaatacaatacccttcgaatactttggggtgaaatgctacaatggtatatccgtgcgcttgcggatgaactctgtaaccataatataccaggagtatttatgcaccattgctgggaattatatttctagtaatgtcgtttagaaataccaacaagcatttctggcaccgttgctggggaagatttgtaatagagattaccataactagtactttatattttcctctgtataatcactgtcctttgcaggctaaccttggttgttttcacttttattatggaaacagggtagtgcacgactggttttaagt

SEQ ID NO: 49691 - DNA, 523 bp, Oryza sativa
actcggaagaagaatcaacttgggaacgagaagatgaattgaagtcagctcatccgcatctgttcaccagttcttccgaatctccaggacgagattctgttaaggggggtaggtttgtcacaccctggaaattcaaaatatataaattgttgtttaattggaatttttagaaataattttaaaagcctagaagagaagatctaattttaattaataaattccaatataaaatggggccagataaaatatcattaaatactttgcttaattctataattcccagatttttctgggatttatttgagctaagaaagtatttttaataaatggaattgcatttaaaaaaccctcctgtcaggatcgtcgtcctccttcgggcgtacacctagtttcgcgcccccgccgccgcttttccaatccgggcgttcctttccgtttccggccgaatcaattgaggggaaacaatctccggcatcttctctaccttttctcctttggaatctttggctaaatcgttttggaa

SEQ ID NO: 49692 - DNA, 1146 bp, Oryza sativa
caaagccacgcagcaaatatgcaagtgcacaggataacaaaggatggcatagtagggtttcatttgcaaaagcagcatttagcaaacatttgagaattataaaacagttaagtgataattaaacaatattaatccaacactatacaacataccctgttgcataggcccaaccattctgaacaaccaccccggctgcacagttctatctccaaaccaggaatgtaccattccaaaccaggagctaatcaaattattaccaatttaagcatcttttactatggtgagaagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttatacaacacaatccactgcagcgcaccttcctggatcataatcacccccttataaacaaggcatggactccccagcgacccccgtgggcttatctccgccacttctcagtctggtgccccgcaatgaactatgctatacaaacgataaagccgttgcccatgctggcttgtggttggcacggttaatgtttcacaaccgaaactcgtgaaccggtccttaattgtcatgagcacgaccatcaaaaccatgtgctcacaacccaccattatcaggttttagttggcacattaattaattaactaatcacgattgaccatcgtgaactatcaataagccatcatgaaataatagtgaatcataagttatcccaatagtgaatcataagttatcccaatagagacttgaaccaactaaatcggagctaagatgaattagttatgaatttttaaagattaaatcggattaaaacacttatatcggtttaaattgaattatgacgcaataatgaattatttttgaaaaggaaaagaaggtttattgcgtcagcgggctagggtttcggtggaccgggcgcacgggcggcggttcacgcgaacggacggccgagatcgatccaatccaaaacggacggccgagatcgaacggtccacgaccggctcacggcggacgaccccga

SEQ ID NO: 49693 - DNA, 1501 bp, Oryza sativa
ttttggaggttggtggaggaaagcagtcatcatgttggcctgctgggcgaggatttgggtgagaatggcgttggtatctggtggtggtggtggaggcggaggaggaggtggaggtggcctgccctggtggttgtggttgctgccttcaggttggttgccatcaccggtattagcacttctcctggtcatcaccatctgaaaaccccacacagaaccagcaaacagagagagagctgacaattaaagctaaccacccacgactaccataattcttgaatttattactgctattaaattggttcattaaagttcaagttgcttagacgaataaaataaagacaggctccgacacagttataccacacacggcataaccatgccccacacgactccaacaagaagacaaacgagaaagaacacacgcgcaagcctactaactgctcgtctaccgctgcgacgggccaggacggaaggtgagcaacagcgcatcctccgtgctaccaacgccggaggcttcccctcctggggaaccacgggcgcgggctcggcacgaggggtctccacgaagcaggtccacgccagggactgacgaacaagctcgggcctggaggtgcttttgcgggcggtgatcttctggctgcggtagacgcggtggcgcttggggcggcagacctctccctgggcgatcttgagctgatgcagctgcgcctccactgcgtctaggtccttcttgagctgcaggttctcctgatgcagctccaggatcttcaagttgttctcgaccatcccacggcgcaccatctgatggaagtcgatacgagccgcgtcgtacgcctccaccatgcgcgccaggtgcacgatggtagcgtcattcttcgagctagcatcccggaaggtggcgtagtcgcgggctcctccacggcaggggtggtaccggtaggcgaagtgctacaactcgtccgggtagcgctggtgaagagtgccgatggcgaggagagcggcgttttggtaagcggcggggaaagaatctccacccgcggtgactgccagcgaagtccgctcgggagagccagtgaggatcactgcagtaacctcccacgcagcgtggggctctgcatcgtcaccctcctgatccgaaagcggcctggcctggtagtccactccatgcggataccccaggacaacgcacatgccccgcagctccaagacgaaaccagtcatgtccaagccacgacggctgacgctgccggccatctacaaacaaaaccaaaaagaaaagcaacatttaaaaaggtcagattttggcgataaatgaagcagcaagacagagagagactagagggttttcacaaatacaaaggatttttatttcgaaaatactgctatggcttgggatctacggctcgtcctagggtcaagggtggctctgataccaacttgtcacgaccggaaataacccaacgggcgttccttacgtgcgtgcattaatccttgtcccagg

SEQ ID NO: 49694 - DNA, 1501 bp, Oryza sativa
aaggctttggtgtctagctcgtgcctgccgtcaagtgcctgtggtcgtcgccctagtcttccgctgtttctcgtttgtctctgtgtgtgctgggccttcgctgcccatgtaataaattaactatttacgcttccgcttgttaaactttgaattgtatcaacttttggtgtaccttgcctcctgggacaaggattaatgcacgcacgtaaggaacgcccgttgggttatttccggtcgtgacaagttggtatcagagccacccttgaccctaggacgagccgtagatcccaagccatagcagtattttcgaaataaaaatcctttgtatttgtgaaaaccctctagtctctctctgtcttgctgcttcatttatcgccaaaatctgacctttttaaatgttgcttttctttttggttttgtttgtagatggccggcagcgtcagccgtcgtggcttggacatgactggtttcgtcttggagctgcggggcatgtgcgttgtcctggggtatccgcatggagtggactaccaggccaggccgctttcggatcaggagggtgacgatgcagagccccacgctgcgtgggaggttactgcagtgatcctcactggctctcccgagcggacttcgctggcagtcaccgcgggtggagattctttccccgccgcttaccaaaacgccgctctcctcgccatcggcactcttcaccagcgctacccggacgagttgtagcacttcgcctaccggtaccacccctgccgtggaggagcccgcgactacgccaccttccgggatgctagctcgaagaatgacgctaccatcgtgcacctggcgcgcatggtggaggcgtacgacgcggctcgtatcgacttccatcagatggtgcgccgtgggatggtcgagaacaacttgaagatcctggagctgcatcaggagaacctgcagctcaagaaggacctagacgcagtggaggcgcagctgcatcagctcaagatcgcccagggagaggtctgccgccccaagcgccaccgcgtctaccgcagccagaagatcaccgcccgcaaaagcacctccaggcccgagcttgttcgtcagtccctggcgtggacctgcttcgtggagacccctcgtgccgagcccgcgcccgtggttccccaggaggggaagcctccggcgttggtagcacggaggatgcgctgttgctcaccttccgtcctggcccgtcgcagcggtagacgagcagttagtaggcttgcgcgtgtgttctttctcgtttgtcttcttgttggagtcgtgtggggcatggttatgccgtgtgtggtataactgtgtcggagcctgtctttattttattcgtctaagcaacttgaactttaatgaaccaatttaatagcagtaataaattcaagaattatggtagtcgtgggtggttagctttaattgtcagctctctctctgtttgctggttctgtgtggggttttcagatggtgatgaccagga

SEQ ID NO: 49695 - DNA, 498 bp, Oryza sativa
attttcaacgaaaatttattgtgccacgaccacattgaccgttgaaacccaacggccaaaagtgcggccggtgggcccacaggggttcggccgaaccggccaggcaacggttacatgccacttttggcagggtaacggctagtgggtcccacatgtcatttctaaccattgtaggtgtccaatataagccagccagccaagagagggaattccatcccatttcaacacattttcattccctctctaaaggtttctctcaagttcattcaagctttgatagttttccttaaattcaaatacttagttgcatacatacaagttgctttggtgaaactaaccagcgggtgaaattcttgctattctaaccctcgccgagttagtccgttcttgctccattgtgtagaatgaggaggcgattgtctcgtttgttcaaggggtccgactcttcatcaagtcatcatgactagtctatagctcgttcatcagccgatgtctcga

SEQ ID NO: 49696 - DNA, 215 bp, Oryza sativa
actgttgtgttatgaatgagtttattccaccatgcttgcaaaacgaagttcacatcaaaacaatttccttaacagaataaaaccataagggctagttaggaaactaggttacttacctaatcggcctacacagatggcaagccgacgtcgggcgtcaaccagcaatgaagagactcaatcacccgacctaaccaccctggctggcgttatggcca

SEQ ID NO: 49697 - DNA, 997 bp, Oryza sativa
gcccccccccccccccccccccggtcggtcgccgtcgccgccccgggtaggaagagagccaagagaggaagagaaagaaaaagaaagcgaaaagagaagagagaaaagaaagagagaaaaagaaagaaaagaaaataggaaagaagaaaaggaaaaataaaagagaaattaggggagagattaggaggatttaggaaataaaaatggttggggtttaatcgtagattatttttggaaattcctagagtgtaatagtatttcgatcggaattccgggttaattataggaatatatttctcgatcggattttattagaattggtggtagtgaagtatttgtaatttcatgaaatattttaggatgtataaatcgaaattcgatttgcctatttcacgagtagtataattaatataaaagaatcgactttcgcattcgacttctatttggatttatttggatttttatttgaattctaaccgaattcaatcgaattttcgcacgtaattttagagcccgagggagttgcggatccgagcgaggaccaagacccgcaaagcttcgaacaaggcaagtcatcactattccttgaacatgttgatctcatttgcaaaattattttgtttacaaataaaattgcatgcaatgatgaacatcctacttgtgattatgccatgtcttgattattgtttacccttaaatcctataacaatgatttacgtataagtccctagacaactatgacaaatgcttagaaatgctactctagatttatgcatactcatatttatcaaatgctatgtgcttgggcaattacctttgggaaggtaattgagatgcggcatgtggagacatgagcgccacattgccataatattaatgacatgatttgtgaaaggaaaataaaactaaacaaatgttttcgactggggcggatggaggatttgggtggtatccggaaaaggctagtgccgtccctggtcaattaaggaccgagcca

SEQ ID NO: 49698 - DNA, 1501 bp, Oryza sativa
gtgatatttcaactggaaccatatagagtatatgcttttgatcctctcatctacacaaaaaccagcccagtacctcattgcagctcaggaacagcagttcaaaaccaaccagcataaaaccattcatgttttgcaccttacagtcaggtagaactaaagttttgatgagtccaagatgaattgtactccagaatctctcaacagatagcaaggttccatgcaattcagtggtgatgatgtggctgaagaatatttgatttgattcacaaagtgctctagcaagatatatactcatccaaaactccacggagagatccattgcatcaagtattgtgctagattgttcacaataaactgacactacccaagttgcactgaactgataaataaataattgcatcacaatgacccaattagattgtttctttagcaaggcttgaaagtgtgttccattggcagctgaaacatccgcaatatctgatctcctttgaaaatgcttgcaccaaacagaacttgctagaaagttgaattgtaacatactcggaacttgttgaataaatgagttttcattcccatatagaacctgcctggttttgcataaacccaggtacaagatgcagcttggatttatcttcgcccaagattgcacaagcaaatcaatgtcacttatgtctccagttggatgatcaagaaggtagttggaaccgaaattgacaactcccagttgcagctgctctctctgtaaacagcactcatttgtcttcccactttgattccactgaagaataaactcagatttaactagtaactgttgcagcctttcccatagttctccccaagaattgacaaatgacagtagcaatagttttggttgcagcattacttccaacccattagtcaaaccgccacaataatgcacatgaggtgaaaataatctcaagatccataaatcaggtggtggccatgtcttccaggaagtgatctctgtcaatgtcaaaaacatcaattccttacttttagtttgaagagaaggtggccatgattgaaagagtttgaccagcacacttctgctgccttgtactgttcgtggatcaggacagggttcaagttgatgctcagcactgtcacctttgcaaatggctccaggaagagatggcccatactgtgagatcttcaccaccacgcttccactgccttgagtaaaccatggatcaggccatagtaaagattgctgctcaacaattgaacctttgcacttggcttgaaaaggaggtggccatggttggagaggctcaaataccaccacactgctgcatcttccatctgcttgacaaccatagagacatatcgtcaaacagatgagagatagatagatagctcagtctgaatcagctatcccgtagtactccaataaacaattggtgccatatactaatatacaaattaatcaaccaagaaccagtcaatgataattgataaagaaatgcgaaattgtgtggca

SEQ ID NO: 49699 - DNA, 1501 bp, Oryza sativa
gaggcggtcttggccaacgttctccaggtggctccacgcctccaccaccgtccctggggtttggtggcggcgcgacgcgactgcgaacacgagcgcccacgcggccacgcccacgtacgtaaaccgtcgcgagaaagaagaaaaaggagaggattacctgtccgccagaatatcctactcatcaatcagaaaaaaaaaagataatattgtaggagtactacgcgaaatcgcctgctacgattccgcctaaatccaatgtatcattcgattgacttgactgacatggaaaggttgtactgcacaccacacttaggtctgtttagtttccaaaatttttttcctaaaaacatcacatcgaatcttttgacacatgcataagcattaaatatagatttttaaaaaaactaattgcacagttagggaggaaatcgcgagaccaatctttcgagtctaattagtccatgattagccatatatgctacactaacctacatgtgctaatgattgattatttaggctcaatagattcttctcgcgatttcctgctaatggtgttcttacattggacaccgcagagcattctttcctgctatatacgatgttgcattgcttgagcgtagatgctctgacatcagcacagtcccgcaactgagtgcaaaggaggcctgtttgatgttgctcgagcattgaacctgaaggaaattgaggctgacaatgaggcagccagggttcttcttactctgagatgctatatgaaattggcagaacgtcctgatttcccaggcatggcgatggctgtccaagggctgcttaaggataactgctgctggaaatgcccagcaaattgctgatggatggaggatgcatgataactccgtgtggtaatcgaatccttgctgtggctgtcaatgccatgttgtcacttgtccgtgtagttttgtagcctttgtgctcacacgaaattatccttttaaaactcaacggtataactttattagctcattttctcataccactcttctttgttttaaggctcatacatttatagtttgtaatatacaaataagagtgttttgtttttgtgagttgcactgggttgcatgaagatgaatgagtagagcagttggatgtgaatggcgggtgccaaccaaaaacgcatcagttgtcgaatgcagatgaatgaatgaccaattgtaaatgcagattgtgagtgagaggtgaatgttgtttggacttgatgattctttcctgattacaattacaaattaacagctatgctggctgctcctagcatgtgttagccaacaggttctgatgattgcgtttggtcatgcagtctaaagcaaaacgttacgaaatgctccctccgtctcattatataagggattttgaatggatttgacacattttaatacaatgaatatggacagacgattcattatactaagatatgtcatattcatccaaaatcacttatattatggacggaaggagtagcagt

SEQ ID NO: 49700 - DNA, 397 bp, Oryza sativa
cgttcgcttccagcgattaactaccactgtggagaatcctgcgcactagtataccggctcaaagcctcgaactcttgggttggggggcccgtattggtttaaatttataaaaacttgacggtattattacagccaatccggaatcagccgcgacctccagtgttggcatgccacgtcagcagttgccactgcagatcattagagtttaggggcacatttgtcctaagctaaaacaacaattctatctaagcgcgagaggacaggggattcgcctcaaaatcatactaccacattagacaaaagcacatttcgtagaggtgtctctctctctcactgtcgaccctcgggttcctgacgtcgcaaaggcgtcactaagctccaccggcggcaggcagca

SEQ ID NO: 49701 - DNA, 828 bp, Oryza sativa
ggcgcagcgcacacttatccggtccgcgactggtcgcggtgtgtgaccggtcacagaccggtcagatcgcgggttaggtggcaacaggtggtctgtcacacgcctcgccccgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccggaaaagcgggcgagcggggcaggagacgtgcgctctgcttgttagaggtcacttccggctgtagactagccctcattgtaaaaagcatgtttcccttcttaggcagctagaggcccatgtggtgacccctgaccagataaaaaggaggcccaggcctaggaaaaaaagggggagagagagaagaaaggaggggagttgggactctggcgaagggtttctagagcctgaactctctttcgctctcggcctctcgggattccttcacgcaccgatccaccagaacacaggagtagggtgttacgcttctcagcggcccgaacctgtctacgtcgcccgtgtcttgcgtatttcctctctcgctgacgttcctcagatcgagggcgaagaatctcacttagcgcccccggccgaatcggcaaaggggggcctgcgcggtctcccggtgaggagcctcacgctccgtcatctggcgcaccaggtaggggcgcgcgtatttttctaagccctcgtcctctttcgtgtgcgccaagcttctctcgctcagcccaa

SEQ ID NO: 49702 - DNA, 1501 bp, Oryza sativa
ttatccattgcagtttatcattgactggagttatgccttatgtaccagtgcttttttactgcctagggagtattacagagagcagtgcgcatcactgtatttgtgactggtacaggatcaacatgattttgtctcgttcttcttttcaatgttttttttttctggagtgtttcttgttggaaaaagagatgaaccgagtgcctagttctctcgcagtactttgtggcagctgagaacagtacgattgctgattatttaagtggatgctgacagcagttgatctcttggtttgcactaatctgaatgtttttgtttggacgtttttgggcagatgatggtcattggtgatgaaggagatccgtagcaagatgatgaccatatgaatttggtgagacagttttagctttatcatcttagcatcagtcaagtctagagagttgaggtggtgattgatgtctgaccatcaagcaggtggtgcttttcgcaatttcacctgacctttttttttttgttcaattgctgagggaaatcatatgtgatgcctcaagtctctctccaccaatgccagatttcaatccagaacttgaacatgaatagcaaaattgtaaatgaatttgctaggaatttaccatttcaagaaatcttggaatattaacaggcacaaattgcggagtagccaacctccatatctttcgttagaataaggccatcaccaatcaaggataccatatgagtgtcttcactaactgaagatactgtgcgggaaacacctctggagaataccctggtgacccaatgagtgttcctaacccaaaaagcctacgtagttattttactgtactacccctctcttctcccccacttcctctctcttccccacatttactcatctaccggacccgttcacatcgtggtcctcgccgccgccgctcgcctttccctctcgccgcggggccactcgccgtcgccggtggccgcgagggctgcctccctccctctctctcctcgccgtcatcgtcgccgctgtggccgaagcgtcatcgccgtccgccacctccgcctccctccctcactctcctcgccgtcgtcatcgccgccgcggccgacacgtcgtcaccgtccgccgcctctgcctccctccctcactctcctcgtcatcgtcgtcgccgccgtggccgaagcgtcgtcgtcgtccgcctcctccgcctcgccggtctcctccgcctcgcaccgtccgcctccctgatctcctccgcctctcgccatcacaggtcgggggcggcaaaatccggcgccgtagcgggtggatctagcccccccggctagatcggggaggagatggtggcggccgtcgcgctggtcgcggggtcggcgccgtcgccgtcgcggggtcggcgccgtcgcctccgactcctccccactgccgtgtgcctcccgcctactccaagcgacgaggccgagggtggaagggcaaagttgtggtgggggagccgtgtccacg

SEQ ID NO: 49703 - DNA, 197 bp, Oryza sativa
atattgcatgttcaccttattaatataataaactaatagataaatatatatattagtatctatttacacaataaattagcatgtgttagcacaatatatttattttaatcattttctactattttattagtgtgattaactagaaaataattatacttatcaagagattattattaaaatatatattatactactta

SEQ ID NO: 49704 - DNA, 1501 bp, Oryza sativa
tttggcgtcgttttcctccttggggcattgctgtgttttctatcgtttcccaatgggttcttcaggtgaaaacaacgtcctggttctctaggacaggcggcggtggcgcttttggcgtcgttttcctccttggggcattgctgtgttttctatcgtttcccaatgggtccttcaggtgaaaaccacgtcctggttctctaggacaggcggcagtggcgcttttggcatcgttttcctccttggaagcgtcgtttagaagacatattccttgggggtgttgtgtgcatattttgttttgttttagcagtatgatcaaacgtagacgcgtggtgtggtgaacgcacgaactttattagcttcaaaatgtttttatttcctgatacaatgcacaggctattctattcatcaattttcgttgtttgtattactatcatacgaaatctataaacaacatgtgatgtaattattattagtgccatattaaagttttcatcataaaagaattacacttaataattatttattaccttactgtgtggttttaaatcggtgtataacttttacctggtactcgtgacacatcctaaaactgtgaatttggaagagagcatgtccaaatttctacaactcccaactacctaatcacccataagcaaatatcatttaataggatattctagtattttaatcttacccagtagagaataatcccttatattatagaatgaagggaatatccgggaagttgggaagtatccagtgcaatagtacttctcggtgggagaatgcgatatcctattgctagcctttagatttgaaatggacgcggtagattggagcacttcctattctcttagttgacaaatgcaaaaaaaaggaccctataatatgtgccaaaatgttacgagcccttccgttctcttctactctaatctatctatggctatatttagttccacaccaaaattggaagtttgaagaaattagaacaatgtgacgaaaaagttaaaagtttgtgtggctaagaaaattcgatacgaagaaaaagttaaaagtttgaagaaaaaaaaaagttatgaatctaatcgggcatagcctatgcctgaggctctatctcccttgtggccttatctgaatcatttttcattgttcacctcttgttcggatacttgtcccctatcttttcccccttccctggcgtaaaagaaaaaaaatatctcccgtctccactccactccttgcgccatctcgcggctgaacaggggagtggaggggagggccgcctatctccatctggcgagcagagcaagagcaagggaggggatcctggtgtggtgagcatccacatcctcttcctgattcatctctctctctcccaccgggactacttttgcctggaatttgctttgctttcgttaagctcctctcttaatttccgatacttaaccttaatacaagtagtaacagtttgtttgttcgtctcaagttggattctcgctga

SEQ ID NO: 49705 - DNA, 164 bp, Oryza sativa
aagcagccgaagttggtgctcgacgccaccgacgacgggttgcacctcgccggcgtgggcgagaagcagcacaacttggtgctggacgccgccaccgacggattgctcctcgccggcgcgggcgggaagcagcacacttggtgctcgacgccggcccgggcagg

SEQ ID NO: 49706 - DNA, 309 bp, Oryza sativa
ccaattcttgacgtgcggtgcccgcaaccaaacagaactgcagaaatgttaaaatgctgtagatttccatgtactcccatcagagatgactttgagaaggctcaaattcgtagactcctctcgaggttttttctacccaggggatgaccgcgatctcataagaccgacaggaccttccaaaaccagagcacgaactacggagatgagacacaacattgccacaccgtaacaacctcagcacaagcggacaggcaaaacacaagcaatacacaaagcaagaatagtctgcagaaaactgtaccacgagaa

SEQ ID NO: 49707 - DNA, 1501 bp, Oryza sativa
gaagcgcttgagagaggcggtgttccaggaatggtcgaactcgtcaccttctagtgtcgccaatcgaaaagatcccgtcctagacttgtgtttgatgaggtatggtccttcccactttgattcaagcttgccaacagcaatcgggttcgctttcttccttaggacaaaatgaccaggcatcagttccgtcggtcgaacttttttgttgtaagttgccgaagtgcttgtggcatacttgcgcatgtgctcaagtgcttcaactcttaccccctccaagagttcgagcgacacttcgcgcccctcttcgcctccagagaacatcacccttggtgagttagcccctagctctgctggggtcattgcttcgtcgccataaagaagcatgaacgggctaaacttggttggtcttgtgggggtcgtccgaagggcccagagaacggatagcatttcctctggccatttgcccttcgctgccccctcgagccttttctttagtgcttctaggatcttgccatttgtacgttcggccgccccatttgactgcgggtgcacgaccgatgcgaacctgatttccaggttcagccctacgcacatttctctgaacttgtcagagttgaactgcttgccattgtcggtgatgaactcttttggtactccgaaacagcagacaatgtttttccacacaaacttctgtactgctgccgaagtgattgccccgaggggttcggcttcaatccatcgagagaaatattccactgccacaattgcgaacttatacccgtttcgcgccactgggaatggcccaatgatgtccaatccccatctggcgaagggccagactggcgcattgggctgcaaatcatactggggcgcggtttggcttcgaccatgacgctggcaactttcgcacttcttgatttgctcaacacagactttcaacacagtgggccaataaactccgtgtctaaacactttggaggccactgttcttgcggcctggtgagcgccacatagcctctggtgtatctcctttgccatttccttgccttcggcgaaagagatgcaacgaagtaagggttgaagtaccccggagcgatagagctggcccgagaccatcttatacttcgtggctctaagttgcaagcgctttgcttctgcttcgtcttccggaagctagccagtttcaaggtgttttacaaacggggttcgccagtcgtatgggtcttcgcccagtttcacctggtcgattgccatgatctccaagctgtccgtgggcacacttggtgcatgcaggacttcgaaaaagatgccaggcgaatgtgggccaccacaagcagcagatttcgccaaggcgtctgcttcctcgttctggcctctaggtaagtgttcaaccgttatgccggtgaagcacttttccatggaccgaacggcctccaaatacctcttcatccctttttcttttgcctcgaaggatttgtccacatggcctttgatgtgacca

SEQ ID NO: 49708 - DNA, 1501 bp, Oryza sativa
tcaggcattcgactgccacccccctctgattcctccgccaccggcggcgacatctctgtcggccgcggggatcccctcccggaacaggagcccgtcccggatcccgccaccacctcccgccgcggttgcccacagtccgccgccgctctcgccggctgtcgcctcgctcctgcctgcttcgcatgccgctgccgctctcgccggccgtcgccccgcccgtctcggctcgtccaagaagacgagagaagagaagaaagggaaaaaagaagggatgtgggccccgcaccgttttctctcacttacatgtgggccccacgtattttatttatttatttttgctgactaaaatgccacgtcagtgaaaccacccacatatactgccataggatcttttgtgcacagtttgtgaaaatttaggggtgaacatttctgattttgtggttgagatgttaagttgagggacctttggtgaacttattcctttccctgcagaagaaacaacagtatctcgtcgagagcagtgacacaagtttgacacagaaccgatgaaaaccgctcagttttcttaaaatttgaagggatttttaggctaaagatcgtagacccggcttttaaaaaaaacgtctaagaggtcttccggctaactccacaagatggtgggttagctaacctgggttcaaaatctcatttgatattagatcttttcataatattcgcttttttaagctggtttttaatcaaaagtcacaaagtcagaaaatttgaaggtttcgagccaacacgagttgacaaacagcacactagaccagtcaaatataatttataaaaaaaatcaaattacatttaattatttgataaaatttgttcgtatgtcattgccttttactagatggtttaccttaccgctatctagtggtatcacagttatcaatcgtttggttactataaaagcgataagatattaagtggtatcacaattatcaattgcttggttactaaaaacccaagaggtttttgattaaaaaaacctattagcttttaaaaataaataatactccctccatctattttcaaatttgaaaaatttatttttaaaaggcatatttcaatctaacaacctattatcttaatgacattctcggatttaatgtgtgactctctattctttcacacaagattggctacatggatatcgagaaatgcaaatatcaatgaatcatttgtttacgagaaatgactagtagcatgtttaaatagatgataagtaaaattacttatccttggtctgtgtgccaagatgaaatatgactattaaaagtagatggagagggtattgtagcaggatgttactgtgataagtgaaggtaattatctgccgcactgctgatgctagcaaacagtaaaactgtaaaagcttcaggtcaaactcacacgctggcccagttgctcagttaactcctcccaataatctcacgcgctctcctctcgcatcgaccctgtc

SEQ ID NO: 49709 - DNA, 1501 bp, Oryza sativa
aggcaaggccccgacgctcgccgccgaggtatgggaatcccgtatccctatcgcttcccgcttcccagattttggtgccttgctagtttgcctctcgaggtgtggttacgcgcgcgtgcgcgggcggcggcctgctccggtggactggtgcggcggcggcgcacgcgcgcgcgctcagatcccagcaatctgtgatcgcgtagtggattggttcgcgcgttcggagtggcgggatttctcttcgtgcgagtaggtttggagcggtgggatttctcttggatgcatgtgtgcatgtttagtccctgttaattagttcccacgtaaaatcttttcaccatgtcacatcgaatgtttagacacatacatagagtattaaatatagaaaaaaaaactaattacacaaattgcgtgtaaattgtgagacgaatcttttaagcctaattgctgaccatgtattgctacagtaaacatttgctaatgacgaattagttaggcttaataaattcgtctcgcagtttacaggcggaatctgtaatttgttttgttattagactatgtttaatacttcaaatgtgtgtccgtatatccgatgtgacatgtcaaaacttttcactcctgtaactaaacagggcattagttgggttgagtggaggaattaactcgttccgtcttctgaattggctcagttgcgactgctgttaggcgttagctactgtcgccgtcagtaaatctctttttttccccttcgattgccttgtccaaatcgttgactagttgtctaccgtgtaactttggtgctgcacagacgcgtacagagcttcaaagatgtggtggccatcattccgtgctcacaaacttaccgtgtagccgtatgatattgccttaatcaaattatgcatgagcaatgcgattgaagttaaccccctttattttgtctgaattaagtaataaacattcagcttataaaattatatgcttttgcatgtattaggagtttatgataaagctgatatgatgctaaatgtactacttccgtgccaaaaagactttatttccagtggggcggaggtagtacaaaatgtcattcaaaggataattcatattttctatttttatgtttttgttgagcatttgcgtacttaggtgtgtagcctcaaagttggaagagttacaattaggatatattgagactgaacccataatcttgtatgagtccgctgcatagtccaattgtaatctaggcactgtcctcacaaaaaagaaaaagtaatctaagtactgtaataaaggatatggaggccctggacaatgcacaattattcctcaaaatttcggtggatgatatctgtgaaaaaatattaccaaaattaagcctagaacactgttaccctgagtatcccgtgggtagcaacaatttgacacttgcattaatgtagacgcgcacttgagcccaactatcttctgtgtgttgctgttccttctgtaattgatattccatggt

SEQ ID NO: 49710 - DNA, 240 bp, Oryza sativa
agtaccacattacagctgaatctgtcatgtcgtacattctgcttcaaaattgtagtaatatttctatcccagttatggggaatccccattggggatagttcctccctcttggaataattccaaaggaaatgtgcaaaacaatcttatttacagacattcaccttcatgtctttttgtcatcactcgtcaccactcttttatgggcatacccaaatgatatgggtgttctttttcctcagg

SEQ ID NO: 49711 - DNA, 312 bp, Oryza sativa
ccccccccccccaaatcccaatttcacatccgcgtgatcgaatcaaacacctgttcatcatcatctgcagcatccaagtatccaatccatcactactactactgatttgtttcaccaatgctatgtgattcttctctgtttgagtgcttacttgttcatcatccgttagcatccaattaatccgtcacttttcagggtcaagaacactaattctgctagtactaatttgttccaccagtgatatgctatgtgagatgtgattcttctctgtttgagtgcttggaattggaaattcttctgcattgctgtagt

SEQ ID NO: 49712 - DNA, 438 bp, Oryza sativa
atgagttttcgtgtccaaatttgatcgtctgtcttatttgaaatttttttataattagtatttttggtgttacgagatgataaaatatgaatagcactttgctcatgacttatgttttaaaatttttttaaaaaaatttaaataaaattatggcagcacttaaaatgagatagattgagtggagtttttggaagaggagagtcctgcatacagccatacacagtgttgctctgcatttataccagcactccagcagtgcacagttgccggtcaagagctgcaagagcagcagcttgacagtagtgtgacagcgtctcagccttcgtcacgcagcagcagcagcagcagcagcagcagaagaagagcatggaaatgggcttggttgcaaggacttgtttgatcgtctctctctctctctctctctctccctctcctagt

SEQ ID NO: 49713 - DNA, 1501 bp, Oryza sativa
cactgggtgtcagccctttgttccctaaaaatatatgggccaacccaagaaccttttggtgccaaatttttagggtcggccagcgcacctaatgggtcgatctgccccctttgcaggctgaggtgtagcattatataacactaactaaacagagacgattttgctatatatttgtcgacaaatttttccctaaaaatttgacagatgtaattacagtacaatcgtagtgtaattacactataacttctatgtaatcacactgtaactatagtgtaacttgtatgtaactttcaaaaatctctccgtaatatgttatttcggtaaaatggaggtcgtgggaacaaattctttcacatatgtgtgtgctatgatttgttttcttcctcaccaaaacaaatcgtgtaatagatctaacgattcaaaattatgtgaaacttatatataagttacactgtagttacatgcaagttacagtgtaattacatataagttacagtgtaattacactacgattgtactataattacatctgtcaaatttttcgggaaaaatttgtcgacaaatgtataggtagtcccgtttcgggaaaaatatgtatagcttacataaaaattcatgagtggacgtccacatgagccaccaatcgtttattcgacaaaatcagcataactggcaaaaagaaaaaacttgcagctagcacctactcctatcaatatcctacatgagtattatgatccatacaagatcattcaattcttcaacctactgagatgcttcacaattttttagagcttcaaattttatccatttgcttagtgtgacaatgctccaaacaggggtcttggaaatacatgacattctcgacgcattacaacttacaagatagcatattgcatatagttaagttaagcaacaactgttgtataaaacactaaggaatctgctcaagaaatttcaagcttcacaaggagactaaattaaagataacatatgctggattgattccatgaagttaagaaacggtcagcatgtaacattgaaaagtctgctatagaattttatacttcaaattaggggactaaattgcatatactagaattaatagaacattgaataaactacaaacaatcattatgaacaaaacaaaagaaaaaaatcaagatgaccttcatggcctcacactaaaatatagtaatgcttacgtctatagagcaacaaatggaaggaggcatgtcttggaacataattcccggcagactttctctgggagtctattattgtttatagataaaactagataaagcacattttccatgccttgcatagatcaatttctaggaacaatatactgttgtgttagattaagacggccatcttacaaagaaaatgccatttattactaaattccctaaaatattctaaatgatattttagtactttaccaaatagtgctacaatattcagaacacaaatgggggctgttggcatcagataattatta

SEQ ID NO: 49714 - DNA, 1501 bp, Oryza sativa
aaattcatccaaaccatatcgccggtttcccctaccgtacccccgcgataagcgcgattatcatgcgataagtgaaaccctggatagtactaaactgggacaaaagtaatatattacaataaagtaataggtagttaaagcttgtcctgatgaaaaaaatacaccttatatttaaaaatagaggaagtaatttattttaacatgatcttttggctgccaaaaacagatgtgtaaaaacatttttcatttattagattatttgtggaggaatttgtagtattaaaatctgataggagttttttttcgttttgtgaaatagaggattgaagctttctaaatcatataaaattccttagaaatagctcaatacatgtagatttggaagggaagttaacaagagttctaatatctaagaaattttcctttcaagtctgtttactgcgtattttttgttgcttctattcaaacaatcatttttatgtcttgcaatattttgtttgcacttatatattcctattaaaattctatgttttcctaatcttctgttttctcaaccatgcatttcaataagtaatataacaatgcgctatgcataactattatacgtagaggtgggttcaatgaaggaaagaactcagcttaattagttgccaaatgcgtattaaataaacctatagcaagcaatatacacatcattgtcttaaaaaaacactaagcacatgatcattttgtcacaatggtcacgggtacattgatcctatcccttatcacggcaacacgcaacaaatctcctctctgtctccccttagtttttcagtgtgtgtttggataatggaaaataaggggtgtgattgggattaggaaatgaatgaagggttaagattaaatagaaaatgagaaatgaatggttaggattgaaaggtgtcttttggacactgcctcacttctctcctccggaatcttccactcacagcaacaaaaacaaaaccgggaattattctttttgtttttagaacaaaaccgggaattcttggcttggatacattcttctgagtttgaagcacgtaagccccaggccccaacacgcagtagcttatcatcccagctcgtcataggcatcattggagcaagaaaaccaaaaggcccatccattcttatcaaaacaagttaaataaaagaaaaacagccaaattttctgctccatggacagcaaaagaaaataaaaaaggaaataaaaagtatatttttttaagacaaaataaaaaagtacagaaatagagtctcatacgttgaggagggtagtcccacacgccagagtctcagcttgcctcgttgtcactcaccaactctctttcttctccataaataccacctccttctcactctcgcacacaagctctccgctcagctaagctctccaccattgcttgcaaagctggtcgtgtcactcctcccgttaagcttcccgcggcggcgagagcaagctaagctaggtcgggca

SEQ ID NO: 49715 - DNA, 1501 bp, Oryza sativa
gctacacacctgttatatgagcatgctcaaagtaaatagtttaattaacaccaaggtttcaggtatgaggaatctgaaactgaaagatctcgatcatattcatacctatgatattcaatatagcgtgtgaagcaatgccttgtttgatttgttgttgggaaacgaaaatcagcgggagccgtctcaatctgtatattatatatggtcagtactcaatactgaacaacaaatgtgattgcttttccaatgataggtggtattgtattgtaccttaatttctggcttctcatcaattgtttcctcttcagcctcattgctttcctctgtagcagcattgctcccctcttcttctggcttctcagaggatgctgtcatctcgggagtttcacttttgtcctcaacaacagaagtggtgtcctgagctgctggtgtttcagcatctttctcaggaacaacttcagccacactgttatcagaagatttttcagaggatgaattttccacagggacctcgtggggtgggagtgtgtgttcctaaaaaataagatggagttcaatattgtttatcaaccatggaatatcaattacagaaggaacagcaacacacagaagatagttgggctcaagtgcgcgtctacattaatgcaagtgtcaaattgttgctacccacgggatactcagggtaacagtgttctaggcttaattttggtaatattttttcacagatatcatccaccgaaattttgaggaataattgtgcattgtccagggcctccatatcctttattacagtacttagattactttttcttttttgtgaggacagtgcctagattacaattggactatgcagcggactcatacaagattatgggttcagtctcaatatatcctaattgtaactcttccaactttgaggctacacacctaagtacgcaaatgctcaacaaaaacataaaaatagaaaatatgaattatcctttgaatgacattttgtactacctccgccccactggaaataaagtctttttggcacggaagtagtacatttagcatcatatcagctttatcataaactcctaatacatgcaaaagcatataattttataagctgaatgtttattacttaattcagacaaaataaagggggttaacttcaatcgcattgctcatgcataatttgattaaggcaatatcatacggctacacggtaagtttgtgagcacggaatgatggccaccacatctttgaagctctgtacgcgtctgtgcagcaccaaagttacacggtagacaactagtcaacgatttggacaaggcaatcgaaggggaaaaaaagagatttactgacggcgacagtagctaacgcctaacagcagtcgcaactgagccaattcagaagacggaacgagttaattcctccactcaacccaactaatgccctgtttagttacaggagtgaaaagttttgacatgtcacatcggatatacggacacacatt

SEQ ID NO: 49716 - DNA, 1501 bp, Oryza sativa
ctaaaatgcatttttagatccctgaacttgccatgtgtgttatataggtccaaacggattttaacccactcgatgcgctgacgtgacaatgccacggtgacgcctacatgtcagtggaatccacatgtcaagcatatataaaaaataaaattaaaaaccatattttctcctcttaggtagacagaaaaaaagataaaaattctaaggtagagaggagaaaatatgtttttctacttatatttttttatatgtgactgacacgtgggtccaactaacatgtatgaactatcgtggcatgtcacatcagcgcatggaaggggttggagctcgtttggacctatatgacaccccaaaacaagtttaaggacccaaaaatgcattttgagagtttagggacctagatgacacacctgcacaagtttagggaccactcgtgcacttcactcaaaatttaaattttggctaataagtataagcataagcataaacataaacgaaaagatgaggccgtaagttattttaaaactccactcatgatttgagcattgcaattgtaaaaggccgctatcgaagtaatcatattttgaaatggtatgatatcaagtggatactagatactccctccatcccaaaataagacaacctcgtactaggatagggagttgttgacgaaaaatccacacttggctgatggtgctagaactgtgttggcccaaactaagtcgacgaacacaacggcctgggagatctgcttagcttcagtgcaggttcaaatgttgatgagatgcgggcgtgccagtcagtttgatcctacaactaacaagatatacaaaaaaacagatcaatgagccgatcggctgacaagtcgatggagtaattccagctgatgctgataccagccgatagcaataggattttgagctatcgtctatatggttgatgtacaatctaacacttgatataaataaagacaacaggcttatgataatataacaaaacaacaatataatctgtaaaatcaaaatgtttttgattcttattccgtgatgaacaattggcatctaatattattagttttgatatttggagattattggtgaagtggttttgaagatgattgacttgcaggtgatgaacagggtccgctgattgaatgggtccagtcaaaccggcgtgtaccatgtggtcagaccggccagcccgcagtcaatctagctgactctgtgtctatttctgttttgggttgatttgttgggtatctatggataattcgtgtttatgacttctagatagatactatgcgtatgtaatacttttgtttgctaacaatgattcaagttggtgagaacttgtgttcggatatggttttttggttgatgcatgtgtaggtggtcttgatgcctcgagagagtgtcgccggtgatggatcgggagtcaacttgggagaagataacgcccgaacgatcaggatatcatgcgggatgcttaggctaaagatcaa

SEQ ID NO: 49717 - DNA, 624 bp, Oryza sativa
gtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtactatataaaagttgtagctctcaatgatatccacaactttataactaacaacatttctattagagatcgtttacatccctgaagatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgttataaagtgagatatattttgaaaaataaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgt

SEQ ID NO: 49718 - DNA, 1501 bp, Oryza sativa
tataggattctataggattcattcttttgatttaaaggctacagagaaaaaaaatttatgaatgaaatactctaaaattcttacgaatttcctttgaatccaaagggggcctaatttcttcaactacttttctatgtcaactgaccataaccatcctttatttaatttcacatctcttcttgatctctgtaaaagaaatttcagaactacttatatttggagacaagtatcttcacctcctcacaatgaaagaaagaaaagagaagaacatctggtcccaattgtgtcacatggggggtatcttcgtggtgccacgtgcgtgtggtgccgcacacaaatcaccccaaaaacattgcattgcctggttcgtaaaatcgatttcgacctaatttaaatcgagcatcaagtaacatggcttcctgtcataagacgacgcggaaatatgcgaactagacgtcgtcgaacgtacgatactgcagaatattcgtacgaaatcggaccaaattgttttaatttttcacgcatgtatgtatggtgtcaaaatttgaaagtgaatgcgaaacgaaaccatgtggccgagcagggagccacacaaagagccacataattggccctgggtccggaatcccccggggccattcgtgccaccaactaaccccacccagacaggtgactttcacgagccggtcgtctcgatggcaggtgggggccaacctgccgggcacgggaagcggcggggcccacctgtcagttgtggatagatgttgacaagtggcgctgtactgtacgccgtacgatatttttagctgttccaactgagccgagccgagccaagccaaaattgtactgggaacatgattattatagcaggctctgttaatgtgtttttttgacatcaaatcattattacattcatcctaaaatacaacaacctagcgccgaattatacaaaacctattagtatgaatctgattgtacatattcgtgatactaatttatgccaaatctaatacttgattactactccatccgtcccacaaaatatgtcgttttactcatttgtgattgtcccaaaaagtgatcgtttagcatttgaagcagaaaagtagacccatatggtataaggtcatcttatactgctatcaattgtttttgctctatgggactttatgccccaaacgaggttgcaggttggtggtgcagtggagaggagaggaggccggtgaaattacttatagtacctgcaagtactaaattataattacttatagtacctccaaaactaatttagcagcactttcacaggatgaccagaattttgggacgaggagtatattttgtaacggagcggctcaagctttagcagatcaggcggcaagccgagccgagccgagccaaggtcaagacctaccccaccgaccctgcgtcacgggcccacattgtcatacacgccacctaacccctaaagtatcttttccaagtcaggtcatatagatacgaa

SEQ ID NO: 49719 - DNA, 1501 bp, Oryza sativa
aaaccaccctcaaaaccgccgagggatctcatctgcactggttttgatagttgagggacccgttgtatctggtgttccggttgaaggacgaaaatcggattcgttgacaagttaagggacgtcatatgtacttattcctaaaaataacggttacactaccaattcaagatttcagtgttcgcttaaatggtcaattagttgctaaaataagtgtaaaagcttttacctatccatcgaccgttgtcttcctatagctgccatcctccacctcacacgtgaggctgtaaggcaaggactataatctcctgacccggtttactgccttcatgacaatccactatattttttttatcattgcattataaggtgtacgtacgcatcactatacacgcaacatcacatgcacacatccagtcaaaagagatgaaaatcaattataatcttactaaattcctatagtaagtttatttgaatacgcataatacttatgtccacccatgacaccatgtcaacaataatttccttcgtaaccatctgctatattagtaggtccttccatgttaatgtatttcgttcgagacatgtattgagagatggagcaatgtggaccgtttgatcgagagagaggggcaagatacaaaataattggtagtggagtaattaactagtaaaatatatgcgttttatttttattgaatacctttactacaaagtattgtttggtattgttaggtagaaatcaaagtaaatattctaataaacaatttaatgaatcgaatcgtacataaaaaaagattgatgcctcttttttttttttttgagaacctttcactttgttcttgtacttggatttatacatgttcaccgaaagaagacagagaaagaagcaatccccgtatggttaagggttgaagaggagatgagatggaccgatcaaaggttaggcgcaaccgcacaagcgcatcagagaacggagaacccagttttagatgtacatagcgctactatggagctccagatctttctggaagcagcatctgagaatcgatcgagtgcttgattacaccagcaacggggcggttgctcatggcccacatccagtacacccgagtggcgtccacatcagaggtcaccgtccacggtcaggtcggcgcacgcgcggtaaaatatcatcagttcatcttgcctgtcacatcgccacctttttacgacacaccctctcaccctcaattccgttcaaaaaggtggcagtagtactactatattataatggacgatttaaccagggaagattatgtacgataccattggaagagctaccgttttgtgaaaagtttttctttttttatttgaattaaaatgtttcttttactttgggtatgaatttgatgaaaagttatcatgtttatacaccataacactagcagattcgtgctcacaaaatgataaatacatggcagatatacaaaatatagtaaactaataatttgaggtcatgaat

SEQ ID NO: 49720 - DNA, 1501 bp, Oryza sativa
tggttcctcaagaacctgccgatcgagatgactgacgagtaccagatgagcgtccagatgaacgacatcaacaccccgtcacagggcctggaggagatcatggccatcatacaggaggcgcggaagccgggtgatggctccaaattctccgggcagatcccgggcctagggagcatggagctcgacgacgttgacaccgacgacatcgacgtcgaggacagcggcgacttcgtgtgcgcattgtgacgaggccgtgaacttgctttctcttcttggagtgtgctgctccttttgttgtgctgctgttcatttctgagagctccattctgttgttgtgtcagtgtttgtaaacgaggtgctgtggataatctgaactcttttatatgttggtgttcttagctgaattctttgcgtcctgcctgcttccctttgagctatgtgcagtttcatcagtctcacaatgcattctcaatttctcatgttttgttatcctagctttagggccaatttagtaatctctatatgcgttgcagttgataacaaagttattcattttgttcattgtactgaactctttcccccgaaaagttatcatacaaggagatgcaaactgttgtgagaagatgaaaatattggtagcctaaaagatggatcttcttggtgaacagaaacacaatcttatttttttccttaaaaaagaaaaacttttaaatgaaattgtaatataattacatcacaactataccataactattataattataaaacttatgcataagtattaaaaaatatatacaactttttacccaagttataatagatattagttacattgtacactacaactaagttgcatgtgaatgtttttgactaaaaaaatgcgatagctttttagaaattccgtaaaaaaagttaaagaaatatactaaaatggattttcagtgtgtacgcagaaaattatccttatgaggccttcattgtgagcccacaatttccagatcacccaggcctcattttcatcataggccttcacacatggatgagcacattaaggcccattcaaaccatgcctcaagtgtgggcccaaacgagactgaaaccaagagataggcccattccaagtgagaaaagccagcccattttttccctccggcccagtaagtccaatccaacggtgaaggcgatcaacggacggctcagatcgagcctcgcacccgcggcccagaccccaaccccttctctcctctaaccctatataaactccacccatcaactcacgccgctctctcgctcaaaaaccctagccctcgcgccgccgccgccgccgctcccccgcgcactcgccgctcgccgcccgcgagctcgcgccgcttcgcaaccatgaaggtaagacgctcctcgtcgccgttgctggatcccccagatgagctagggattttatggtagggttagatttttttttcgtgggtggcttctgattcgtgtggtttccgccttcgtt

SEQ ID NO: 49721 - DNA, 170 bp, Oryza sativa
attaaactttgaaaattaataactcccaaatgcaaagtgataaaatataaattccttcaccacaaatcttacccacacagcacctaatcacactagtaaactcatgcattttagagcattttgaattattgcatgttttggtatttatcgttacttttatttcttttaga

SEQ ID NO: 49722 - DNA, 1501 bp, Oryza sativa
tgagatatgacttaattctatttaacattatttctatacataataaataaggtgcccgcgtatctgcgcgggcttcctttctagttcactatagaaacagcagaaaacagtgaaaaccactattcacaactactgttcaccaaactactgtggtgatcgatctcgtccgttcgctgtgaataggctaaaaatactctgaaagtcaccgcactgtagctctctggctttacacacatgtaaagtcagaggatccaaatcccaggggtgggggtttgggttgctagtactacagtcctgctatacaggggcgtagacagggggtggtcctggtgggctcgggactaccctgattttggcccaggatatccccacccccaaaagcccacaaaccttggttcttattcaagcccagaaaaacaagctcacaaaccttggttcccattcaagcccagaaaaacaagcccacaagagagaaggaaaaaagcgctaggtttggccttctgggagtcaaggcatctgacgaccacgacgccgtctctactcgtcctcgtcgcctctgctacgcgcttgcgccgccgcttcctcgccaccgccgctgccgccgccacttccctagctcgatctacggaggccgaatggcgaagcgctagaggcaccagtccccacgccgcgctgcctgggtgcaggctgcttacgccgctcgccggggctcctcacatggcgccgccaccggccgccggtgccaggagctgggagcccaggaccctggcggcctagccctaattgatccttgcctcgatgttttccctccgtctaccccttggaatcccgtgcttaggtgagtaaatcattgtattgtgatttgtgaatcagtgaatatgtgaatgtgatttttgatttgtgaatcatcggatgtgaatgtgttgctatttggtactattgtagtatgtaggatttgtaaacatgtggttgatatggaattgctcttttgtatgttagccttaatctagtgatgaccaagaggagaaacaatatatgatttattgaatcattgatttgtcacatatatcaagtgagatatcttttatgaattaagttagtaaagaagacataatactaaaaactttgatggctaagatattggcattgtgattttctatttgtgcccaagatcttttatatttgcaatatttatgttgtaatatttgcacgtgtgagcttgcttgttaagttagtcaaatattgacaatataagacaatattgttacatttctattactttttcattaaatttgtactcgtatataggatttacgacgtttgaaaatttagctatgtgatgtgtatttgtgagtaggactacacagcgaaaaattcctggctacgccactgctgctctatatatcaagccgaagccgaagccgccttgacctgcaaaggcagagcagagcagcgcaggcgagcaggttgcggagaagtggaagccatcagctgcctagtg

SEQ ID NO: 49723 - DNA, 1501 bp, Oryza sativa
gtcctgagtgagtagaaaaccaccaaaaatattaccgatgcaatgcaacggacgagggtgctctgacgcactcgagcccgtgcgtcgctgcacgaaaacggctagcaattcagggggtgtttagatggggctaaaactttttagcccatgtcacatcgaatgtttggacgctaatttggagtattaaacatagactagtaaaaaaactaattttataaatgagagctaatccgcgagacgaattttttaagcctaattaatccataattatagtttactgtagcattacattgttaaaatcatgacgtaattagactcaaaagattcgtctcgcgaattagtccaaggttatagaatgggttttgtaattaatatatgtttaatactctaaattagtgtctaaacatccgatgtaacagggagttgaaataagtcctggaaaccaaacaggcactcaggatggccgggggttcgcgttcggccgttctattcatttaacaagggcagatgtgctgggcctattttacgagtcgctttgttgtgcgtcacgttgaaaaaaaaaatttggggtgaggctcgaactctcgacctcaggatcactcacgtatagctatgagacttacgcgctagccaactgcgaaaccaccccgttgtgctgtgtgttacatccaatcttcaaatctggtacaaacattgatctctccaccgccattactttccccatctcagaatatgatactattgattttacggcttatcttactaacaaaggtcgagtttagttccgcagccaattatttttttaagtatatagacacacatttaatgtattaaacataaactaataataaaataaattatagatttcgcatgtaaactgcgggacgaatttattaagcctaattaatctatcattagcaaatatttaatgtagcactacattaggctaaaaatattcgtctcgcaatgtacatacaaactgtgcaattgtttttttattcatatttaatgttttatatatgtgtttaaatatttaacgtgactgatttttttggaagtttaaagggaactcaaacacagccaaacaccacatatgttgcccatgagtacaagtacaagtcgagcctcaccaaattaggcaactactgcccagacgcagcgcatcccgtgaaaccaaaacggtaaatgtcccatttatttttctgatggatcgatccgtgggagcgcaccgcctcaccgtaaaaaggcgaattttttttatttataattttttttattaaaagttttacaaaaataattttccattttgaaaattgacggaaggagtcgcctaccgccctctggaaaaatcgccctctcagagggcggcgaaaatgacgtggcagacagccgttcgctctcgggcgacggccgtcaacgaaatttgcaggcggcccccttgccgccctccgctagggcgattttatactgtgcggggggccgcctgcaaattggcggcgag

SEQ ID NO: 49724 - DNA, 1501 bp, Oryza sativa
gaggcaggctagagattatggttctaagcacgacttagtagatcaaacacaatatctagacaatcaagccgttgactgattttcagggtggtagatgcctaggctaatctaatctagcaatgcgatttagccgataccggcagaaaccctaaagcgagagacagctgatagagctaaattgatatgctaagactagattaacagagacatgataaataggtaggcaaatatatcatccaaaccagagcaatccaagaggtcgaatgtactgatgcagccttgaacgacgccgacgtaaacgatacaattgcctgggccgacggaacattggacttaccccttcgtcagagatcgaacaccgatgcagccccgcgtcaggtgccaaatcctaccggacgataaaataaagtagaaaaggtaaaaggtggcgatgcgccgaattgtattgatcgtgaggatagattacaatgacccagggtgtacatatttatacccatgggttgatacaagtctttgtcggacaagaaagaaaccttcctaaagataaaaggaacagataaagtccttataggacactaaacacatttttctaaagataaaaggaaactaacaaactatttctatttaatagataacttgccatgccgcattctttttaaactcggtcacttatggataagcttccgttagtagattgatttccttagccgaatatagcaggaatttgactattggcgacttgataactcccatcggctgatcccgagatgctgcagccgataatgactctaagccgatgacgtctttgctgattaccaaatttcactgttaacagacttacattgtgaaacggaggaagtactaagatattgacctggagtcctggaaaccatatacctcgaaaaaatattgacctgaaaaccatagatctcgaaaaaaaaatgcaagctcttttcttgaatagttgtgcaaaaaatagtttgtgcttcgataaattggtaacctgtgaatggccaaacaacgcatacccaccacacactagatatgtgcttccacctcctagcgaaatgcatggttggccaaacaacacataccgcgtgctttatcaccacacactagatatgtcctttaacttattagtgaaatatagatacacgagaaaaactgagatatcttatctaattagacgacctacgaacatctcaaatcgtcgaaatggagtgtaaccacaatggtttatgaatgatggacagcactagcaatcggtaagggacaaacgaaaaaaaaggagtctgcaccctcttcctcctcacgacatggaaagcttgaaagtagagatggatcttggaaagtattttctacatatggatgctatcatatctaggagtatgcatgtggtttaaatagttactacctcattccctaaatgtttgacgccgttgacttttttaaacatgtttgatcgttcgtcttattcaagaacttttgtgaaatatgtaaa

SEQ ID NO: 49725 - DNA, 244 bp, Oryza sativa
tgctattgttgcagcaaactgaaatatgtcgctaatgttgcagtaaactgatagttttatcactaaacttgcagttttctaaaatttactcttataataattaaactcaattaataatatgctaatacttttttatttttgcgtgtcgtaatctaatcttcatgttcttcagattagcaccgcaacgtttagtaatgttgttcccgccaagtttcgattagagctcagcacggcacatcgccgg

SEQ ID NO: 49726 - DNA, 1501 bp, Oryza sativa
cttgccatacggtcatcgcaatcgcaagtggtggcgtaaatgcgtaatacgttggaaaaagtacatcgaaggtccctcaacttgtcatcgagttacaaaatcgtcctccaaccacaaaaccagatatgatacatctgtcgtcccttaactaatcaaaactggttacaataagtccttaagtggttttgacaccggttttgtcctacgtggcaactaagtcaacgtgggacccacgtggaccacgcatatcaggatgccacgtcatctctcttacccctcctctctctctcgctcttctcttctatgggcaagccggctggcggttggggaggaggccactggggcgaggcgggagaggaggaggcggcgtggctagctcgtgccgcatcccgtccttaaagttcccgtcgctgtgggaatcgaagaggcagcgcggtggtgtcagaagttgcgcggtggagcggaaggcggcgttgatcgcgttgggagccgtgatggcgtcggagagggagcgcggcggcggcggggtggtgttgttgccggaggaggcgaggaggggcgccaacctgccgctgccgcatcctaacatgtggggtccatgtgggtcccacgctgactcagccgtcacgtagtacaaaaccggtgtcaaaaccaccaaaggatctattgtgaccggttttgattagttaagggacgccagatatctggttttgcgtggggggggggtgattttgtaacttgatgacaagttgagggaccttcagtatactttttcctaatatgttgggctcacgaatctttaaaggcccatgacttgtgggccttagtgggcttggcctaaaaatgcggcaacgcgtcttcctcgatgccagccgtctctgctcccggcggtcttttttttttttttaaaaccacttccatcggctgtttgtaatcagacatcagctgaccgcagacgccgccggccgccggccgccggcgaagtagaagccatttacagcgctggaagtggtaaaaatagcagataatttacgctttgtgcgtcaagaggagtaatgtattattgtatttctttccaacgaactgtctggtttttacttgttagtagagagtaacatccatttgcaaattactgcacttgttttttctaaacaaaagttataatactacgtatcttctctatctctactatattataaaaataaaaaatatttttgtcagtattttggtacgttatccgtatttgaatcggtttttagatttgttctttttggaaatacaaatccgtgtttgaatcggattttaagtttgattgcttaggagtcatataataaatctttttttttaaaaaaactcacatgctaatttaggatgaaagtcggactcctaattatagctcatgattttcttaaaaaaatatccaagcgaattccaatggtgaatttcaccctacctataccgtataacaataatataattaaaataatatttttctagtgtg

SEQ ID NO: 49727 - DNA, 1501 bp, Oryza sativa; identical to SEQ ID NO: 43006

SEQ ID NO: 49728 - DNA, 464 bp, Oryza sativa
ccgcctccctgaaacgcacgggaatttcagctggaattcatacgggagaggggggcaaggaagaaaataccccagtagaagggaatagcaaaaccccacctggacgacgcccacacggctccctgcgctaggtcggaggcgccccccgccgccgccgccgcccccgcctcgggagggtagtcagggtgcacgccgaccgacgaggaggccctgcctgcctccgcgccaccggaggaccacccgagcgagagccagccgccgcaggcgtccacggcggcggcgaggtcggccctccccgcggcgacgagctcggcgcgggtggggaacgcccccggcttgtcggaccgccgcatgaactcgtagatcgcctcctcgaggtcctcctccccgcgggccgcattggacgccgacaacgtcctcctcggcgcccgcgtctgcgtcggcgccgcgcgctggcgacggta

SEQ ID NO: 49729 - DNA, 1019 bp, Oryza sativa
gtcccccctgcacccacgttggatccgcccctgcgggcccttcccatccgctggtcctcccctccagtaaaggtaaagacgatttctcctgtggtctcggatactgtaacgaattgcagagtgtagattttgatgctatcaattttttttcatcagtttgattaatgaaccgttttcctgggtgaccaatgttgattgtgctattgacacttttctgctaatgtactgagacatatcttctaatcctccattaccagtttcaaatacaatgtattcagcaaagggtatgaggagatcagattatttatgtcactggttgaggagaaatatttcagattcaggacagttagccgcttgaaaccttcaaacttctgaggcaagctgacaatgcatctttttaagtgcagataatccaaatcactgatagagaagaggctcgatggaagcttataattattcccattgtaaaacttaattctaatagaccttgatttttttcttgacagcatgtacatgcacctatcaaatacatcatgatatgttctgcaacatgccattgaaaacaaagctagaggtccattatggaacagcaatgccagatcaacgagagttataaatttggatcatgttctttcagaggaatcccaattgtgatacaaatcagacagaagtatttcgggcgggacctgtgctttggaagagcgtgtgtggagctgattagtatattgggtatttagatgttctaattctttgactcttttggttcgatctcccttggttataacgaaacattctttttttacttttggcataaaaagctaatttgtgcaaaaattgaaggatacaacattatgactactcccaaggatgtggttaatgttgaaaaggttgattttattggttattcatgagaacatgaaagatttatattttatttatgtagcctaaaaaggtaaatctgaatttctgatttaatgtggtactgcaatccaccatttgatttctatagctagccacgc

SEQ ID NO: 49730 - DNA, 927 bp, Oryza sativa
tatataatctcaccgttaattttcacttaagttggtggacccgatattttagatcgttagattagatgtattattttaagaaggtaataatttcctctcataatgtgggcccaaaaaagaaaccaaacataagtatacttggtgtacgtacttacgtgctggaaaagaatcaatgaatcttaaagaaaacctatgtacgaactgacgataaaatcaataaagtaaaaaaacttacgtaacataggtagtatgtagtgccataaaaaaatcgatggtccataatatatgattttctactatttaaaaacaaaagtataatactctataaaattaagttaaactagatcttctacaatataaaaaaatatcctatctttaaattattttaaaattatatatctaatttgtgatccagtcagattcctttaattaaataaactattgatgtctatgttcctaaatacatcataacacatgaggctgacatataataaataatgttatgataatattttcaaggaaaaatgacgaattaccctcctaaactattatggtagaccgaattacccccataaatctgaaagctagacatctttcaccctcaactattaataccgaacgaattaccccgctgacacagcctgaagtggttttgatcctacgtggcagtcccgtcagcattttcttaaaaataaattgatgggacccacctatcatatctctgcctcacccctccccctttctctttcttctccctccatgtctatcaataggcaaggctaagggcagtgagcgggtcctctcggtctctgctggcgcgcgcctccttgatggccgtgtggcttctcctcaacatccactggcgcgtgaagaggacaaccgcggtggaggcgaacgagggcagtgagtagcagaggcggctcctcc

SEQ ID NO: 49731 - DNA, 1022 bp, Oryza sativa
attattcataatcacatgagacacctttactaattaatttagagaataaatctattttcccaaacttatttacaataactaatttattgaagtatactttatagttacgtcaatagtgtgtataatatacatccatcaaattgatacttgatgtgttggaattcctcaactataaaaaaattatatcatgagtagtttattgtgcatgttacttgattgttcatttgttgccaaaactatttagaaaagagaaaaacatagatatatgaccataaatctcatggtggattaaatggttgtattatagcaagatcattggtatgaaatatttttttcataatttctttacatctatgcaacatttatgttgcccacttattagatactaatgaaatagttctaaagattccaaaaaaaaattgagaatcttagtctcaaacaaattaaaattaaatgaaatatacttaaaaatacacaactaaattgtgttgttttcatttattttacatatatggatttaaattaccattgtatagtcgtcaagtgatatttgacacatgaaatatgatgtgaaattatttaaaataggaaaaagcaataattaccccctaaacctgaaaaccagacatctttcaccctcaactattaatatcggatgaattaccctaaccaacccggagtgggtttgttcctacgtgacagtccagttagcacttttttttaaaaaaaaaaataggtggggcttacctgtcacactctctaccctctatatatctctctctcctctctctctcttccacaatcccattacctagcctctctctcttctccttctccttgctacaggggccaaccgggtaggcgagccgccgccccgccacacttttccttcctccttcatctattcccctgcacttgctctcttaattgatccaccttgttgttcttttattgattggtgctttctgtctcgtcaggagaaaggcattggtggtggggatcgattaagaaccatggtggga

SEQ ID NO: 49732 - DNA, 275 bp, Oryza sativa
cccccccccccccccccccccccggtgatgaaatgaaactttcaaaggggtgtgattgaaatccatggagctaaagcatgtacagatactcctaatctcctagtatgtgatgtctggtctcaccggtgatctccattgcatgatgatgagtcatctgataggttggttttgcattttggaaacttggaaccccagcagtagcactactagtagtaccaaccaaccaaactactaatatgactagacaacaataatggtgtcacttcctgtttagc

SEQ ID NO: 49733 - DNA, 494 bp, Oryza sativa
tcattgggtgcaaggtacttgtgttttgtctggatcatcgtcatatcagcaacaaagtctgccgaccaagaggactaggttagttgtggtttgcgacttgaatatttacggagcactgctgctgaattatgtgtgttttggcgtttgctatgtaggagtacaagattatgggctataagcaaatcaaagatatgggaaagaaaagcaagtggtattagtacaatttttcggaggagattaggagtgaaaaaccactccacatacgtgaataatgcatggcttttgtaatgctttatggtcttacagaatatattatatagtagttaatgacttttagatactttagtttgattctgtgcctctatcagaaacaatttgactggtttttctatctgtaagttgtggcgtaattatcattcacctcatgctgaagtatatatcagtcttctatgtgtcattctgattctgatctattaagtagtcaaaacaaatta

SEQ ID NO: 49734 - DNA, 852 bp, Oryza sativa
tccccttcttctcttactactacaccatataaatttgaattaaaattcaaatttttaatgtgtacgtaaactttttacttataaactttgggtctataaactaatatttgaattcaaattcaaattcaaattcaaatttgaaacgggtatgtaaacttttgacctataaactttgggtctataaactaatatttgaatttaaattcaaatttgaatcgggtatgtaaacttttgatttataaactttgggtctataaactttaggtgtataaactttagatgtatagaaatactatatatagaaaatatttaattcaaattcaaatttgaacggatataattcaaattcaaatttgaatcaggtatgtaaatttttgacttataaactttgggtctataaactttaggtgtataaactttagatgcataaaaatactatatatatattttaatatttgaattcaaattcaaatttgaatcccgatataattcaaattcaaatttgaatcgggcatgtaaacttttcacttataaacattgggtctataaacttcaggtctataaactttagatgtatagaaatcctatatataaaaaaatatttgaattcaaatttgaatttgaatcggatatataaacttttgacttataaacttttggtctctaaactttagatgtgtaaacctgaggtgtataaactttaggttcataaatttactaaaataggaaagtaatacggtgccaaaaaaggaaaccaggtggagggagggagggggaagggggatcgatcgctacccttgtcgccgggcgatcgatcgcccattagcacttccgccgtcaacaatgccaaca

SEQ ID NO: 49735 - DNA, 981 bp, Oryza sativa
agccctatgccatcctttgttatcctgtgcacttgcatatttgctgtgtggcttgttgagtatgtcatatgctcattcttgcaatattcattcatcagaagaggagtacttgagtgaaggtgatggtctggaggattaggcttgtcctggttaagttgcctgtggagtggagttgccatagctgttccgtagattgttttagtttaatttttctgctgcgtagaatgtttttttttgagaggaactatctacctctgtaataatttattatttgcgattgttaaatagttatttaattgtactctattatcaatattgtcattgtgtgcctcggttgattcctggacgagggtttaacacacatgtaagcgtttggaattttggatagaaattccgggcgtgacaaatattgttatttaacttttaatcgggtaatatctatcattggaaggcagccgattaggctaaataccaacgttgacctagattatataggatatccaccaccctatgaaacattcaacggcttgattgtctagatattatccttcttttcatacttatagctgcattagttgagtttgaccttataagtcgtgattagaatctcaatctctagcctactttttggttgccgattagggtagtatcggagtttcagccgatcttacctgatttaactcttttatatcttatgtgcttgattgacatgttaaatccgctctttatgttaagatcttgtcacaattaggtatattaagcttcctgtttgatatattttgcttgctttaatatcttaatatagaatagtataggagtattagccgatgcatgctggatctatttgatcggctatgccataaacgtctataatcttcttgttaatatatatatcgatgtaagtgatttatactgtctcgatcacttgatttaagtatatatcgacggaagtattatataccattgatattgatgtgacca

SEQ ID NO: 49736 - DNA, 895 bp, Oryza sativa
aagcatggtagaataaacccccgtccgatcattcaccagaatgctctccatgcatctcccttccagataattcaaggcacaatttgcttggttttgtcgctgcattatattattgccatctctggattgagaagtgatgtgttgaagtgcagttgtttgaatttaagtttcagactaagcgcgcaggggtattgatagggatgggtattgcccagccataccgaccagttcaatcaaaaagcttaagctaataagaaaatgtgccgagtagtagtgctattgttttttttctactatttgttagggaattataattttgcaagaatgcttagctgttcatcataacactgccgaattaaggtagatggtcgaatctccacgagtaagaaataaaacctaggcttagaaacagctggagctaaaaggatatcttcttctttcttttttaacttgtggatagtattagcgttgtcgccgtaggagtataattttgagaagacagtgacttgtgagctaactggagccgatggtgagacgcctgaagaaacctgtgtgatgctgggaatagaaaatggtatttggcaggccagcagctagcagaggcattgctggtaatggaatgatgaggcaatgaagttgtttgattaaccaactaataaaggtcaccgtaggattaacaaaatctcatgctagtatcagcccccagccagccacaagatattgtgactgtagtaggttaccttttcctattagcccccagcacagaaacaaactcaactgacaaaaatgaaaatgtgaaattaggagtagcaagaacaaattctccacttctaactgttgtatgcatctgatctgatgatctgaacccaccagagctgttattacaatgacagta

SEQ ID NO: 49737 - DNA, 180 bp, Oryza sativa
ccgcccattaggagtaccctgttgacggtccttaaatcataatatttgaccgtcaatgcctacatataatggaataaaacatggtatccaacttagtggtaggtattattactaatcatttccactagtgttggtgaaatatgtgtatgcaggtattttgaggagaaaacacatccgtca

SEQ ID NO: 49738 - DNA, 506 bp, Oryza sativa
  unsure (1)..(506): unsure at all n locations
atgtctgctgaatactagtatatgtaaatcatagccaatactacgtatctgttcatctctacatctcaaacacatggcgtgttcttcaaacttcacaagaaatgnagaatggatgatacagaacttgattttactcatacatatttgcactgtcgaattcgatctaattgactcgaccgatggccatggagatgtatgcacatcctaaataatttcataattanctctctctctctctctcattgattgattgattttttttaggaccgactatttgccattgcacataaatcatcttaaaaatttcgtgaattctaaaccattatattgctttgagattcttacggtacctcctaacccctcctgactcctagcttgatgcccctactaccactaccgtaagtgttgcccaaccttgccagcgaggctaaggcaataacatcagtgagaggcccctagctgacctcctccccctccgctctctcgccctcttcctctcctcaagt

SEQ ID NO: 49739 - DNA, 1501 bp, Oryza sativa
tcatgtgacccagcttaagttaagtaaattattttaccgtgaacctagtttaagtaaactagataggtaccccgcgcgttgctacgggagaattgtgtgataaaatagttagatatgagttgtagaaaaaatatcttatttactatatgattttgttttatgtgcttgtatattttgtacctcgatcaattattcaaaagttataaatggttgagttatatgttgtggcttttaggaagaagagatgcaatttgcacccttgatgaatcatccaagggctaaaaacaattgaggtgacgtggcttcacgagagaagagagaattagcattaactacatttagtggggatgagctttatagatatataggattacccatgcaaatatgttccttgcatctcggaccctggtagcatcacccctagttgtaagtattctaaatttccaatggcacaaatcaggataagatgcagcaaacgtttatgtatgagccaatgtttgacatggtttatatttatttggatatagatagagcaaaaaaggcaaagaaaaataatgagtatatgcgtatgggattgggctgcaacatgcgcgtgcaccacgtaacgttaagatgccaagcgccgtcctcatttgatcgtacaaaaacatcatatacgtagcattttccatttcataacagtctcattcattaatagggattcccatgtgtttcaagataaccccttccatccttattaccagctcgttagcaatagtttgaacgaacttcttaggtcttaccagatttcaaactttgtcaatgtaaaatatttcaattaacgagaagaatcataatcaaatatataaatctagttggagtatgaaaaatgtattgtccaaataagaaaacatagtaagaaactctaaaactataatagaaaaaaaaacggttagggtgtatgcctacacccaccagaatatatgttatgctgcccgcgtatgcggatatgttctcaatagaaatttagcattattagagatttgtcgttgtatacgttgattgcgtgtataagtaatatatgtatgtcttcctatatatattagtaataacatttctgtataatgtaatgaaccaggttcatataattagagatagacgagaaggatgattaagaataaaacattcggcctcgtggctatgtacgctgagtgtacgaacgtgttgtgggaggaggggatggaatgatgatgactctgtttttagcagtagagataagaaaaatccaaatgacaaacaaaataaatgtggaaggatctaaacgccgttagttgtccatcaacattgacagctgaaaatgccttccaaatttcattacaaaccatgatgaagccatcttcttctttccctgattcactcataaaccctctataaatggttcctatcacaaccacaaacaccacagctcaaaacacttccaacttcctgagcatttctccatttgtctcttccaaggcaacaa

SEQ ID NO: 49740 - DNA, 732 bp, Oryza sativa
aggcacatggtgacatgatgtggggttgtgtcttgtgggtacagtggtacacctctgatcagagtaaactattcgaatagccgtgcccgcggttatggcggggtctacaaatgtctttcgtgattagtctcacacctctcatcattgtaaaagatgcttaaactgataataatttgattagctcctggtttggaatggtacattcctggtttgaagatagaactgtgcagccggggtggttgttcagaatggttgggcctatacaacagggtatgttgtatagcgttggcttaatattgtgtaattacttaactgttttgttaaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggataga

SEQ ID NO: 49741 - DNA, 833 bp, Oryza sativa
agtgcacccggtccaccgtggaccgtgaggctgccgcgtgggccccactcccgtggacccggtccgcgcgccccctcccctcggctgacgcaataaacccttttaaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgttcgtgcttgttatatggagtttattagagtaaaagccttttcttttccgttggtcgtgtagacgctgcagcttcagaagatccgctcttcgttgaagttgaagccgacgtttgggaaagcgagcaaggcaagtcacatcatccttaaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattaggtggttttacaactctagactttgggatattcatatcacctggacactatggaatggtttgattattgtggaaattggattcacacctccccctctattcaaaatcctcaaaatggttttaggctgggctcggggtgcatggttttgatagtagcacctcggccatataaggaccggt

SEQ ID NO: 49742 - DNA, 1501 bp, Oryza sativa
cgtctaacaagagtttgatcaagttgattaagagaaagatttctgattatcctcggcaatggcatactaggttggctgaagcattgtggtcttatcggatggcttgccacggattgatttgaggcagttttaccatgggaacagatttgcagaatgagttgtcagctaatgaatattataatctcatggccgatgagaaggaagatttggttcaatccagattgagagctcttgcaaaagctaccaaggataaggaaagggttgctcaacattataacaagaaggtggtgcctaagtctttttctgagggagagcttgtttggaagctaattttgccgataggaactcagataacaaattcggcatgtggtgtcacgcccggaatttctatccaaaattccaaacgcttacatgtgcgttaaatcctcatccaggaatcagccgaggcacacaataacaaattgataatagaatactatcaaacagctaattaatattcgcaaaataataaattattatagaggtggatagttcctctcaaaagaataaaattctacgcagcggaaataaacataagactaaacagctatggcgactccactccacaagcaacttgacccgaacaaagcctaaccctcctgatcatcaccttcactaaagtactcctcctctaatgaatgaatattgcaagaatgagcatatgacatactcaataagccacacaacaaatatgcaagtgcacaggataacaaagcatggcataatacagctcaattgcataaacaacatttaataaacatttgagagaacagtaaaacagttgagtaattaagcaatattaaatgaacactatacaacacacccgtgttgcataggcccaacctcacctgaacaaccaaccccggttgtacaaatcaaacctccataccaggaatataccattccaaaccaggagtcaatttagttatcacaaactatcaccaataatgagtagtgtgagactaatgacgaaaaacattgttaaactcacccataaccgcgggcacggctattcgaatagttttactctggccagaggtgtaccactatacccacaagacatagctccacaacatgtcaccatgcgcctcaataccaccatgatatctcggataggaactgtgacagtaccccttacacaacacaatccaccacagcgcaccgttcctggatcataatcaccccctcaataaccagaggcatggactccccagcgacccccacggacttctcgccgcttctcagtctggcaccccgtaatgaactattctatacaaaaggtaaagctgttacccatgctggcttgtggttgtcacggttaatgtttcacaacagtagctcgcgaactggtccttaattgtcatgagcacgaccatcaaaaccatatgctcacaacccacctttaataaggttttaattatcaattaattatcataacatgattaaccatcgtgagctacca

SEQ ID NO: 49743 - DNA, 315 bp, Oryza sativa
cagtgacataaataatctgatctcctcataccctttgctgaatacattgtatttgaaactggtaatggaggattagaagatatgtctcagtacattagcagaaaagtgtcaatagcacaatcaacattggtcacccaggaaaacggttcattaatcaaactgatgaaaaaaaattgatagcatcaaaatctacactctgcaattcgttacagtatccgagaccacaggagaaatcgtctttacctttactggaggggaggaccagcggatgggaagggcccgcaggggcggatccaacgtgggtgcaggggggac

SEQ ID NO: 49744 - DNA, 1501 bp, Oryza sativa
atcctacccagttagtattctttacaagtcaattgatgttcctgcaaggtttcatggccttcagcttcacaatttcttttattcgttacaaaagtatcacatttatttgtaatcaatagtttggatggtactatctaaaacaactgatttggagatgaattgttgacctgttaggatccttaaaggttcccttcgattttggtaagatagagttgtattgttttctttaattagtgtgtgaattaggtgttctagttgtgtgcctataaaacattcattattctgattcttctatttggcataacaaaaactgaaatggtgatatgttgcatgtcttattacttcctttttcagggctatgcattgttgtgtgttggttttccaacttctgatgttgaagttgaaacacaagatgaagatgaggcaagcattaagccaccttgttaatagtagtaactgtcttatctaaccatacagaaggaactagactgtattcttctgaattcttatgataagtcctacatgttccactaagcacataacacctcaatgtataggtctactggctccagtttggaagatatttcgcacgaggacctgttgtaagtattattaaatttgtatttcacaactcatagtttttatgcctaggaactcccgtgtagacaatttatagcataagcgcataactgttgatgttggctgtggttgtcaacaccactgttattccaattccactttaaacatgaaattatatcttctagcttttctcagacatagtggactgctcttttttttcaggaaagggatgattatgcactggagcttgcaatgggtgatgagtgagccgtgtctaaagaggtgacaccaccagaaatttcaatctctacattgtttaatctgttcatttttccccttatattctcatctaactctcagttctcgtccttcacagtggtgtttgcagtcgggagctcatgttgtcttaaggactttctttgaaagtggagaaaggggctttttcctcagctcacaattttccatcttcagtgctgttactctgttagcgattgtttggcatgtaaaaaagtgtgctttcttgtaaaaataccattttctagttcgcacctgacagacgaagaacaccatggattacatgtaaagttgtaaactgaacacctaatcttgagtgcgaataatgaataatgatcaccggagttatgagtttgggaatgatatgctgccatgaaaaccttgaattgagtgaatttgaatcttaaatttatattcaaagcaaatgtagtttcaaatacttccgttctatacaaccagtttgaaaatgagcttctagagttcgttgtagctgagaatttgtagtaaactagagtactgatgcagggcaagttggttttatgttcatgttgcctcaggttacaccgttgtccaattctgcgtggaaccaacctgagaatgctcaattctctgaaactggagtagccga

SEQ ID NO: 49745 - DNA, 1501 bp, Oryza sativa
aagaaccgtatccaatcaagggcaagtactcacagttcacattgttgactatgacctacgatgcccggctttggaatctgaagatgtttgtggagcattattccaattgtgcatcggtgagggatattgtagtggtctggaacaaagggcagcccccagctcaaggtgaattgaagtcagtcgttcctgttaggatcagagttgaggataggaactctctgaacaacagattcaacatagacagtgaaattaagacaaaagctgttatggagcttgatgatgatattatgatgacatgcgatgacttagagcgtgggttcaaggtgtggagggagcaccctgacaggatcattgggtactatccacgcctttctgaaggcagcccactggaataccgcaatgagaggtatgctcggcaacaaggaggttataacatggtactcacaggcgcagcatttatggaccatggtttggccttcaagaaatattggagcaaggaagctgaggtaggaagacagattgtagacagtttcttcaattgtgaggatatccttctaaatttcttgtttgcaaatgcaagcttgacaagcacagtggagtatgtaaagccagcttgggcaattgatatgtccaagttctcaggagttgccatcagccgaaacacacaagcacactatcatgttaggagcaaatgcctggctaaattttcagaaatatatggaaatttaactgctaagaggttctttaacagccgaggtgatggctgggatgtatagtgacacatattagtggatagctttattcctgagactcaaatagactgattagccaagtatataaggtggggaagcagggggaggactagtgcaggaggaattatgtaattaagttattcagcaatgtatcctgttgtggttctactccctccgttccataatataagggattttgagtttttgcttgaactgtttgaccactcgtcttattcaaaaaaatttggaattattatttatttttttgtgacttactttactatccaaagtactttaagcacaacttttcgttttttatatttgcacaaatttttgaataagactatccaaagtactttaagcacaactttttcgttttttatatttgcacaaatttttgaataagacgagtggtcaaacaatacaaacaaaaactcaaaatcccttatattatgggacggagggagtattagtttagcgtgcccctgctgtaggttttccatagatggtttttggtgttcctgcgcttccacttatatttcataattttaattccttttgaattctagttgcctcacatgtgcaatctgtaattattgcaactgtacatgcaattgcaatcgtgccccaggagccaggataaatagttcaatctccctcagattaacagaggtgaacttccttcctcccttttttctttttgtgcaaaattgtatattacatgaagaaagcaattatgaatcacaaaa

SEQ ID NO: 49746 - DNA, 1501 bp, Oryza sativa
tgtgacatatgaaatttcaggtgtaaaacaccatctttacgggtaaattttacatgttcgataaataatagacattacttaaagtttgtagagacatcttagtaaaataatatacacatcttttacgtattaggtttaaaacattatcattgtggataaaacctacatgttccataaaatagtagacaacacttaaaatttgtactaacatcttcttaatacaacaatgggcacatcttttacaaattacaaaaagtattaataacaaatcgtataagtccattcttagcaaaaagtttcatttcacggttaccaatattgttatgtcgtcaaaagagttttgaatcgataaatgaaataaaaccttcagtgtacaatttcattttgtggctttttaggttagtcataacatttaataataatgcatgggattgaatgcagttggatgaaatggaatactcgagctcctcaatgccagtttcaaatagttttatagtcttagaaacagtgtacatccagttccatatatatgaaactcttttaatctctcttcataatgatattgccatgtcatcaaatttgtttgaatggcatctcatttattgagaaaaaactctataaaactaccactagaaattttttgttacattaaccaccattgaaattggcctaagagcaatttcaatagaagagtaagccgtcagctctaaaacctatcaaacacatagagtgctgctccaccaaacagatatcatgtacaacaaaagtctacaagcttgccatcacgcaattaccaaagtcttttttttaatgttatgcctataactgttatttttttcttcacactttgctaattttgtagactccataattatatgggacagtaaggaacaatccgttgttactattatcgcctcaacatggaagtgtagtaggcaactattaatcaccgattcacactctctcccccttatttctctgccaagtgccaactcagcatattagtctgcatgcatgtagtatgatcgattaaaacgatctgctgtacctgctaaacttgtgacattcaaaccgatcgcaaaatattttgatctcgcaaatattgatgtacgtacactagtaaaacaactacaaatccaactgtagtctgtagttatcccggtagatgtccccgtcccgtgtgcgaccaattcgccgttcgttgggaggcgcgcgcgccgctcgccttcgctaacgccgcgcgtcacgtagacacgtactactagccgaacggagccgcggaacgaaggggaagtcagtgagggcgaagcacacgtggcgctctccatctctaaccgccgccaatggcgtcgtccccgcggccggcggcgacggcggcggcgcaccgccgggggctgatccagcgcccgccctccgcgcaggcctacctctccgccgcggcggcgctcctcgtcctcgccgccgtcgccttctcccgcgccggccaccgcttcccgcaccc

SEQ ID NO: 49747 - DNA, 1501 bp, Oryza sativa
ctgctaagatccatgctctggcctcctctttgattttcgtcagcaagctattcgacaagagctccttttgctggaaggttctacggtttctttcattccaaatctctcccagacgaccagcagcgtcaacgaacggagggccttcttgggggcttctttggtgcttgtgattaacatatgcaaaatttaagatggaaggagcagatactcgtgcagtacaaggaatatacaaacccataatttgtgaggagacaagaacaatcaatatcaaatattgaaatttaactagccaagttaataaggctataaaatgctcagattcttttctttcttaccggttggggatgttgtcagaacctgtggtaaatagaccatctctagcacttgccagcattgcggccaatgatgatcttcacaccaaaatataatcagatttcgcttggattcatgccgcccgtgtaacctgtcaccactgaccacatgaacagcatgtgaaagcaactggtaccatctgctgtggccagatagcgatgagcaagaagctgccaaggagcagcaacggatccatgcctctcccctgtgatccaaccagcatatgacctggatcaaaaacggaagaaaacatgggaagcatatgcacttgtcagtacagtagtatttgtttactatatacttgttcttattccaggcatcaacatctgcgactctccacggcgctgaagagctaagccgccttctcttcccctcacgtccacccaagaggccatccatctctctctctctctctcttgaccctatctcctcttcgccgctttatcctgcccatttaaatacccatactgtgcttcttggggagagagaaggggagagagagagagagagagaatggcattgcagcaacgaccggggatgctcggcattggctgcagcaacgtcttggcacgagcaagggtgcagcaatgtctagcagcggcgtcccactccaatatgccatgtctacccgtcctcctgcatgtcaatggcagcaagaagcagggtagcagcttcctttcttctcagaggatcggcttaagtaggaggaggaggaggagggacctgagcggcgtcgttgtcgcggaagtgagcgccgccgccggtgtcacgccggcgtcgtcgtcgtcgtcgcctggcggcatcagcgtcagcgatgttctttggccctccgccggtgagtctgaaacttgaaacttgtcttcttcgtcggccttcgttggctgggtctctgaatctccgtgctttttcgccaagtgaattcagcgagggcttggtttcctctctgtgatatatttttgttgaatggttgtgcagagaaaaaaaaagactatttcttgcatatagtagtggcaaaaccacaaaagccgtcgagagtttgatggttttgccaataaattttatagaaaagaaggctcacctgacatatttttcctcaaataatgataacgtgcaggtgcattcctagcaa

SEQ ID NO: 49748 - DNA, 1501 bp, Oryza sativa
aaatgtgagctggaaaatattgcagaattaaaacctttttctttacttctatctttgaataaaaaaaattgaactctgactctgtgattgactataataacataggtaattttgacaggcaacctgagatacttgtaacagagcaattgtactatcttcagactcttgtacatacacaattattagcatcactcattccattgtttgtgtaactgaaaattgtaggaaaagatgggaaacatatacagagtaaagtctacatgattaattattgaaagtatcttattaccagcaaggatggcattgaattcattagccatagcgatgggtcaacgcttctggtatctcgtaggcggaggcctataagaaaaggtcggtgatcaacataaatactgtcaatgagcttgacattcacaagaatgaacaaaaccacaagaaatggcagcattttcaaattctaaaactgttaccagtaaattatcaagcactatatgagagtttggtacagactacataatcatgttttttacagtccttgagaaacatattctttctacctaccacttgatttcaatagctgcctccggcttatttttttggtagacatcctcccattagattttacttctatcacctgagtaaaatttgatatccgggaaagttaatttgcatcttgcaatttgcagaagtcccagaatatgtaacaggcatttcattccaaagcaaacctacccttacagaaacatgcatcaaattagcatgacaattgcagatttattttagataagggagatgattacatccccagcctctgcatctaggatgcacacggccatttgagtttgcaaagaaaatgatctcaacgagggacataactccccatgacttgaaaaaaagagagagcaaaatctgaacctagagaaagatttattatgcatgaagcctactggtagccctccatccaaagttacacgtttggattaacggcatataatgtattgtttatttacgtttggacactcacaatgatcatattgcaatatttccatttggcttgttgagtggacttaagaccttgagaacatgagctattgcaatccataattctgactaggaacagaagttagctgatgcacgaccttgcaaccttatccgaatcgcttattagcaaataaaaaatcatttgtgagtaaagcttttatatacgtatccttagtgactaaaaaaacaaatgcggcgaataatctacaatgaaaaaaaatcaaattcaaaattaagttctaaaatttaaattttgacttatatgatcataagaatgagtcccttgctgtctccaatttaccattaaccattacaaggcgttcgatcgccgatcggttacctcgtagacgggctccctgatgccgagcgagatgtagtcggcggagaatcgccccgaccccgatcccctcgctgcggcctcccttgacccatcgtcccctggcttgtcctcctccctcct

SEQ ID NO: 49749 - DNA, 616 bp, Oryza sativa
gggggggagaggaggaggtccggcagccgacgtcgcgccggcggaggcaacgccgccgtccgcatcctcgttgtcaccgccgtggtacagcaccgccagactcgtcctggaggctgtgcgcgagcacatagaggccgtagaagtcggtggtgcgcaggctggtgacttctacgaagaagtacaccatgttggggttcttggggtggacgagcgcgagcaccggggccttctccgacatcccagtcgccttgtagctctcgctggcccagatgtcggcgaagctcacggcgtactcaagagtccacaccttggtccctggatcaatctgcgtgtgcatggggaccttggtagtaacaccatcgcttgcagagcccatgtccacgcacctgaacttgccgtcgctcagctgcacgcagtggcgggaggcgagcgctctctcggcgcagtagccacggccgtggcagtctccgtcgtgttctagcgggaggtcgaccctggggattgggacgtactccatgtgcagctcgtcaacgaacgggttgcagaagaggatgcctgtcgcagtgtccacccagtagagcttgccggcgtgggaaacgacgtcaaagaatctcca

SEQ ID NO: 49750 - DNA, 697 bp, Oryza sativa
agagagagattagaggattttcacaaataagaaaggatttttattttgaaaatattgctaaggtttgggatctacggctcgtcctagggtcaagggggctctgataccaacttgtcacgatcggaattaacccaacgggcgttccttacgtgcgtgtattattccttgtcccaggaggcaaggtacaccaaaagttgatacatttcagagtttataaagtggaagcgtaaatagttaatttattacatgggcggcgaagacccagcacacacaaaaacaaacggaaaacagcggaagactagggcgacgaccacaggcgcttgacggcaggcttttgtttataaccagactgagccacaaactaagccttacctactagacatgtggaagtacggtagtgctttgcaacagaggctcgaagaccggtccttatatggccgaggtgctactatcaaaaccatgcaccccgagcccagcctaaaaccattttgaggattttgaatagagggggaggtgtgaatccaatttccacaataatcaaaccattccatagtgtccaggtgatatgaatatcccaaagtctagagttgtaaaaccacctaatgttgcctaattaaccagcgaagcatctacctaaaatcatactagtggtaccatgagtagagtgtccactagttggggttttgtttattctagg

SEQ ID NO: 49751 - DNA, 468 bp, Oryza sativa
ggcctctgcagcttatttctggtccaacaccctcaatgcctttatgttcaatcaagggccgatgaccccctgttaacaaccaaatttggtaatatcggcatcgggaaagaagattagatcgaagtgaagtcgaaggcggagatcgaatccgaaaacagagtaggaatcggctggagtccagatcggctatgattaggatcggctgggtctgagttggactaggtaagccgatgcagccgattccgacaatacgacttgatgtatgacattgggttgaattgaggtggttcaagatgattgccgcgcatggatagagtcttgagaaggcaattgtatctattaattaggatattttatgtaatttccttagagatatgcttgggcaaaagtctgccgcaaagacttatggtatcttagagtttgttagagataatagtcgtgtctggtatggacatgtcttgtaattct

SEQ ID NO: 49752 - DNA, 1501 bp, Oryza sativa
  unsure (1)..(1501): unsure at all n locations
gcatctttaaacaatttgtgggtgattgtggtccattcgggcaagacttcgagaaattcacgctctgatcccggatgatctttcgaacaccatcactccagctgcatacctcgagccacatcaattcaagctagaaaaaactaaccaaagattacccgaatggcgagagcggaaggacatcgaagccacaatccaagccatcggcnaactcgtgcatgaagagaagtccaagcttgataaattatctgaaggtccgatccagtccaacatagatcggcttgaggcccgaaagattgatctcatggcacaacttgaagaatgcaatgctaaattggccttggaaacacagaagctagccaatctcccaaaagcaatcgaagagaaaaaatcatgacttaaatcggccatcaaaaatgttgctgatttaaccaagtctgtgaaggttatcccaggaaccgatgcccaagacatccaagaagtagaggaaattagacaatgacctatatcggctatcctgcaatacctctctaaatgattggctttgtaataagacttagcttgaaactcatttttgtaatcggctatttgtagtctaactcttaatccatctgccgattaatataattttcgcgttgaaaatccactttttttttcatatatctgcccccctaattttgcaatgacgaaggcattgataaaattataacttgtactaagggcgatatagcaaatatcggccatcatacatcggcaaaacaccatcgattataataatacagaaaaacaactaagggcgatataaccatatcggccgtcatacatcggcaagacacaaccgattatgataacaaaactaagggcgatataactatatcggccatctgaaggcgatctaaatacatcggctaacatgcatcggcaacacttagccgatcatgcaatgacccagacacttgggtaatatttcttcaagtacttgtcattaagtgctcgtccataaacttctccatcaaacccttgcaacatacaagctcctttggacacaaccttatggatttgaaacggtccttcccaatttggtgaccacttgtcacgccatgaaaatcgcctagtttaataattcattctttaaatcatttttagaaattattttagaagcttacaagttaaactctaataatctaggaaaaatttcaacataaaattgagctagataaaattttattaaatactttgcttgtttatctattttctagatttttttggaaattatttgagcaagggaagtatttttaataaatgaaacatcatttcacgaattattttaattgaaaaagtctttaaaattccctaggccgttgggccgtttccggcccaactcctcttttcctcgcgcgcggccgtgcggcccaagccggcccaagccgagccgccaccgcccccctccttttagccgccgacatgtggggcccacatgtcggggttgtcttcaacctccagc

SEQ ID NO: 49753 - DNA, 1501 bp, Oryza sativa
tggcaaatgacaaaagaggggtgttgggggggggagagggtgagcggacgagccatgaaagagtaggacaactaaaatgtatagaaaaaaagtaaatgatgattatgatcgaattttagaattcaaatgacgaagaaaaggggcaacaagtaggttgagaaggagaaatttgcatatgtgctatttttaaaatccagtttcgctagaatgccatcgttaaaatgggattcgctacaatgccactcttaagctgggggtattcgctacaatgccacttccgcgcgtttcttacatttgtaagacaattttcatccaaatattttttcttggacatttttgccccctagttgtggttgaaccgaaccacatcttctcgctcatcgatggtgtcagaagcgctgacgacgatggtcgccatcctcaccgatgacagcatccgcagcatcctacgccacctggtccccgccgacctcctccacgccgcactcgcctgccaccgttggcgctacgccgcgtcgtccaggacactcttttgcatcctcgtcctcgaccctgcctcctgcccccgcgcgctactggtgtggccatcagcactttgccgccgaaggacatggcgactaggcttggcagggaagccaggggggagcggtgggttcaggggatagcggcctacgtgcatgggggtggcaggctaggaacacctgacagggagaggtggcggtggggagaggtgacacggttgaggaagggggctgaggtagggagagagtacgggcggagcaggtggtgtgtggtgccagcgtggtcgtggtcgccccccccccccccctcctcgtctctcctcgcgtgagatgaataagagcgagatgaaaaacttatggttcaagggtaaaagtgtccgagataaattgaatcggatgaaaaatgatgatttagaaatataagaaacaactagagtgacattgtagaatgctcacgatttaagagtggcattagagcaaatctcattttaaccatgacattctaacgaagctggcttttaaaatggcagatatgcaaatttctccccagcgatataatcctgtggacccaccacccccacagcatactctctccgtcccaaaaaaaaggcaaaccttgggtttgcgtgtccaactttgactatccgtcttatatgaattttttttataattcgtattttcattgttgttagataataaaacatgattaatattttatgcgtgacttgtctttttaattttttaaattttttttcaaataaaacagacggttaaacgttgggcacggaaaccagggtttgtctttttttttttttttttgggacggagggagtacgacgggcaggagacgttgcctggggacgggaccccgaccccctggtacagtacgggcatacgtactgtaagcagagggcgctgtccccgctgccgacgccggcgctgcgccgagagatcgatattggagtacatactgccgtaca

SEQ ID NO: 49754 - DNA, 955 bp, Oryza sativa
ggctttactttttgtataatatggttcattgtagagcaccagactatgaagtggcggagataagcccacgggggtcgctggggagtccatgccttgtttataagggggtgattatgatctaggaacggtgcactgctttgaattgtgttatgcagagggtattgtgaccatctctattcgggtacttgttaagtatcgcgacgcatggttgacatgatgttgaggttgtgtcttgtgggtacagtggtatacctctggccagagtaaaactattcgaatagccgtgcccacggttatgggcgggtgtaacaatgtttttcgtgattagtttcacacctctcaccataataaatgatgttgtacttgataataatttgtttaactcctggcttggaatggtatattcctggtttggagatagaactgtgcagccgggattggttgttcagaatggttgggcctatgcaacgggtatgttgtatagagatggattaatattgcttaattaaatacttttctgttttattaaattctgaaatatttattaaatgccatttatgcaaatgagactatattatgccatcctttgttatcccttgcacttgcatatttgctgcgtggcttgttgagtatgtcatatactcaccttgcaatcattcatcagaggaggagttctacagtgatgccgaaggtgtggaggattaggcgtagccctagtcaagctgcttgtggaatggagtcacctgcgccgtttatcttattttgcactacttagaactttattgtttgagaggaattatctacctctgtaatgactttatgttcgcttattaattagagtaataattgtactctattatcaatttgttattgtgtgccttggctgattcctggacgatggtttacacacatgcaagcgtttggaattttggatagaaattccgggcgtgacaat

SEQ ID NO: 49755 - DNA, 1501 bp, Oryza sativa
tccttaagattgtgcgtgcaaattctgtaatcgcagtgggctcttagtttcatggccatggagcgactgcctttcccaaacttgcgccgtgtttagttccaaaatatttcttcaaacttccaacttttctatcacatcaaaactttcctatacacataaacttctaacttttccgtcacatcgttccaatttcaaccaaacttccaattttatcgtgaactaaacacagccttgagttcttgtggattgggaagatgcctaactgggaagagtggtcatttcacatagcacaagcaacacacagttcttctcttcagacattcccttgtctgcatcaacttgaactgaaggactgttcaaaactcagagctctacctgaacagctgaagcatgcccccaagatgcagaggctgcgcatacagggagctcatgcactgaagaagatcaagaaccttcatgaactttcaggctcgctacgtatcaacggaagccactctctcgcgagcatttcagacctgtatcagatcaaagagctctatgtagctgactgccctgcactgcagtttgtgaacaatctaaatgcgttgaagtggctgtacctcgaagatgagacgatggactgtatcccgatgtggctctcgaggctggcagagagtggtgagcaagccggtgaggacggcctcgagttggagctgcattgcagcactgaaatgctcgataggtggctaattgagcgtcaggattggacaatcctggagaggttcacaagtgttgctgcatattgcaaagaagattacatgtgctattcgagacacccagttagctaccacacaagcaagagtggctcaaactcaaaaatagaaatgcatctaagttagctactgccttgtgtatgtctgtttggacaagaaatgcaagattagtcaattcatcaaacttgatgcgcactgcttcgtgcataaaatttccctgttaaaataacagaatgttcgacagcaacagaagaacaaagcagcgaaatgaatcaccagctggggaatccaccgccaccggctcgccgcgccgtcgaattggtggtcatcacgacgaggagtaagcatatgtgtttatgattcgatacgttttgcatatttcggggaaaaagattccatgtctctgatctctgaacctgactatggaatttcagtgtttcggttagctctgtctgcctcggagtggcaagcattcattctgctgattatctcgatgacagagatattggatctttagatcttgtctgctgattatctcgatgatagagatattggatcttcagatcttgcccctgagtggcttgcattttgttgaacaacccaaaacagagttggggctgcggtctagtacaatgcttggaggtttttaatgaggcttcaggactggggggccatcatagttcatttctttaattttgttgcttcttcaacggaagaaatgtgaagtatgtaagtatgtactattccaa

SEQ ID NO: 49756 - DNA, 709 bp, Oryza sativa
acttaatatcttaagccctgaagcagcatcaaccaatttatcggcaaccggcattgggtacttgtcctttggggtagccttgtttagatcccgaaaatcagtgcacactctgaccttgccatttttcttgataactggaactatattagaaacccactcagcatatcggcatggacggataaaaccagcatcatataaacgtgtaaccttagccttgacagcatcgagcatatcggctttgcatctcctcggcaactgctggtatggtctaacccccggtttaataggaagccgatgttcaacaatcgatcggctgagtcctggcatctcataatactcccaagcgaagcaatctttatattcctttaaaagctctatcagcttggctctgaattctggagataagttattgctgatgaatgtcggcctgggtctatcacctggacctatatcaatttcttccaaatcatcagctgacatgaaaccctgtccttgcttgtcatcgagatcatctactgtatccttggtgtagacgtttgaacccaccacgatgccctcaaaataataatttgggctctccatcttcaattgtgtcacgcccggaatttctatccaaaattccaaacgcttacatgtgtgtaaaccctcgtccaggaatcagctgaggcacacagtaacaaattgataatagagtgcaattattactcta

SEQ ID NO: 49757 - DNA, 1501 bp, Oryza sativa
agcattgccaacgaagagcaagaattaaaacaggaaacaacatgtgatgacaacatctcgtgctcacataggtaaaactcaaattatttcaatgtgtaatactctctttggccagaaatacacatcattttgggcatgggcaaaatattcaaaatgtaaactggatggttcattttcttttcttttattttgtaatttagtaataaactagctaaaaccacaatttcactaaagtatattctttttagaaaaatgtaaaagcataattatcaagcatattgatgcttaatgttttaaaaggtgaaacacatgtttgtctgcaatgacatgtatttgtgaccaatgggagtatatacgttcaatttgaaaccaaaatgtagtttgcaaacaaagcggcccatgatcactatagtggaaagtttcaacatggtgtgcatatagacaagtaaaaaaggtcttaccggtgtgataaccatactgtagcgagaccaaatgactccagtgcaagccacagctgcatgccatccaacagaataagaatgctaacagtgcacaagaatacataaacaaaccgatatggccctgatatctggaatgaatgaatatgatgggctaatggggtaacctaaacataccgacttgctgaggataggatatcttttcaggaggcttagcaaagtccgcaacattggcaatactgataccccatttaaatgttggagcccagaaatgaactgcaataattaaggtcatataagttataggtggtatcaataaatgatagatatccatcacaatttcctatagtgaaatacaaaggtatggggcgcttgcattaatacaaaaattcagtttaaagtaccaagcaagattacatttccatagtaatggtttattcagtatcaaatacccaagaatgcagacaagggatgtcaaataaataaataataaacattatagatagacttgtatcaagtttatggtgattcctttattatttccatgtttacatgataaaagtagagatgataaccaggatcagaaatgatacacagaaatctaagataagcaggagcagccaggaaataataaagataaggaaactaactagttttagggccagcaggatggttccaaaaggcttgaagctttgatgccatttagcaaatgaatgccttttctgtccttccacagaaactgtttacacttccactgcaccctacaagcagaaaaaggaaaatcatgatatctcaaacggcatacgtgaaacaagattaatttcagacaagcccatctaccaagagtaatagggcatagatgaacctcaaccagaatatgcaaatacagcgtctgagataccaccacttattcatatcacacagagttccatttatatgtaggcctattcaaaaacaagctagccaacctgttcaaaaccacagcagaggccactacaggcagcatcactcctgactgcagcagcagaacatgctggcgatga

SEQ ID NO: 49758 - DNA, 1501 bp, Oryza sativa; identical to SEQ ID NO: 36421

SEQ ID NO: 49759 - DNA, 1501 bp, Oryza sativa
agtctgcatagctgaagtctgaagattatggtatatggatgatgaaacgggtcgacggccagtgagaggtctacagcgaaaccataccacctgttatctccatctattttatattctgaattaatattcttaggcccaatttttttgaccagtgaactgagatgctccttgatttttttttacacgtttcaaaatgcgctaaatgttgtgttttcttaaaagaataactttttatatattgaagtttatttgaaaatgaataaatcattttttaagtttataatagttaatccttaattagtcatgtgcaaataacctatcacgttttatgtgccacaatcatcttatcgaccaggctaagtcgaatggagtcttaactttgaccaaatttataaaaaatactttcctcttccccaatcctccctcttcatgggaagctgtcgcctccacctggggacttcaccaactagcacacactagagccgacgccgtggaggaagtcgatggtgcagaggcgttggggagttcatcagccactgccaccgctcgtcatccctgagagcaagttcaatagtatagccaactactagctccaattcatctatagccaatctaatagctcattcatacaatagttacatactacactattaatacctggtcccacctgtcatagacacactgcgtcttgaagtccgtgctacagctggctacaaatctgtagcccgctgctcttctctctcctgatttatctccttaaaatatgtttacagctggcttatagcctgctattgtacctgctctgagagatggggatgtgaggagagaccaggaacacgatgccgctaacatgtgggtctcacgctgactcatcaagttgaacgcagtcaactcatcacatatatgtgagtcccacaagttttttattttcttttcactaactagggtgccacgtcagtgtatgctaccatgaaaccaaatttaagatggttttgtaagttggagggtgtcctgaagaggataggaaaaagtacgaattaccctcccccaactcaaatactagacattttacaccctaaactatttataccggactaatgacctctcctgacactgttctgagcggttttgacttgagctagcatacgtggcgctaacatggcagactagtcaggaaaaaaagtttaaaaacccctggacccacctgtcatccctctcttcaacctaacctctcctagccaccccccccccccccgcgttctctctccatcgcgtgcgttcactcggggggcagtggcggaggtgggtggagcttacttgcgcggtagggggcgaaggcggaggcgagccggttccccaattctggtcgtcggcgccctcttctcccctttggccgcccgcagaggaggcagccggagctcgctcgggagaggcgtgtcaaggtgggcggagagcgattgctccatggctccggcacgctcccctactgcactgcgctcat

SEQ ID NO: 49760 - DNA, 1501 bp, Oryza sativa
acattaaccgtgccaaccacaagccagcatgggcaacggctttactttttgtatagtatggttcactgtagagcaccagactgtgaagtggcggagataagcccacaggggtcgctggggagtccatgccttgtttataagggggtgattatgatccaggaacggagcactgctttgaattgtgttatgcagagggtattatgacaatctctattcgggtacttgttaagtatcgcgacgcatggttgacatgatgttgaggttgtgtcttgtgggtacagtggtatacctctggccagagtaaaactattcgaatagccgtgcccacggttatgggcgggtgtaacaatgtttttcgtgattagtttcatacctctcaccgtaataaatgatgttgtaattggtaataacttgtttagctcctggtttggaatggtatattcctggtttggagatagaactgtgcagccgggaatggttgttcaggatggttgggcctatgcaacgggtatgttgtatagcgatggattaatattgtttaattaaatactttactgttttattaaattctgaagtatttattaaatgccatttatgcaaatgagactatattataccatcctttgttatgccttgcatttgcatatttgctgcgtggcttgttgagtatgtcatatactcaccttgcaatcattcatcataggagttctacagtgatgctgaaggtgtggaggattaggcgtagccctggtcaagctgcttgtggaatggagtcgcctgcgccgtttatcttattttcctaattttattgtttgagaggaactatctacctctgtaatgactttctattcgcttatttattagagtaattattgcactctattatcaatttgttattgtgtgcctcggctgattcctggacgagggtttacacacatgtaagcgtttggaattttggatagaaattccgggcgtcataagttggtatcagagccacattgaccctaggttatgccaaatggatacctatagaagccctctaaaaagattgaaaaagtagaactgttctcctctctttctcttttaattaaaccaagctaatggcacatgcagtttatagtccctttaattgttctcattcaaaatttatttattattcctgtgttgttagtactgtacatctattactatactaatggcccactttctagcagagattttacaacctttcatttatttatttatttattcaatcatgttgcaatataatttagcatgttgattttataactctcttttattttatttcttttgaaacctgttattcaaaagtgcaaaatttgtgattctgttttcaactgtttcaacttatcttgcaagattggtttactttatttatttaccttttactttgattttctaactttattcaaattaatccaaaaacttgtgctattaattggataaatgtcttaactccctcctttcacttgtctttaga

SEQ ID NO: 49761 - DNA, 1501 bp, Oryza sativa
cgccgccctccccaactccggcgacgactattcccaaggttggtgtactcaccccccatcccgtaccctcctcttggtcctaggtttattaaagattgttagtaggtctctaaatctgcatattcgccgtcgatttagggctgcgattagcttgtcttctttaaattttactgtccatttctaggctgctaagctacagaattaggggcgatttgtgagctcgtcccttggtagttgatacggtttaatatggtgtaggattctggaatttagttgttcctttgagccggttacatgaattattttggtttcatcgccgtcattggatgaaatacttctcatcttattgacgtttatcgttgatctttcattgtaaagttgtgagaaaatggaatggcccgcctatgataattctttggtgtcgattttcctatgtgattgttttgcagtagatagtttacggtggtgtttggactcatcatttgtcattgtttgccaatgcaaacctgcggaaatagtctgcatcatgtgagttatatataatgttacagatcacaaattgtagcaccagtatttatttgatttataatatagaatacaactaggtgcttccattatctcaaaaaatatagaatactactagttaatgtgccaaggccctgtttagttcacaccaaacttcccccaaactcccaactttccatcacatcacatcacatccaaaactttcctactcacataaactcctaactttttttccaaactaccaactttccccaaacttctccccaatttcaggaactaaacacagctcaagttactcctatgctttacggtattaaaacagggcaccacacaagtaagattttaaaacaagtactacagtaactctgatatctttatgtaccccttgccattgtgaaaagtgatagccacgatgcaaagttgcaaacatatgaaaaaaaaggatgtctgtgatgcgaaatatactcataagctagtggccaaataaaaaaaggagaaatttcatttgatttccatccaatgttttatggccttcctcttctgctgccacatgggatcccctagtccatgagccaagcttatagctatgactgttcaatgaacctggttttcaatttgttgtcaatccatttatgcttcatcgccagcatgttctgctgctgcagtcaggagtgatgctgcctgtagtggcctctgctgtggttttgaacaggttggctagcttgtttttgaataggcctacatataaatggaactctgtgtgatatgaataagtggtggtatctcagacgctgtatttgcatattctggttgaggttcatctatgccctattactcttggtagatgggcttgtctgaaattaatcttgtttcacgtatgccgtttgagatatcatgattttcctttttctgcttgtagggtgcagtggaagtgtaaacagtttctgtggaaggacagaaaaggcattcatttgct

SEQ ID NO: 49762 - DNA, 629 bp, Oryza sativa
cggccacaagattcatggtcggcgacaggggatcaatgtgccattgctggcgtccttctgttgtgttcttgcggggagggtattttggctatagacttatagtataactgtgttgaacaaaattgtgatattttctgtggtattaagggtgtgtttagttcacaccaaaattggaattttagttaaaattggaatgatgtgatggaaaagttagaagtttatgtgtgtaggaaagtttggatgtgatgaaaaaatcgaaagtttgaagaaaaagtttggaactaaactcggcctaaagtgtacactagccctttcacgtgtataacttttaggaaaaagtacgaattaccctcccgccccaaactatgacgacaatatgaattacccccctaaaccacaaaactagacattttataccctgaaaaccggacgaataacccccccctcaaccaaatccaaagcggcatcgtcctacgtggcattcgcgtggcaatccagtcagcaatttttttttaaaaaaggtggggtccgcctgtcatactctcacacatctctcttcccctcttctctcaatctctctctctcactgtctcggatgtcgttgggggcgacgaattagtggccggcga

SEQ ID NO: 49763 - DNA, 1501 bp, Oryza sativa; identical to SEQ ID NO: 36423

SEQ ID NO: 49764 - DNA, 1501 bp, Oryza sativa
gattatgagagattttgtgtgagcattgtgtgaatctcacctatttcctgcttagcctctccaaatacaaacataccaatgtctagtatgtacgttgggtgagttttattagcttatggactcggttactttctcttttattataaacatgattctcaaaggactcggttactttctcttttgttataaacataacatgattctcaaactgctagaagatacattttggataaaccaatttaatatagaaatttatttaaaaaatctaaataataaaatatttaaagtagttaatatttaactaattatatgttaataatccattttgatttttgcaccactaactaactcggccaaacacaacctaagatgaatccatagatttcaccatagcgtaaagccgtaaagttataacttataagcatatattcaattgcctttacaaagcactccagtttacaatggaaaaaacacatgctacaaaaccacatatttcgatggttttaactgaaaaaaagaggtgacctcgttttctttcctcaatgagagcagaggcaagagaaaaaaaaaagagtaaagtccatcaccggtccctaaactttaccgctgtgtcatcccagtccctaaactcgcaaatcgatcgttcaagttctcaaacttattcgactgcgtcatcctggtccctaaacttgcagatcacttatttaggtcctccaacttgttcggttgtgtcaccccggtccctaaacaggacggtctaaaaactttatatcaaaaaataattcataactttttcatgtaaactctaatgaagacaaactttatatcaaaattgtagccctcgacacgacctacaactttgtagttgaaaagtttttgaattaaaactgtttagggtcccaaaatattgttgaatatttatagattttgaaattttaattttaaaattacatattgggacaaaaaatgacttaaaataaaaaaattcaactacaaagttgtagatcgcatcgagggctacaaatttgatataaagtttgtcttcattagagtttacataaaaaagttatgagttatatttaaatataaagtctttagaccgttctatttgacctagatgatattcaaatccaaatttaaggaccagggtgacacaactgaacaagttggagaatctaaacgagtgatctgcaagtttagggaccgggataacacagtcgaacaagtttgaggacctgaacgatcgatttgcgagtttagggaccgggataacacaacggtacaagtttagggaccgatgatggactttacttaaaaaaaaaaaacaaaacaagtgaagtgacctcagctgctgcggtgctgcctgtccctccgcatcaccacacagcacgttccccgagctcggccacacccagtaccaagtgcacagccgcagcgccgcatcaccgccttccatttccacatctagggtttcagttgagtcgagttgagtccccctccc

SEQ ID NO: 49765 - DNA, 1501 bp, Oryza sativa
atcctgccaagcaaggtaactttaagataacatatagctcacaagctgtcacaacaatcctacagaatttattatccggaaagattaccagagatgcttgtagaagccctgtaaccacacgatcccgtagttgctccacaatgacattacaaagctgattaagcacctaaatattgaggcgtggaatcaaatatctccattagttcaagcgaatcttacaaaccaaatcacaatatatatatttatcaaaaaaacactaataaccagaggtacaggattcaagattgattatcgatttttgtgatatagcaaatggtttgcactttggccacagataattaacttatccatatcttttgaggaaataaactatattcataacagaatacaatatgtgttctgtgaaaagttgatcatctaagtagctaaccagcattagtacatagataaatggtaggtttcatgctagctgtcagatcatagggttttgtttctccaatttaatgttcctgaaaggttgcacgattcatgagcataccgtatcaagtacttccataatagcatccagtcgagcttgagaaacattgtttttgtacaaattatcaataaatggctgctgtaggtcccagaagataacctttagccctaagaaagaaaaggttaacatgttaatagatatctgtcagcttccaagaaagcactggggcatgtatattttcttacctgtaaactcacatatccgatcaattgcagcattgatttcttttctgctgccatcaaattgattcttctgactcgagacagcactctttgatttttcactcattgatcgtcctgacaaagttcaaatattttcaatataacagatttagtctgatgttatctataaggggtagatcaaatagattgatttgcaaacttatcagaatattcaacagataaattggcaactaaaatattttttttctaaagaaaatcataacagtatacattttttttcttgaaaacgcataacagcatacttactgatgttaatgctctcacttttcctcctagcccaccgctcatttatgctgtcctccagcttgcttagctggctgataccatactgtttgacaaaaaaaaaagtgcttctggttcaaaactaatgaaaatggacacaattcaaagggaagagaaaagtcaaaagatgccatgaggacactgatgtagatcatgaaaaaaaaaactagcaatagctaaattcaaaggaagccaggctggaaggtgaagatattcacctataggttatagcagcataattatcaacacacttgaagcctagaaaataattttaatgagatacatacactgatccccaaatgtcatagttttaaattaaattttttattaagattggcatataaagaagatatatcgttttatatctcacagaaattgctcgggaacttgacaagtcattctagtcaaagcaacaaatccatatagcagtgctctgttg

SEQ ID NO: 49766 - DNA, 1501 bp, Oryza sativa
aaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgttgtttgggtttttaagcaattgattggatacaatatcgttgctttttgccacgtaagtgtgcatttttattgaccaatattatggcttaggctgattatatattgtagtcattttttttaggcggttggtaaatcctttatgagtttatttactcggattctacaccacatatgcctgttttaattatggtggatagtcatagcttaggctattagacttattcattaccataatttttataatatttggtgggtaatctttagagttttttattcggatgcctgtcaagtgtgttcattcgtgaaccttttagagtgttaaccactcggattctttttattatggctaaaaagcagtcggctagaatgcctctttaggtgccgcatatgcttttgtcatatgatgcacgattgtgctattattttgttctcaactatatgtttagtttgttaactaatcacatagttgggggctacacctaattaggtgcatctatttgatgcaccatattccttattttttcgccctttacagtcttcgtcttcgctactcggcaggccttggcatgaaaagtttgaagcactcggattattatctttgagaaggctatgatggttgactgcaaaggtctcgggggctactgtggagattatggatatcccatatctacacggcgatgatatttggactggatataggataccgaatatatatataatatcttatttgtatctcgggttcgtttcttaacttgtacatcaaggaaacaccttgagacttagtcggttacgactgtattttacctatatctgcatattccgttagggatatagattatcttttgtaacacggactccttcccatatataaggggggtccgggtgcctctaggggcagaggttgattttctccaaaccatacaatcaataatacactcggcggattcatccccggacaggagtagggtattacttcttgaataagaaggcctgaacctgtataaatccttcgtctccaaacccatacacttttccagcttgatagccacccccttttattattgccgaaatctagtttcgacatcaccctcgggcccgaccccctcgagggggtcaagccacgtgggtgaccgcggctgcccaagcctctagtcacgatactctcggtcccatgtcaccgacagtagcccccggcgtcatgccagggcgatcgcccccctcgagggaagcgctcgggcgtgacgccactccttaggcctggtgacaggtggggccggtctctacaggcgggcaggaacccagcggtcgcaaatcgcgcgcatcggcaagggaaaaccgaccgataataa

SEQ ID NO: 49767 - DNA, 1501 bp, Oryza sativa
gggaaggagtccgtgttacaaaagataatctatatccctaacggaatatgcagatataggtaaaatacagtcgtaaccgactaagtctcaaggtgtttccttgatgtacaagttaagaaacgaacccgagatacaaataagatattatatatatattcggtatcctatatccagtccaaatatcatcgccgtgtagatatgggatatccataatctccacagtagcccccgagacctttgcagtcaaccatcatagccttctcaaagataataatccgagtgcttcaaacttttcatgccaaggcctgccgagtagcgaagacgaagactgtaaagggcgaaaaaataaggaatatggtgcatcaaatagatgcacctaattaggtgtagcccccaactatgtgattagttaacaaactaaacatatagttgagaacaaaataatagcacaatcgtgcatcatatgacaaaagcatatgcggcacctaaagaggcattctagccgactgctttttagccataataaaaagaatccgagtggttaacactctaaaaggttcacgaatgaacacacttgacaggcatccgaataaaaaactctaaagattacccaccaaatattataaaaattatggtaatgaataagtctaatagcctaagctatgactatccaccataattaaaacaggcatatgtggtgtagaatccgagtaaataaactcataaaggatttaccaaccgcctaaaaaaaatgactacaatatataatcagcctaagccataatattggtcaataaaaatgcacacttacgtggcaaaaagcaacgatattgtatccaatcaattgcttaaaaacccaaacaacaccatgactatattaaaaagtcagcggggcagctatataaagctttactgtttgacaccttttaagatgcattgtaccaactcctaaaaagttgagtaactgcggtataaaaggattttaaggtattgggcacttgatcacgcgcactttggcctaagcgaaaagtgcctgagtccctaaaagaacatgacaggccacacctgaaaattcgcattgcaataattccgaagaattatatgaccgcgtaaaaaaggattttatcagcattgggcaacactattgtgcgcataagttgccaaagcaaaaaatgcctaagtccctaaggagcacaatgggccacgctgtcaaaagtattgggctgaggtactgttcaggcctaagcccattcgcacctccgatacccttaacaaaaaatcccgtgatccaagcgccacttcgtcttccccgccggaactctcgccattttccccactccctgctacagtacggagctgcgccggcaaactagggttcaccaatccactcaaatccacattcgaaaagttcatcaaaatctttcccgtaattcaccgccttaatccctcacctctccctagccatcccccgaatcaaatcagcgcattcgggtaaaatcaa

SEQ ID NO: 49768 - DNA, 1501 bp, Oryza sativa
ttaaggggtatctttaatttccaaagacgcttattaatattagaaacattgctttgaattagagctgatgatgagactttagtgagaactccccatcttactcgtcacctatgcttaggtttctttgaaacggaaacggtttggaaagattctgcccaatttgttaatctctatttcatatgcagactagatgttagctaccgccagggcagtttgaaatatatgttttttttaaaaaaaaagtttttggattcctaaaaaattctagggcaagttgtaatatgttgaaacctcttatccatatttgtacatttacgatgattatcaattgcttgtaaagaaagtacgaggctagtcgttgttcctagggcctagcaaagcattagtaagagttttgaataattaagatgatcgtggaatgtagcatcttggttcaagtcccctgggacattttcgagtggtttcatgggcctatcttgggttgaagttgaccgataaactattccgtcgaatatctctcgtactcactacttggcatcatagttaataatattgaaaggtgccaatcacgatcatagatacaccgaggatgagtggctatttatgcgtgcatggatcccactcatccaatacatgtggtggtcactttggacacgtgatgacatattacccatggtgcccacataagtaatatccaccgtagtgtttcgtgggaattcaaaatgaaacattacaaggcttattattagtcggtcaactggaagagagcactagtcgattttttttaatggataggatgactttaagatttgtgtgataccccccaactctactgcctcctttctcctttccttcaccccaataccgccgctgacgcaatccccatccccctcccggtcacccaccagtccaccaccaccaatgaccccctgtgcatagccttcttctgcctcgacagtactagcaaggcccaccaaactggcctccttcattccaacccttctcttcctataaccgagcagtggtgaggtgcacccatcttctctgatacctctgccgagacgccaccgtcgcttctgtgtgataaccactttacatttgatgctctcgccttcgatgttgtcccacctccctccctccctcatatcccacggctctagcaccatctacgtgtcactaccatccaccaccgatcttttacacctcagccatccctctaaagccgccctctaaaatctacattttgtgcaggaaaatgggtggcggggtacgttccgttttttccttcagggtggtttaacaaacccttgcccgtgccactgcacctcgttaactcccgccctttttatccccgtcctctcacgtatcaacacttgccgtgccactctctccctcccgccttagctaagctcccatcaattcgccccacccgaaaggggcaaaggagaaagccactgactccgatggggtcgccgcgaggacgccgccgcggcgacaatgg

SEQ ID NO: 49769 - DNA, 750 bp, Oryza sativa
tgacctgttaggagcgtctgctactggtcgctttggctatgcaggaataatatgcctttttattaaaaaaagccacatcttcaccattgcaggttatatatcatcttatccattggcttcatacataggcttttctatagaaacctgtttcgcaggatatagtgcttgcggtatgtctacatttggagaagttggtcagggagttttttacctagggatatgggtggtgatctagtcttaagattggtggttcttaatactccgtgcttttgatggagatgataaatgaattgttcatgggtgacggttgagtcttggattgatggccctcaatactccatatcattttttttctttttaatatggatttgtatgttcgactgtgtgtatcttagttatgtagagaccgaaagtgttctcagaaaaattgtataaccttgttgtaattaattcagtaaaaacttccattattaaaaaaagaaaaggtgacgagcaaggtacgggttccatatgcacgcacgtggaacatgccaagtgcagtgcagagaccagcatcttttcttccttaattgtactcagccatgctgtgcctgtgcaacagagcaaaagcttctcctaagtcctaaatcttgttctcttctgcttgttttattgaggcttgcagctaaggctgaactgaatcgacgacgaccaaggatagcgacgacgctgacgacgaccaaaacaaaaaaacgatctttgcgtgaggag

SEQ ID NO: 49770 - DNA, 198 bp, Oryza sativa
tattcgctctcatgcaaaacgatctatgcataaaatttcgttcttactcgcttctcttatttgagtcctttattgctttatttaaatttggatttgagcatgcattgatcctactcctttgtcttctctagatggccgaccacccacccaaccaccgcggagaaggcatgattgactttgtggcagagttggcacgta

SEQ ID NO: 49771 - DNA, 1501 bp, Oryza sativa
gatggtataatatagtctcatttgcataaatggcatttaataaatacttcagaatttaataaaacagtaaagtatttaattaaacaatattaatccatcgctatacaacatacccgttgcataggcccaaccatcctgaacaaccattcccggctgcacagttctatctccaaaccaggaatataccattccaaaccaggagctaaacaagttattaccaattacaacatcatttattacggtgagaggtatgaaactaatcacgaaaaacattgttacacccgcccataaccgtgggcacggctattcgaatagttttactctggccagaggtataccactgtacccacaagacacaacctcaacatcatgtcaaccatgcgtcgcgatacttaacaagtacccgaatagagattgtcataataccctctgcataacacaattcaaagcagtgctccgttcctggatcataatcacccccttataaacaaggcatggactccccagcgacccctgtgggcttatctccgccacttcacagtctggtgctctacagtgaaccatactatacaaaaagtaaagccgttgcccatgctggcttgtggttggcacggttaatgtttcacaaccgaaaatcgtgaaccggtccttaattgtcatgagcatgaccatcaaaaccatgtgctcacaacccaccattgtcaggttttagttggcaaattgattaattaaccaatcacgatcaaccatcgtgagctatcattaagccatcattaaataatagtgaatcataagataccccatttatacgagctagtgtctctaagcatggctaagcattctagcactttagctaaaaccatataatattctagctaatccaattattaaccaagtgacaaagaataggtaatcaataatcaaaaggctataacaaaggcaataggttatttccactcaatgacattcaaaaataaatgcaatagttgaatagaaacaatagctttaaacgggatcaacatgctcaaagggtcgtttgggatctgtgtgacttgccttgctggccctggaattcttcaaaatcttcccctccaaaatcggactctccgggaacgtcggaacctaagcataaaagatcaaaatcaccataacagcacataaacaatcatgaacagtacatgtggatatttttaacatgtagatctcacttttagaaaaatttagagacttgaaccaactaaatccgagcttagatgaattagttatgaatttttaaagattaaatcggattaaatcatttatatagattttaattgaattatgacgcaataaagaattatttttgaaaaggaaaaaggagttattgcgtcagcggctcaggtttatggtggaccgggtgcacgaagacggtctacggaatggacgtccgagatctaacctaatccaaaacggacggccgagattgaatcggtctaccgcgggtctacggatgacgcggcgc

SEQ ID NO: 49772 - DNA, 1501 bp, Oryza sativa
tacctaattaattatgcttaataatctaagcaccatacttacattattaaatactactctatacccgcatgctagacatagagtaactgataaattagacattaaacccgcaccattacacctctctggtaggctacccacacaattaacacaatacagatataaaataagactagtacttaaacaaagtaggcaaaatttgctacaggacgtccgaaaaatatgtaattagctagaggacattgtaagaacgtgtatttgctgtaaggcatcataacaaaactggtaattaactgctggacaccggcgggattattttattatttttagagggataggagagagaaacaatcattaaagaccagtttgcccttggctcaaattaatccaatgtgggccccactatgagtatgtccttctcgtgtcgccatcgtaggtgaagtggtgaaccccacgtcggcgccatcgagcgtgcagctcgctagcctccgcgagaagtaggcatcgaaacggccgcaaccgcacaccctgagtggcacagcggctgcggtggcgttgacagcgcactcctcaacagcatcgctgggtgatgccctccatgccgtctgcccacggcctgctgatctgccggatgctgtgccagtggatggcgactttctccgtcagcagcgagttcttgatgttgatgacgatactgtccctctagacgacgctgatggtgcggctcggcgtgtggccgttgatggtgacggccagcttgcggacgcagtccggggacgtgaactggtaggtgatgtcccagtcgtggcgccgcggctgacgtgacgccgcacagcgccgcagcggcgaggaagaggctgcagaggaggcggcggctacaccgcgtcatgtcccctcttgctcgcagtcgcagctgcattgtttggtttgctccggttgctagctgctctgtctgtgcgtcgttttgagttacacaggtggatttggagctcgccaagtagcgagcttaggtttttgatgtttcgagatgtttggagcctgctccggtaccgctgcgatggcattgatggaacacctcgtactcgagcgccccgagcatcaccggtagagcagcgccgcacggcagccggaccagctcacgcgcccggtgccgtcgttggcgaccagcgcaatggcgtcgacgtcgtcggcgcgcacgcgccggtgagcatcgcgggaaagaatgagagagggagaaaaggataatgaagaaaaaaagaaaaaaaatcaaagggtagaaacgtacttacacatgtgtttcactcttcaattcttccagatataataaaataatcacgcgggtgtccagcagctaattaccagttttttgtggtgccctacagcggaacacgttcttgcggtgtctcctagctaattacacttttttggatgtcctgtaacaaattttgccaactaagtaaagtaccgaagatatataaagaagagtattccattaatttgg

SEQ ID NO: 49773 - DNA, 1501 bp, Oryza sativa
catctcgcggcgccgcctccgtcgtcggcattgctgcggcgtggaacacgccgtcctcgtctccgtgcagccgctgccggctgccctcgtcgcctcctcgccggctccggtcgtcgtcgtcgtcgtcctctcgtcgttcccggtttcgctcgttgtggcgttcgtccctccgtcaagccattctcgtccgccgcccgcgtttcgtcaagtgtgcagcagccccgtcgtcgtcttcgtcctcggctccgcgtcgtcaagccttgtgccggccgcgtctcgccttcgtccaaggatcgccgccgaagtcgttccctcgccgttcgcctccatcgtccctgagctgtctccgccgcgcccgttcgtcgttgtcgttcccacgcctcgtcgcgtggtggtaaggatccctctccctcgctgccccgtcctcgtcctttcggtgtcgcccgtgcccgttgtgcggttgtcgaccccggtacccgtgtaccggtgtcagtagtcgttcgcttgcgcgtgtggtgaccgtgttagtgtacccactcagtagccgcgtggactccacgtgtgcaacccgtgtggtgtctagtggagtccgtttgtcggccactcgcctcagttgacacacggggtccgcttccgtcgacccgtggaccgtctctgtgtactcggtctaccgcggtcctttaggttgacatgtggggtccgcatgtcaacagcgcagccttcctgtcttttcccaggctagcgcttccacatgttttatggttgcaaagcctaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgtggtcgtcgccgaaggttcggaaggccgttctctctgagcaaggcaagtcacatcatctttgaacatattgaatcccagtttataaaattattttgatttaaattaatgcattatcgctttatttaaattcccgtgttatcactgttttatttagccatgcctatttacctttgttaagaccttattattgctattgttattattaccttgttcaccctaggaaaacaaaaccccaactagtgggtactctattcatggttccactagtatgaaattaggtagatgcttcgctgattaaataggacaacattaggtggtttttataactttagactttggaaattctcatatcatttggacactatggaatggttggcttatggtggaattggacatacacctctcttcctctttcaaaacccctaaaacctgttttccggtggggtttgggtgcatgccagttgtgggaagtagcaccccggccactataaggattaa

SEQ ID NO: 49774 - DNA, 1501 bp, Oryza sativa
tatacaatggcggtccttatgagctaattgttctacacttcttacttggtgtagcttgttatatgggtcgtgagtgggaactgagtttccgtctgggtatgcgtccttggattgctgttttatattcaactcctgttgcagctgctactgctgttttcttgatttaccctattggtcaaggaagtttctctgatggtatgcctttaggaatatctggtactttcaactttatgattgtattccaggcagagcataacatccttatgcatccatttcacatgttaggtgtagctggtgtatttggcggttccctattcagtgctatgcatggttccttggtaacctctagtttgatcagggaaaccactgaaaacgaatttgctaatgagggttacagatttggtcaagaggaagagacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaactaatctgtagttgatagccaaggtcgcgttattaatacttgggctgatatcatcaatcgtgctaatcttggtatgggagtaatacacgaacgtaatactcacaacttccctctagacctagctgctcttgaagttccatctcttaatggataaggcttttctgctaacatatagcaatttttgaagaaaggaaagctagaaatacccaatatcttgctgggtattttttattttgaatctttctattctgaattcagttaacgacgagatttagtatcctttcttgcactttcataactcgtgaaatgccgagttggtacgaattcccccaatttgcgacctatcataagatttgttatgtaaataggtatatgttcctttccattatgaatcgtgattgtatggccaaccattgcgggtagaatgctagatgcccgggaccatgttactattgtttctttctcctccttcatattgaccttttctatttttgccaataaatgatgagctacaaaagaattctttttttttcgtgtcacagctgattactccttttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggtttaattcccgtcgttcgcccatcccattattgcaaattccaaaaatgcaattttccatattcctagttacgtatttacttacaacgacgaagaataaaactatcactatattttttccttttcctagttcttcttccaagcgcaggataaccccaaggggttgtgggtttttttctaccaa

SEQ ID NO: 49775 - DNA, 1501 bp, Oryza sativa
ctactcgaattggaatagttttattacttcaatgaaatccgattttattttgaaaaaagaaaataaaagactatttcggttcttatataactcttatgtatcagaatatgaatttttcttgttgtttcttcgtaaacaatcttcttgcttgcgattaacttcttccggaacctttctggaatgaatcatcttttctaggaagatggaacattttgggttaatgtaccctgctttttttcggaaaaccatatggttcgttatggatccccttatgcattatgttcgatatcaaggaaaggcaattcttgcatcaaaaggaactcttcttttgaagaagaaatggaaatgttaccttgtccgtttgtggcaatattctttctctttttggactcaaccacaaaggatccatctaaaccaattagcaaactcttgcttcgattttctggggtacttttcaagtgtaccaataaattctttgttagtaaggaatcaaatgctggagaattcatttctaatagatactcaaatgaaaaaattcgataccaaagtccctgttactcctctcattggatctttagcaaaagcccaattttgtactagatcggggcatcctattagtaaaccaatttggaccgatttatcggattgggatattcttgatcagtttggtcggatatgtagaaatctttttcattatcacagtggatcttcaaaaaagaagactttgtatcgactaaagtatatacttcgactttcatgcgctagaactttagctcgtaaacataaaagcacggtacgagcttttatgcaatggttgggttcgttatttttagaatatttttttacggaagaagagcaagttttttctttgatgttcaccaaaacaacttacttttctttctgtggatcgcacagtgagcgtatttggtatttgaatattctccgtatcaatgatctggtgaatcctcttaattaatcattaaacaaaactaataaactagaaatgattgataaatgatcaaggtaaaactttcacagtttctattctgaaatgttctttgtactataataaatagtaagtgaatcaacttactactaaaaaaattagtagacttcctcttcggaatagaaatagcctatttctacatagggaaagtcgtgtgcaatgaaaaatgcaagcacgatttggggagaggttttttctctattgtaacaaggaataattatctactccatccgactagttccgggttcgagtctcgggcaacccatatggaaactagaaaggagcaatctgagttttgatttttcactcaattcatttacaaatttttttggtttggtaaattttgttgtatggatatacaactgtcggggctggcttggttgacattggtatatagtctatattatactgttaaataacaagccttctattatctttctagttaatacgtgtgcttgggagtccttgcaatttgaataaaccaagatcttacca

SEQ ID NO: 49776 - DNA, 673 bp, Oryza sativa
tgtttagttgtatcaagccttggatcagtagattgatacaggttcaaccaatctggatcttcatcgcatacatttggtaaagactccaaagagatatctttatataaaataataggatatttacaagtttgtggctaactattcagcagaagctatagaatggcttaactctaatgttttgctatagacttaaaccatgtatctagtctatacttgaaaattaagttagaatgaaactaacttatatgattgaactcccagcttcggcaaaaactccaaatagactctgaaaaagaggggttgaagcaaggttgagtacaacgtactcagcaagctattatattattcaacaatgaatgcatgagaggtaatatctgtgtagagctagatttacttgcagaatgctgagaataaagaggtagaaatcctgaaatgcttgatatgcagcagtatttaagaaaatcttgaattatatttctaaccaaagtaccatatcagtcccgatgctcaaatccgtgagcacggctattcgaatagttttaaacatattcatactgcagtagatgtacgctttacccgcagtccataacttgctaataatcattagcttagtcatggcccagtattaagttattaacaattgtggcacctgttccatgaactctagtcccca

SEQ ID NO: 49777 - DNA, 1501 bp, Oryza sativa
tcctctaacttcgtcttcaactcagaagcactacacttttgaaaagggggaacaatagcaaggctgagtacaaccaccatacttagcaagccacaccaatgatgcagacgtgcaatgggatacaaggatggcttgtggctatttgcataaaggcagttgtaaaacattttattgagcaaaacagtaaaactattgattaattaaagtaatattaaatttccactaatcaacactacaccacgttgaataggcccaaccaacctacctgaactacaatgcattgggtcgatttattgagtgtgagactaatcacggtgaatctggtcgatcacccataaccgcgggcacgactattcgaatagttttactctagccagaggtgcacaactgtacccacaagacacaatccatcggcatgtcaccgtgctcggctagacatgtcaccatgtcgagtgattgtgacaagacccttcatataaccccctctgaccacagaaccggaagcgcccttgtttcaaagagaggaggacgggttattcacatttaatttgatggttataggcgaattgagaccctcgggggaaaatagggatgtctcctacgttacccataatatgtagaagtatcgacgtaatttcatagagtcattcgatctgaatgctacatgaagaacataagccagatgacggaacgtggagacctaggatgtagaagatcataacatgaacgatttggcatatttggattcctttcctatatatccactcatgtggtacttcatcatacgattcatataagatccatctgtctagagatcgtcatatacatctagaaagccgtatgctttggaagaagcttgtacagtttgggaaggggtttttttgagagaaaagaataatctatttcaaccgatatgcccttaggcatggccatacataacataggaatcacaagtggaaggggtgggcaattagctagagcagcaggtgctgtagcgaaactgattgcaaaagaaggtaaatcggccactttaagattaccatctggggaggtccgtttggtatcccaaaactgcttagcaacagtcggataagtgggtaatgttggggtgaaccaaaaaagtttgggtagagccgggtctaagtgttggctaggtaaacgccccatagtaagaggggtagttatgaaccctgtggaccacccccatgggggtggtgaagggaaagcccccattggtagaaaaaaacccacaaccccttggggttatcctgcgcttggaagaagaactaggaaaaggaaaaaatatagtgatagttttattcttcgtcgttgtaagtaaatacgtaactaggaatatggaaaattgcatttttggaatttgcaataatgggatgggcgaacgacgggaattaaacccgcgcatggtggattcacaatccactgccttgatccacttggctacatccgccccttatccagctaaaggattttctcttttttc

SEQ ID NO: 49778 - DNA, 1501 bp, Oryza sativa
actatttattatagtacaaagaacatttcagaatagaaactgtgaaagttttaccttgatcatttatcaatcatttctagtttattagttttgtttaatgattaattaagaggattcaccagatcattgatacggagaatattcaaataccaaatacgctcactgtgcgatccacagaaagaaaagtaagttgttttggtgaacatcaaagaaaaaacttgctcttcttccgtaaaaaaatattctaaaaataacgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaagatttctacatatccgaccaaactgatcaagaatatcccaatccgataaatcggtccaaattggtttactaataggatgccccgatctagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagtttgctaattggtttagatggatcctttgtggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcattccagaaaggttccggaagaagttaatcgcaagcaagaagattgtttacgaagaaacaacaagaaaaattcatattctgatacataagagttatataagaaccgaaatagtcttttattttcttttttcaaaataaaatcggatttcattgaagtaataaaactattccaattcgagtagtagttgagaaagaatcgcaataaatacaaggatggaacatcttggatccggtattgaaggagttgaagcaagatatccaaatggataggatatggtatttctatatgtgctagataatgtaagtgtaaaaatttgtcttctaaaaaaggaaatattgaatgaatagatcgtaaattctgaaactttggtatttctttttcttccggacaagactgttctcgtagcgagaatgggatttctacaacgatcgcaaacccctcaaatagaatctgagaataaaactcagaataaaaaaaaattgttgtaatccaataatcgatcttgtttaggatgattaaccaaattaatccaaaaattctgctgatacattcgaatcattaaccgtttcacaagtagtgaactaaatttcttgttattagaacca

SEQ ID NO: 49779 - DNA, 572 bp, Oryza sativa
agcatgtttgtggtgtgataatttggaagccatgtatctttcagttaatccggtttttcatgcaaggacaaagcacattgaagttgattatcattttgttagagaaagagtggctcaaaagcaattggttattaagtttattgcttctggagatcagattgcagatggatttactaagtctctttcagctcaacaattcaagaattttgtatacaatcttaacttagataagttatgattgaggggggctgttagagataaagtatggtttagatttgcataggcttagagataagtctagagtttgtttctcacatgaaacaatgttttatctcttgtaatcggatccaaactgattcaatcttgtaagccacgttgagggttcttctcaacaacatataaatattcatacgcggcctcgagacgaggtgagaacgcttacgcacttttacagtgttcgtgcgtgccggtcgacctcgcactgttggatatggagctcgaggagaagatggctgctagggcattgggcaagggcatcagcagcagcaacaatggctgcgaaggcggcggcg

SEQ ID NO: 49780 - DNA, 1501 bp, Oryza sativa
aatctagaatatctccgacatatttattcaatgtcgaaattacgatagagcaggaagttctacggtaccgttaatccaatcgcgctatgtgcattgactcgataagtttgatccagcatttcaatatctcaccagtgcttctaagctactctcatgaatgagtatgctagacgactaggcgcgttagcatttagaaggttatggtgcacaccctacctcttgcagagcaagaactatcagcaagaatgggtattttcgactatgattgactaagaaaatgaccaagagagtacggtaattcggtgcaccgaacttgcaccaggtaccatggaaactctcaatgattctacccgagcgtcacaaaagtcgtacgcaagcatcactagtgcacatttataggtgacttatgatggttgtatggtggttaaacactcacaatagccattgggagccaaccaggaagccacgcgtggagggccaactaccacggcgaggatcttggcagcggcgctggatccgaccacaggctcgctgcccctccccacctcacgcagatcagaggagaccgatgccgccgttgctggagccgaagacgaagccggtggtgattcacgcgtgttcggcgtcgcctccctcagcaccagcatcatgtactcattcacccaggtccgtgcctcccctcctagtcccttgcctcgcccagcccgctgcacacggggatccccggggcggcgagtcggcaaacgggggcaccaccgcaaccagctgcattgcctgcacgtgtaacataccgaaaatttgctattttctacatatgcatcacgccgattcttatgtttttaataacttcctaaacttaagaaattataattagagggacctcctaaaactaacatgcataaaacccctctttggtatttaaaatctttcgtggttttattctaaaaattggtcttgttaaattgaggtattctctttgatttgattttgcatcttaaacgttctttcgaccaaaattttctttatttaattttagtttgaaaatcctttttacttttatgaatcatggtccaagaaatcctccaacaatacctttgaacctaaaccgaagcaattccaattttattagaattaattgtcgacccatcctttgatttcaaacctattcttatttatcgccaaatatccaagttccccattagcctcgaatacttctccaaatccttgctaaataatttgaggctaacatcctatttatttcccttccctctcaatcgagtgcatcaaataaattccgttatattctatctctcaaaagattgcactcaaataaattagaacatccttattttaaaatccctcaccatgtatcaatatctccgaattcaaatcctttttaaatctagccatccaaattcctctaaatcaattatttgaatctctagaaaaattagactttcttccttgtaattttgggccgaattcttcttcccactcaggc

SEQ ID NO: 49781 - DNA, 909 bp, Oryza sativa
ttgattgtgaatgtgctgcagatatttaggtccattctttttttagtggatttatgttggttctaaagatacgctgaacctccctcttaacctggacctagtcctaagagcaaagttaatagtatagccaactactagctacaattcatctataactaatctaatagttaattcatacaatagttgcttactatactattagtatatagtcccactgtcatatacacattatgtcttggagtccgtgctgcagcgggctacagaagctgttcttctctctcatcttttatcttattaaaatatgtttgtagctggctaatagtatgctattgtacctgctctaagagcacccgcaatggtaaagtaaggtgctctctataaaacatgtatatctcagtaatagattagattaatagtaaaccacctcaatagtatttctacatgggtatctatagctctctcatccattgtcttgtttttctctatagactctccaggttagtagatagctttactctctctctccatttaatctcttacaagtaggaaaatacgattatcttttatagagagcatatagataaccattgcgggtgctctaataacactagctaagcgcaaactccgagttatccatttcgcagcatttaccttgacggagtggacctgaaacgctaaacgcatgagcaaacgtgtacggaactcctttggtcaatcgttggattatccatctgaaactccttttgttttcgccgggatacccgtatgaaactcctgcatccgtcgccttcattcgcaccggtgataccgtactcatttggccggcagaccaaacatagtggattagtggacacttatgtgttgagaataccgtgccggtcctttgcgaaagcacatgtaacgcctagg

SEQ ID NO: 49782 - DNA, 1501 bp, Oryza sativa
cccatggcaagcctccagcctaaatcccgcagcactctcaccgtctccatcaaccgccgtccgccggtgcgcgctttgtgggcccgacctaccggagaaacaaattaccagcaagggcccgacccaccgtcgccgccattcctttctcggcttagtacggcgtggggaacacggcgcgcaacaacctcgccaccgcttctccccttttctcttctcttctcgcttcccaatccgccattccgccttctcccctccaacacggcgatctcttataaatcgcgtcgtcctccgatcaaatccacgtcaccaccaccaccaccaccaccaccgcaaccgccccctctaaccccgccgtcgccgccgcggccacagcaatgaggggccgcggccatccccggcaggcaccagctgctcacgcgcgccttgctcgccgccgtgacgacagacgcggccatgatgggcgcggccaaggggagcgccatttcctcgaggaaggtggagctcgtgggcgtggacgacgcggaggagggagagggcgccgcggcggcggcggcggcggcggcggcgtcgctactgtttccccgcagcgccgtgctgctcctcacccaccggagcgcggtcatgcgcgcgcgcgcgactggaacaccgagccagcttgcggccgaggggatcgggaatcttctgcgatcgtcagggcgggcgcgcgcggcgtccaagcccgaagcgccggtgaccagcaacaccaggcgtacggccgcgagctccgacgcgatgctcggactccgcgcctgcaggtctgggctccggtactcagcatcggcatcgccaacaccaacggtcctacgttctggattcccttccttgaagccatgggatcgttcgccggttgcctcccaagcagtgcgctgcggggcctcgggaacgtgcccgttgggggacccggagaggtctacatccacgctgcagatgcgcagttttggttgggggcgcccctcgaccgcgatcttcgtagaggttggggaggtcgggtgatcgtcgtcgtccatggagatgacgggcacctcggcgatggtatcgggctcgaccagcggggaggacaccaccgctatttcctccccgtccatttgcatcctcccgatgaggtatggagggatgctccgggtggacctcgccgcggaggagtccgtcatggcggtggcggtcgaggttgcgatcgttttccctgcggcggaggaccagctgcagatcgagtgggcggtggcggtcgaggtggcgatcgtgttccctgcggcggaggacagcgcgcaaatcgtgtgggcggcggcggcgctcgccgcggcggaggagtggccgcggaccgtcaggatggcggcgttgctccccgcggtggatgggctggtgcggtagtcggcggccatcagcaacctattgtgagagaggtaatttcacttcaacatttgcttggtactatgtttgatctcatcatctgaacatttgctcg

SEQ ID NO: 49783 - DNA, 372 bp, Oryza sativa
cacataggacctcaccacgccctccaatctctgttttcatcacgcgatggcacatgggccatgggtccaaagtgcagagttagtaacagaaagatggttcaaagcaataagtgctggcaaaacctattcaagtactccaaaaaggaagtttactcgatacttcaaaatgtcaaaatacaaggacgggatcacgagattgtgggaggaactaccacacatggatgattttttttttttttttaaaaaatctgcacaagatagtgcaaaaatttatattgatatagtcaaataaattataagactgcaacactaaaagcctgtaaccagataaaagaatttttaaaaaacaaaccacctccacttgctagtagc

SEQ ID NO: 49784 - DNA, 1501 bp, Oryza sativa
cccccgaaattacacatgaaattgcaatcttgccccaagggtgcactggaagttactataatacccccataaagttggaaaacctaaggatgtaactatacattcaagtggtctcccagagctactggcgtcagcttgcacgagtgattggagtgatccccacgacatcttctaagagaatattccatgctccatggtgtaatcatcaagctcctttctcccttgtcgaatactccctctatcctagtttgatcatcacataaggtttttaatgtcttcccaaaatgatcatcctctaacaagtgcatcttttttttatttgtgccatgagtaaatgagcatcattgaatgcattgcatgtaaccaaccaagattaatttctattggtccaactacatgcaatatttaaaatttgatacaatacatggaacacgaaatgacgtagcaccttaaccgatgagaattaattacataatgatgaatgttttattatcattggtctctgtgctctttgcttcggtgatgatcaaaatggaatggagggagtagtatttttgtcttgtaacgaattcgaatactactttccaagccggcattcgtgtcatgtccctcggtcatcttctacttgcttgtcacaaagggtcgaaaagtatttgccctaagtaaatatatcctcgattagtattgggataatgttttggtcaaataaggagatggtgtttgtctcttactgaaatacttgtgtgttatgttttttggtcatcaattgtatgcactaactttgttttatatatagggagagagagatgctactaccatgtttttgggtaccgcaagttggaattgaattgataagtttatatgaggttggatgttttggcatcgctatggatgtcaaaaaaaggttttgaggccaaaaaaaggtatacaaacaaaagagaatccaaggataaagttacaccatgtagatatgtttatggaaatgagggtcatcgaggaaaggataaaagagatcatctaataaagtatccttgagctaaaactagatctgattgtcaattacacatgggtgtagtaatggacagaaagacaagaaactatgaaatagctaagttaattttggaacacactcacccttttgtattttcctgaaaccttacacttgatggcattataaagaagaatttcagatttacaagtttttgaaattgaaatagccgatggtgcaggaattgggccaaaggcaacaaatgagttggcaagtcaccaagttggaaccaaatcattcgttgttttattataattagctttcttttgtcattttgcaagcaaacattttggaaccaaatttctttaaatgttcagccctcacatattgaattagcaacaacaacacattttgatgttttttttctgttctgatgtcacaatctcttttgccacactaaattggcacaataatcagtgtcaatctcttcgtatttttaaattgacacaatag

SEQ ID NO: 49785 - DNA, 1501 bp, Oryza sativa
aattggctcgaggtagtaccaaaaccttttactctggccgtaattattcgtgccatccaaaaattaaccatcgtgctccccacagtggagccaagctcctagaaacacatcattgtccgtccaaagaaaatccaacgctccttccacagtcggtgatgctcttgttttgctttgcagttcttcacttctttagcttatataagatgcaaccaaacttgaatttaactgttaattctagattggattagtattttgttgtgggtttgtatttttatgcctttagctaatctcccatgccaccgtgttttccatcaacactataggaccactaaattatataaaaaccttattctaaaatattttttcattgcctatgtatgcagagtataagggcccatgcatttagacgagattttccagccacggaaaataaaaagatcattagcaaacgattaattaattattagctattataattttttaaaataaaaagatgaaaagtaaatttatttggggaatttattttatctttttaaaaactttcatatataaaaagtttttgcacgaaagatatttcaggtagcgtgtccacgaaaatcgagagttcttcaagggtaaatcaaaactcagtgtaaactgcaaaaaaagaattaggaggtgtttgggagatctctccaaaaaataagtcgagggactaaactaacacttccttaggtagtgtttgaatcttctgaagatgaagattaagtatttcacgtaaaacgaggtggtaataacgtgtgattaatcgagttttaattattataaactcgaaaatggattaatctgatattttagaacaacttttatataaaaagttttcgtacgaaacacactgtttagctgtttgaaaagcgtgccacgaaaattcaaaatttaatccacttcttacagtggaaacgaacaggactagtcaatcaattaaaagatactcacatgatgatataagcctctttctaaactaaaatcaaacccatcacctttgttttttccatccaatattctgcaaaaaaaaaaattttgtttgtgccaaatcggattttttttattgatattttagatggttttgcaaaaaaaaattcacaaacaaaagaacttgtgagaggaactacactcttgtggccaggaaaggagggcaagtgtggcaaggctttttgcgtagacacactaggcagacgccaggaatcgctgtcagcgacaagtctgcttttcacgtggcgccgggcccaccgacagcgacactgttccctccagcgctgccgccgttgccttcctccacactacggagtacactactgtcacttttttctctcccgctacttttgcggaatttcccctgcgtttcccacgaatctcccttggctcccctttctgcatcgttcgctgcttgagccagagaaagccaggagtgccatttctagctcaccggccacgtggcccacgtactagagggggaggattt

SEQ ID NO: 49786 - DNA, 1501 bp, Oryza sativa
attaggaggtgggaggggaaggaccgagagcctagattaacagataaattgggttattgaatggacacgttatgttgtatacaatagatagagtggtagcgtaagttaacatttttggattatctggcaaacataattctggtggaattgtcagataatccatatccacgggattttagggacatcacattcgcctcctaatccgtatcaggctcacatatgtacatggatcaaatatacaatccttgatagcttaaaacagtttctacatatttcgagttcgattgctctatgagatatttctcgcaaaacaaattcattgtttcatcttaacaacatttgttactcgatcctgatgctttaggaatatccagaaccacagatacgatactttagcaattttgctatatatttgtcgataaattttctcccaaaaatttgacagatgtaattacagtacaatcgcagtgtaattacactgtaacttgcatgtaattacactgtaactataatgtaacttgtatgtaactttcaaaaatctctccgtaacatgttatttcggtaaaatcgaggtcgtgggaacaaatcttttcacatatgtgtgtactgtgatctttttgttcgtcactagaacaaatcttgtaatagatctaacgattcaaaattacgtgaaagttacatacaagttacattgtagttacatgtaagttacagtgtaattacatataagttacagtgtaattacactatgattgtactataattacatctgtcaaatttttagaagaaaatttgtcgacaaatgtataggtgggtcatgaatcatgaatccataaagcaggcctgttatgggctagccgacccatctcagacatagagcccagtgatggtttatcaagttgtgtcccggtatagaactgctatgctctcgcctgcctctcctccgctctccacaacacttagtaggagtattcctttcattttaaaactgaatgaaacattatatggtacacttagaagtctatccagatttactatattgtatattgtatagtatcttacttaatcgtaggttggtttatttaaaacgaaggaaatatattttaagataaataaagtagtacaatatttcagaccagctcagaacaaaacaaagcatcgttgtctttgtcttgcttggaagttcaaattcctatcctacttttcctatttaaaacttttgacgtttagaatttatataaaaaatagctacctttaaatatttgtagcgatgaaatataaagatacactcgattttacaaccctacccactgaccatagcgatggacaatctaatcttttttatatttcctcttaatctttataaaaagtttaaaaatagttatattatgagaacaagaaagtagaggctcagttttttttggtaaaaatgtctataactatataaacattaaacaagccataattctttatagggagcgttcggcaagttgttggttgt

SEQ ID NO: 49787 - DNA, 1501 bp, Oryza sativa
tatatatctagatcgcacccagctcactttttggccattccacttcagttctttcatcccctaggttgttctagcctctcccaagatccctttgcttcctccactcaaatctagagcctttcttatgaaattgtgagagtagatgagagtgtaggagtaatttggagaagctttgaagactaggtgtggttgagcactttgaatatcttgtgggttgtcactcggggcttattactcttggagatcttctcctagacggataggtgtcgcccgcgagcttccgaaatcttgtggatgtcccaggaaagtttgtgaaggttttcctcacctccgcaaggaaacgaggtaagtgattaaggattcttttgctaagttttcagaggttctcctaggtagagcaacttgcacttgtggtcttttctagaaggatttgtgagttggatcttggtggtcactcaaattctagaaaatgacctaggagtgttgagttgaaggccttggactttctctgggttctctgtacaagtgaggcaaggggttaatcgagacccggctctttggagcacctcaacggagagtaggattgcaagatccgaacttcggtaaaaaatcgcccttgtcttctttgtgatgattctgtgcatgttgttgtgattgtgtatctgctctgtcttcatgcagtttaattcgtgcaaattagtttaagtctttgctagatcttcaggtttttctgttgcccggaagtttcggtgtttagaacaccggaagttccggtctgtctgagtagactggaagttccggtgttcctcacccggaagttccggtcctgctgaattttaccgctatgatttgtttgtgaatttcaggatagcctattcaaaccccctctaggctacatctttgcgcgttcactattaatatgataaactagaaattaattatttttttatagattttccttaaaatatacattgtgctacttaaaaatcaagctcggtagtcgagctcaagcttgatcgagctcgaaccgagtctgtctgaaagctcgaacattttataggctcagatcaagcttggctagagcttgtatcgagctcgagtctaggcaggcgagcttgctcgagctcggctcgttgacagccctagcggccggccagcccaacccatggcagacttgtagcctattaggaaggggaagtggccaggaaaaacgttgttaaccctaggacgtggcatgtgaattttgctgaactttggtctactcaaccgatcgatgttgaagtatcgccaaaatttgtttatattgttcgtcaaacttatcatatcattaatcatcatataacgatattgtgtggagtgtgatgatgtaagaatgaagtaataaagtcattttcatatatagttaaatgtgttattatgccacgctccgctgttttcgacatgaattttcaacttccgaccaatattggcagattccattctgacggtcccgtttccaata

SEQ ID NO: 49788 - DNA, 1321 bp, Oryza sativa
tcctgcagccctcatctggtttaaaaaatgaacaatgcctttgacttttgacacacgtttgatcatgtcgtattaaaaagttttatgcaaatatgtaagtcagcttaatagacctttaatgataaaccatgttgcaacaaaataaattataattatgtaatttttttaataagatgattgatcaaacatgtattaaaaagtaaatgttggcatctgttaaaaaccagagatagcatttttttttggcacaacatagatgggcggtttaacatttcattgtcaagaaataagatgataagtcttagatactgtacaggtcctctaggtaggtgagattctgcagctccgctggtatttgaccaaccacgtccaacttatataccttcctgcccaaacaaaccagtaatattctttttattttaagaactacaagtaatattcatatgtgattattgtagacttttatatgccattcaggccaaatcattgaattaacagtaaaatcccccatttctgctgtcgcgaccgggaaaatcgccttttcccgaacgctagtgtattaatccccgtcccaggaaaagccggggtacaccacacaaacatgatataaaagacacatctttattatatcgataatatttacattattacaaaggcacttcaggcctgacaaacaaaaataaacagcagcggactagcggcctacggctccatcttcacaggcgctcaactggggtataagccaggactccacctaagacatcttctccaaagcttctcttactgaaggggggaaagattgagcaagaatgagtacaaccacagtactcagcaagccacaccggcggatgcatgattaatgcaagggggtacaaggggataataatataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatccta

SEQ ID NO: 49789 - DNA, 586 bp, Oryza sativa
ttctctaagtcaaacttctttaattttgatcaaatttatataacaatatagcaatattttcaacataaaaaactatcaaaatatattcaatgttaaatttaatgaaactaatttagtgctataaatgttgctatgtttttttataaatttggtcaaactttttagaaaattgattttgcaaaagtcaaagcgtaaaatatgaaacggagggagtattatcttctgaacatatgtttgaccattggattaattaaaaaattatataattatcgttatttcattatagcttggttaattttcaaaatatatgttttgtatgacttatatttttatatatttatataaaattttgaataagtcaaatagttaaacatacgtcgaaaagtcgacggcgccatttattaaaaatccaggagtattcatcaactgacaattctcttaattttttttgtcgtaaaataaaattttatttcgtatacacatgtggctataatttataatgtttggttgcacgttctgtacatggacatctatttaacaagcagcgcaatgcttgttttggcagcaatagtgtgagagagagaga

SEQ ID NO: 49790 - DNA, 1501 bp, Oryza sativa; identical to SEQ ID NO: 38348

SEQ ID NO: 49791 - DNA, 1501 bp, Oryza sativa
ataacgacaacccgttatggatgatcccacacctttaacagtctattaacccatcactgataagagtgacgggtacccgatagaaataacaaatcatccctaacgagtttgttttttaacccatcaccaatgtggaaaaaccgattgagcggtcaattgcatgtcatccacacataaaagatcttcaagatatctctcttgctagctagtcagcctctcccttcttgttgctatctcccaccttcaccgtcagcaccaactccaactccaccagccatgccggcaccagctcgatctcgaccggccactgcagcctctagatctgagagttcaggccgctagcctcctcctagggtcaaatatgaagaacaccgtttaagcgtaatagcagatcaaccaacaaaactaatgttggactataataatggattaaatgttattgtggttactaagaacgctatgtggtaaaaaaaaaggggggacacatttaagtatttgccacttcacaaatacgacgtttaacaattgatcactcatgttgtgtctatgaatatggacctaagctagagccctcgtatcttaaacacgtaatgtgaaaaattattaaataccacgttaaaattgataaatacttaaatatcccctgtttggcacccgtcggatagactcgaagcaaaagtgcaaaacagaccaaaccagacgatcagctactttattacatatccaggataacccgatagcatatcatctgaaaaattatactagtaccaatttaccattcctggcatcgacaacgaatgcacgcatgaaataaaggtacatgggctccctaaaaacagacacaatttatggcgattttgacgatacgaagtatctagatttattcggtcggatcacacactgtacgcccctaatcaacgccgaattttcgccatgtcctatattatttcgatgtcgggcaagctgccaatcccaaaccaagattatgctctctccatacaattaactcgatctacaactactctgccgctgcacatgcctgcaaattcgccagtgcgtgtttgatctcgcatcagcaacttgtcctcttccagagcacagatctatctgtcaaatcgcatgtcacccctgcattgctgctgccacttgaccctacacaacaaattatacaattattcatcaaatgatgattcatccatctcatgagtttttttcccttaaacaattgttagcataatcccttgcagaatatatgcgagataatgacgtatcttgttggagcaataaaaaaaattatggccattgttgggtgaagcaaaggttatagcagaacgtgcagccacactagccatgatccatccatgaaccatgatccacaatatatatacgtgtgtgtgatggtggctttgccattgtcatcgtggacactgcaatttgcagctacctctcctaatctctctttgatcaaatcactatcgtgtaattaacgcatagttagcta

SEQ ID NO: 49792 - DNA, 385 bp, Oryza sativa
gcatgtcaatgaggggtagaaacgtcatatcgtatgcgtagctgggtcaataacgatcaagacggacggaaaagttgacggaagtgctaaaaatgggaacatggtaaactttgggtgctattaaagtgaaccggtatttttcggtgctataaaaccaaaaacgtgaacattcaatgctatataaccaattttgccaataaaggtgtccttgtaagaatcaacgtcaagtatcctccataactacaagcatgttatctttattgactattgtataccgtttctatgaaaatattgcattttatgatgctgatctgattgttgtattctaattgttgtgagcgtataatggacattttgtaatataaatgttgaattggattaacca

SEQ ID NO: 49793 - DNA, 1501 bp, Oryza sativa
gttctactggtttgaaacagtagcgatcaacaaactataaagtggcagaatcaataccaggatccatgaaaatatagaccacctcaacacttttgaaccaacattctcatgtgaatatttttattgtatatgcaatagcattaaagatttttaaggttagaaaataaggtaatgatctcacctcgttgctcaaagaagaaatctcctcgactgtagatcaactgacttggatagaagataagcacacgcatcattcagagaaatagtctcaagtttatatctattattggacctgcaaggaaaactgaagaagtattattccacattgggatctagacaacaaccaataacttattaaacacattagcattggaaaagtaacagttttttttcttttttggtttcacatgttgcatttagcaatacatatgagctagtattatggatggttcatacaaataaagtttagaagtaagaaacattggggcaatatttcaatattagcatgaccaatatcaccaccagtaatttccaaaatgcttgaatcacttaacattagatgggtaatactgcataaatattataatccttgttaaaaagaaatagccaatcatgctaggggaattggtagtctatggacctggaataagtttgcacatcaagcataagtaaaaaaaaaaaagaaaaaaagaggtatgattgaaactctaggaagccaaattcaaagatttgacgtagtaagtaccccaggattattgttaaagcatctaaattgcacatctaagatgttccataaagaacatgatcaatgcatacatcagtcattctatcaacaaagaaaaatgacttgttagaaagggatggaagagagcacttgctcatagcgtaaacaccatacctaccagtaactacaattaaataacagaatgagtaatcccatgtcacatatatcactgggagaagacaaaaaaacagaattagtaccttcaaatagaagccacagtagtttgcacgtgagctgatgccattgcttttccgtgggtgattctgcaaccgaatgagcaggagatcaataatagggataaggatagggaaggatccagatcaggtatgtatgcatataacagtagaaaatttattatatagcttagtggtttaagcatgggaaaacagtatataccgaattagaggatcattccatggattcaccgaaggtttagggtcatgctgcagagtgagcaccagtccggactggataaattggatctatgagcttcaggatgaacaggtaaagctaaggattaggagggttaaagggaaaaaaaagggaggcaaaagggctgcataccttaccagggcatggtcgaggcggagatgccgttgaaggctggaccttggtgtgcccaaagccctaatccatgcggatgccgaggcaagagcaggccatagaggccaattcctctagctgcaacggagaggacaataggggcagcggcaacga

SEQ ID NO: 49794 - DNA, 1501 bp, Oryza sativa
ataggcctgttacttaatttatctcgtcatgtgttttacatggtcttttattgaatctttcaatagtctttatttttatcacaaattttaattatttataaattgtattcctaattgaaatcttattttcctttttctaatttcagaatttattttttttctaattttaattaatatcgtattgtgttcttttaatattttttattttttattttcaacttaagtttgtcggtgacatgggaccgagagtatcgtgactagaggcttgggcagccgcggtcacccacgtggcttgaccccctcgagggggtcgggcctgagggtgacatggcctccccgccctctgtctccccgaggggtcgggccgctcccgtttcggccccgagggctggggcgccccgaccccttgtggttttggcgccacgtgtgtgggttaggtgagcacagcggcgcccacctaaccgcatttatagcgggttggacgagcgcgccacgccgcatttaatgcggcgctacgcgctcgcttatccggtccgtgactggtcgcagtgtgtgaccggtcacagaacggtcagatcacgggttaggaggcaacaggcggcctttcacacgcctcgccccgtcccgtcggaatgatgagagactctaggcactcgtccctagccggagccggcgtgctaactcctggagttagcacgtcagttccggctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcagcaaacaaccgtgctcccacgttgcacctgcttccggcagagtggaggttggtatgacccatcccatcggagggtcattcggacagtagccattgcaaatctccgcccattaatgaaggaaggacatggttatcccagtgtcaggcgaaggcacgagccaagttttggtcaaagtagggtgggtccccacccaaaagaaggataggtagaaatggtgcatgtggtatccccttgagatataaaaggaggaccatgcctaccaaggggggacgggagctgagagaggagagaggagagaaagagaaagaggaagagggtttctagagcttgaactctcttactcttcagctctttgtaactccttcacacacagatccaccagaacacaggagtagggtattacgcttctcagcggcccgaacctgtctacatcgcccgtgtcttgtgcatttgctctcttgcgaaacattccacagatcgagggcttagaacctcacctagcgcccccggccgaaccggcaaaggggggcctgcgcggtctcccggtgaggagacccacgctccgtcatctggcgcgccaggtagggggcgcgtgtgtttttctaagccctcatcctctttcgtgtgcgccaagcttctcccgctcagcccaa

SEQ ID NO: 49795 - DNA, 1501 bp, Oryza sativa
gaaaatggtctatttttaaaattagtttttgacacggctcaatatcaaaataagttttttcaaagggtcaatttatcaaaattacgggggagaaacagtcactgtcaaaaagttcagcggcgactactctagacttaaaatctgaataagtaaacggatgtgaatacaataattgagcacagctccataagactcgatccatggttccaaaaggtgtcatgtccattttcttccgattaaaggattttttttaaattgaccaaagatttctcaaagctaatatttatcaattaaccaaacaaaacaattttttagataaaagaaccaaaaacatactcctactactcatctagtgtcattttaagtaaggaaatagcctgtctattctagtatatccacttctctggcaattttaaactgacattaagattgacgcggcattgttataggcggacgcgcattatcacaaatagaaaaggcaaccgaccttgacttgtggccaaaacttcagagctggtcttaaatcttaattaggaataaaaataacatttaacatgatgaaagagaatatgatgagaaaaaattacttcacttgcccatggtgacaaaaatacccattctgatatgagaaaaaacaaaggaaaaaaaaaagagagttttggattcatatggattcgtgactgtaacaccgttcggttcaaaggaattgatctcttacagaaacccaagaaaaatcatgtggattctactagaaacaaagaaaaaaaaattcatgcactctgacatgtctttatttcatttcttacgtttttttctttgcttttgctttgtttgacgcatgttttacaattctatttagaattcatatgtttgttttgcatatgctcttatcttttcttttcctattttgacttttttttagtcctataatccaaaaagcccggaattggatcgacatccctaggctttagttcgaatatgagatatatgtaaaagttccaaatatatctacctggtttaaaatttcggacaagtcaactgttttaaatacgtgaatggaaaatatcttttgctttgacatgaagatattgcaccgttcgtttgttttgcagaatttgctttcattataagtagcctcaacattctgtacccatatcatctgcaccctggcagccaatccaacggccatcctccatccgacggccgaaccgacttaaaaaggatggcgtaatcaccgtccaaaatctcgaattaaataaatcctccaaataaaccaatctccaatttttaatcgctatctataactcttcctttttcgtttctaccgcgtagtcagttccccccttttgagatatttaaccatttgccacatttagatgtgacaattaactttttgccattggacccatatgtcatagacatatgtagacccacatgtcattgagataggggtggcaaatagttatttgctaaaactaaccgtggcaaatagttaaaagcc

SEQ ID NO: 49796 - DNA, 1501 bp, Oryza sativa
ttaaaggttgccgtgcagtacagacccaaggttcttcagtaaccaaacgggctagtacatctgcgtcacgagcggtccgacgaaacatctgtgagcaatactgaactgtgctgaatcaattattgtccagtcttccgtccccatctgtctattcttagctcagaaagtatcctctttaataatctgataatcttgtagtactaagcttgttgattgtgaatgtgctgcagatatttaggtccattctttttttagtggatttatgttggttctaaagatacgctgaacctccctcttaacctggacctagtcctaagagcaaagttaatagtatagccaactactagctacaattcatctataactaatctaatagttaattcatacaatagttgcttactatactattagtatatagtcccactgtcatatacacattatgtcttggagtccgtgctgcagcgggctacagaagctgttcttctctctcatcttttatcttattaaaatatgtttgtagctggctaatagtatgctattgtacctgctctaagagcacccgcaatggtaaagtaaggtgctctctataaaacatgtatatctcagtaatagattagattaatagtaaaccacctcaatagtatttctacatgggtatctatagctctctcatccattgtcttgtttttctctatagactctccaggttagtagatagctttactctctctctccatttaatctcttacaagtaggaaaatacgattatcttttatagagagcatatagataaccattgcgggtgctctaataacactagctaagcgcaaactccgagttatccatttcgcagcatttaccttgacggagtggacctgaaacgctaaacgcatgagcaaacgtgtacggaactcctttggtcaatcgttggattatccatctgaaactccttttgttttcgccgggatacccgtatgaaactcctgcatccgtcgccttcattcgcaccggtgataccgtactcatttggccggcagaccaaacatagtggattagtggacacttatgtgttgagaataccgtgccggtcctttgcgaaagcacatgtaacgcctaggaaagcaaggagcagaagcaatctgcttgtcttgtgtgcgacaacgaggccagtgcgttgtcctcgcaccaagcgaccgcctcgccgccgattgttccgtgcgacgccacaccgaaaccgaaccgggacaacctatttaatctttcaacaaatttaaaccttcaaatcttgaaaagttttcaaccaatggatgcaattcattttaaataaaataattaaaaagcatatcaaaaataataaatctagatataaaaagagttgtataatctaattccactatacttacgtagataaaacactgttttacgtaaaacgatatggcattaatgtataattaatagagttttaattatcataaccttaaaaatttatttatagcaactt

SEQ ID NO: 49797 - DNA, 1501 bp, Oryza sativa
gtgcaatgtgcgcggagaaaagaaatgcatggctgtgcttgatgtcgaccattgacgatgacccacctaccgtgtatgaacaatcgcggaaatagaggataattagagataagggtagacaaacttggatggaccatgatcccgaacaacacttggcattttggcaatgatattagggcccacatgttaatgagcagtattgtagtatgtattgtagtatatctctgtttccctattttgccaattccttttatctttgtcggttatgtttctataaaccggttgagtagataagggaggtttcgtgtctatatgtactccgcaccgatatcaatccaattttgtgttgagtctattccgcttttatggtatcagatttttttcgatctaccgctctaagcctaactccaccaacaccgccatgtcgacggctacctcccccctcttgccagagtccctcgtcaacgttgtttccacgtccgttgccgacgccgtccgcgcgtcttaccaagccctgcccggctcgacaattgatgacgccatggccaagacggtcaccgactccgccgctgatcgacagggcatccgccgccgacccgccgtacatgctgccctcaaacagcacctgccggcgctctccatagcgcccaccgccacctcgtctctccccaccatggacatcgctccttaattatctctctcggttctgtttctataaaccggttgagtggataatggaggtttcatatgtactccgcgccaatatcaatccaattttgtgttgagtctattccactttcagtttggttcatgagatgcattaagtctgaaaagtaatatttcttgaatataatataagggttggccttatctttaaaaaaaactagtggatcaatccagcccatttttctctatcactaacatgtgaaccgtcacttaaaaagtaggtcattttatctctcataccaaacggataaatgcgatcttcctattttcgaaatatggatgagttcaaccaatctcatctcgttctgaaatcaaatacctctgtgtaaaaaaaaaagcggccgctgtattttttcagtagatgaaggagaaaaagaaattcggaattctgaacgttcgtgtgtgatttgactgatttatcatctgaaatatctgaatgaataatgattaggatttctggaggaaacgaagaaacgagcgagcagaaaatgagtgaaaaggaacgaacacaaacgctgaccatcctctgctgcgtgtgtaaaactgcagccctgtccaacaaagcggccggccgcgtcgtccaaaagactgatcgctcatcgatccgtcacatgcaagttgccaaccatgcggtgaaatggtgatggttctctataaaaagagacccttccaacctcaccctgtcaattgtgcagcgagacaccgatagctagctaactaatcttccccttcgtctccggcattattccacttggacgaacactagctcaccggc

SEQ ID NO: 49798 - DNA, 1501 bp, Oryza sativa
tagaaatatatgaaattcatcatttcaatgataaaggataaagtagagataaaatttataaatattacatgtcttatgcatattaactatgcgtatacacgccacatcctaatcaacatcaactttataaaattaacattgtcaagttattttggtcctcgttcgcatgaactagacaagtttgtgtactgaaaacgagcattttataagtttatatactaaattgcacccacctaacaagtttgtataccaccaatacaatttactcttaatttaacaacagtaatctcctccttatacaaagaatctgccagacaaacgtaagagttgaatcattttttgaaaggactttactaccaggacttagcctagtaatgtattttcgtaaaataaaagacttatttacaaagttcgaagcagatacaggaattagaaagtttgtaaccatgaaaaaactatatgcttaagatgtcattcattttgcacgtatgcaaaagaataagagttgaatcaatatttaataacgatcaatttacaattatatcacacaatcaagtgagttgtattggatttggatcctactacatatgccttgtttagttccaaaaattttttacctaaaaacgccacatcaaatctttggacacatgcatagaacattaaatatagataaaaaactaattgtacaatttgcataaaaattgcaagacgaatcttttaagtctaattaatccatgattagtcataaagtgttacagtaatctacatgtgctaatgacagtttaattaggcttaataaattcatctcgaggtttccaggcgagttatgaaattagtttttttatttgtgtctgaaattcccttccgatatctagtcaaacgtctgatatgacaacaaaaaattttctttttgcgaactaaacgcacccttagctcaaatttcaaaacgagatgatttttggttgatacgagagcagcgtgcatgatatccttgcgtttcattcgtgcgttggaatgctgtgtgtgaatcaatataattccgttgaacggtcttgcttgtgctttggataagataacgacctttgacgacgacccaccaaaccatgcatgcatgaacatgagcacttgctcccacacgcatgggctgcatttcgcctcttaaattaatcaaaacagtcgacttctcaaccttgcgcgtatgctttatccaaaaatgcgagaagagaatgcgcgttgactggacaggctcctgctcctgtccaacttagcggccagtagtccccagctgcagctagtactcatggagtggtcgtcatgaaactctcagtataaaaggaccctgcagcctgatcccctgtcaatacaaccagctgcacgcccattcgtctcaaacacacattctttgattcttccttcaatttccccttttcaactctgtcatcaacttaattgttagaagcgacctaaagattttgcggccgatcgagcatggcgtcccctt

SEQ ID NO: 49799 - DNA, 1501 bp, Oryza sativa
gtccttatatggccgaggtgctactatcaaaaccatgcaccccgagcccagcctaaaaccatttttggggattttgaatagagggggcggtgtgaatccaattccacaataaccaaaccattccatggtgtccaggtgatatgaatattcccaaagtctagagttgtaaaaccgcctaatgttacctaattaaaagcgaagcatctacctaaaatcatactagtgggaccatgagtagagtgtccactagttggggttttgtttatgctagggtgaacaaggaaataataacaataacaataataaggtcataacaaaggtaaatgggcatggctaaataaaacagtgataacgcgggaatttaaataaagcgataatgcaataatttgaatcaacataattttataaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgtgtcagccgggagagaggagcgcgcggaccgggtccacgggagtggggcccactcggcagcctctcggtccacggtggaccgggtgcacgcggcttacgccggccggcgccgtgggtcccacgcgtcagccgtacccgagggcgcggccggctgacggccgggccccacatggcagccgcggggcgcgcccgaaggcggcctcgccggcacggccgacggggaggcggcgcgcccgcgccccgatggtcgccggcggcgaccaccagcgcggcggagcggcgcccgagagaggggagggaagggggaagtgaaacggcggtccacggctcaccccgggtcgacggcgacgacggaaacggcgaccggagtggaggaaggcggcggcgcggctcgggtagacgaggacggcggcgttccggcggtcggtgagcgaaacggaggggtggacgaggtcggcgaggtcgcggcgaacccgaagaaggcgatgccgaagcgggagaaggtccggggcgacgacggcggcgaaccggagctcggcggcgacggcggagagggaggacgacggcgcgagctcgattccgacggggagagagagcggcgagtggcggaaaaggaggagggaggcacggggagtgtttaaatagcgttgggagggggagagagcggccggatgagggggaatcggccgcggaagatccggccgccattgatgcgccggcgaagtttgcgggagtgtttccaaacgaatccgagggagagt

SEQ ID NO: 49800 - DNA, 1501 bp, Oryza sativa
cgacgtggctgctctcactgggttcattgcttatggagcacaagtaacagtgccgacacctcgaactgtgtcaaagcatttggtctttgcaataatgctgtcatggaaaaaggaatcattcgcgacagcaaagcatctgagccctgtcaactgtatgttgtaactgttcgtttagctgcttgtgtattgtgcaactatggcattttgctgcctgcttcagttgtcttactgaaagatagagttaaaaggattagagccttgccttgcatctgccaccatccttgatggtacggtgttactccttacccggaaaagaagttttccctccctttttttccatgtcagatgacatccgatatgtaatttatcatcccctccgccttccacccttagcaagcatatgtgctgatatctttctttgcctaaggattctctctctttgtagccttacttgactttgtataagctgccataatttagtagtggaaaaagtatcaggaatgttttcgtaggctttgtcgcgagattcgactggcaagaaaactggcattctttcttgattttaccgaaagatttcagccattgtggtggatatttttcttgaaatattcaggttgacctgtccatctggtttcaaccagtgtggtggagacttttcttgattgaaattttcaggttggcctgcatgctgcacattagtttatttctgttgctgccgtagagttcgatcgttacaatgaaaccctgcatcataagggacttccatactgtcattacaatgaaggctatctgtgtgaaaataatgcaagattttaagtgctcatgaattcacttttacaagatgtagttactactgcagctcgtttggttcggataaaatgacttcagcttcttggtgagttaacaaagttacaggttacagttatctcacaaagacgcgagcctttctgacaggcagctgggctgatcatgccaagataagcgatctattgttctgatttagttataaaacctgttttttcttcaatcctatttatgtcttgtacgacctgtttttctagtagaaacccgctaaattattacaagtttcacaaggttctcaaagcttgagaactgaataaactgaaaatgggaaaacagcttgggaaaaaactaccaaaatgagaatgctgaatccacatactcaaccttttattaccaagctaaaagtaacaccacatagacataataaaattgatgtggaagagtgtatcatattccatattctggttgcacaaactgcccaaacctatcaaatagtatctaaatgaaaacagaaaaaaaaatctccttaaaatcaaatagggattgggccacagttggaccaaaagtagacaaattatacacggctaggcctacaaactcacaaagaatagtccaaataatttctttcgatgggcttaaagtgatcaagttcgtggtactaatttgcagggtcactatccaaagttgtctgcaaaca

SEQ ID NO: 49801 - DNA, 1501 bp, Oryza sativa
ggtggccatccaggctcgtcgacgaataattcattaaaattctatgtagttaaagaaaataaaataaaaactttatagcaaatatactatatatagttaagtttgcttgtgctctagaatttttatgggtccacaactataggatctgccaccagatcgagccatcctgtagctgattaatgttcttctctgtagaaaaaaggatcaagtgagctccatgtttatgagccctagctaatatttttttgaagtatttctcaagcacacatataatatgtgcatgaatgtagttgggtggaggaattatgctcacatggaacaggcaagctgagatcatgatattccatccatcctaagccttacaggtgtaccacgtactcttgttgtattattatgaatcgtaatttaataataatcagagttggttggatgctaagcctctatgttactgtcaccaattaatctggattactcgtacatagattaacttaagcctctagttaaataatcaccaactaacctcttccttcattgcatcaatggatggattgctatccttttcattggatatattcagaatccccagtttgatcttcattggaaggttccattcatttgatggctagcgaccaacaaaggtcattgctgatttcaaccttaataataatatagtttagaatatatatgagtagcatgagtcaattgtgccaaaagcaaattaaggccatatgttggttggtaggtagagtagtacacaggtacaaaactaatgttggagtagatcattagctctaattgtgagctaataaaaaaccacatgccaactctattgtcccttgctaaccaagtaaagttgcaaagtatcttgagaacttgggccaatagaaaagccccaacgtgaagcatcggttgtattttgtatagtttgattgcaaaaggttgaagatttggttcaaaaaggttgatacatttccacacaaagagatagttactttcagttttgccaaatacaccatagattttttttttctgaaacataatagtcgattttgaactaattgtatgtactaaggaacggaaattagactgaccaaaatgtacatatataattataaagaagtactccctacttcccataatatagcaacataggattggatatgacgtaatctagtattacgaatcaagccagattcttagcagcaagatacgtactatctgattttagattgctatattataggaaggaggaagttaaaaattaagatgaaccgaaacaaatgggctatggtgtcttgcaaaaggcttgcctcttttagatgagtcgatcgaggacgaaagttattcgagcaacagtcacacaattatgatctagctattattcattgattgtcttaaatacagtaaacacgcacatgcatcatgcaccaatatatactgtaagtatagcatacatctatgattaattaagtgaaaatgatgtgctccacacatgtactga

SEQ ID NO: 49802 - DNA, 1501 bp, Oryza sativa
agatatttttgtccttctatctcatgactaaaagagtggaatatgtttgaaagaagttctgcttcgttaccatgtgacatcaattaatatgctgagcagcactatacagtctctctgtatctaaacatatgcaaaccttgtttaacattggttcatatatatatatatatatatataaactttttctgcatccaattctgattgtggccattagattctacttccaactatggttgatgctatccatgaatcctaattggcgcgtacgcaccggcggcgcgcacgcgccagcccacacggcccaatgggcggcaagacacggttagtttttcttttttccgaatttttccatatatgtgtaaactttcaacctagatttgaatactttcaactccgacttgaaaactttcaactccgatttgaaaactttcaacttcgacttgaaaactttcaactcatatttgaaaactttcaactcagatttaaaaattttcaactcgagattcaaaaactttcaactcgagatttgaaaactttcaactcaagatttgaaaactttcaagtacagatttgaaattttttaagttaagatttgaaaaaaatatgaaaactttcgactcaagatttaaaaactttcatcccagatttgaaaactttcgactccgattcgaaaactttcgactcaagatttgaaaactttcaactcatatttaaaaactttcaaatcgagatttgaaaactttcaactcaaaacatttttttaaaaaaataagtgtgctaaagattaaaaaaagtaataaaaaaagggaaaaaaaagcgaaaaaaatcgcaaaagaaaaacgaaaaaaaatcgcgaaaaaaagaaaaatagggctgatgggccgggagcaactggcgcgcgcgcgccagctagcaacccctgatgctatccctgtccaaggtgtaaggaacatatatgtatgagtaatttgcttcacctgccacataacaaatgagcgctaagtacaattactatataagatataattagaacgaaaattgcttaatatataactagaaagaagattgctttggttggctacgcaagcatgccaacgagagagcagaccagcacgtcagagcttgggctttggatatgggctcaacaggggagcgatccgtttcatcgctaaaaaaacgttagaagttaggagagaaacgtttcatcgtacaaacgtcgtataaaaacaatcgtatgtatagcagtgctgtatatgacagggagatctctccttttatggggtagatgactagatgcggattagtctcaattttgctatcatatttaattttcttaaaaaagtacatgttgtggaaaaatgggatttattctcgtctttccttttatctataaacggactcatcgaatgcatgacttttgcttttgttaataagctttaggtacgtatatatgttcttcgcaaaaggacatgctatgattcattaagtaatgctatctttg

SEQ ID NO: 49803 - DNA, 198 bp, Oryza sativa
cacccaccattccagggcagatccaaccgagggagagcatccttgctgcccttctccaccgtttctccatcgccggccgcgaagaagacgatagccacattcgttaatgagccgcggtcgtttcctcttcttttgcgttccaaaacctactctcaatgccatctctatttcatctaatttcatcccattctatgcagt

SEQ ID NO: 49804 - DNA, 546 bp, Oryza sativa
tttgtgttgattaatgatgattgcttgattggggttcgctgctacagtaaatcgggttttgctagaggatttggaagaacataggacgagtgtgattcttgatcactccactttgttgttgattatagttcttgtctgaatttcttgtcatataagttctgcaggaattttgttctatccagtcacttcttaattcagttcttgtttacctccttactatccatgaattctcatacccagttagaatttatatatgttgtttctgaatttatatatgcaaacattgtgctttgcagtttcttgatagcataacacgaggccaatcgatacgccatgttttctatgctcctgaaaattgcaatcagaaacaagcgtcatttgtatcagtagtaacatgcttattgtcatcttagcagatgcaattgacaaacctgaaggatcttttgtgatgttcctgacattaaaatgctaaggataggcttttctgttactcttctgactacatagcattccctgataagaactcttgttgaattttcacagagc

SEQ ID NO: 49805 - DNA, 241 bp, Oryza sativa
attcctgcagcccttaaaaccgatcaaacacggatgacggaccacagaaacatcttgacacatcaatacattaaaaccgactaaaacacggataaacggaccgcggaaacatcttcaatttttataatagtagagatataacacgtggggcttgtgagtttatctcctattaggattcaaaattggttttaacctatgacaaaaccaacttaattatctctttctttattttcttcttaga

SEQ ID NO: 49806 - DNA, 1501 bp, Oryza sativa
cacccccagccaacacctccaaaggcctcctcgccgctaccctttggggacctccccaagcaagctcgagctccaatgggcaggatcgatgaggcgccgctccaaattcatcgcaagacacaacagagagaaagagatgggtgagagatatgacgagtgggtcctatagattttttgattggtttgccacgttggtgtcatgtgtgctagctctagctaaaaccgcctaaaagtaccagggggttatttatccggtttgaaaagttagaggtgtcaagtatccgttttttagattaagcagtaacttgtactgctgcaatagttcagagggtaattcgaacgttttccttctttaaaagtcacaaagttgtttggctttgtatcgcaaacatcattacaatttcactcttttaccacagcacggagtgaaatatcaaaattgccccctagtcttcctcgtcctcctcatttctcctctcctatctccaaatgtatgcatgttccgtatggatcctaccatttgtaatcttatatgcacttcgagaaaatataatgtctgaaatttattcaccttgctttttttgcaaagttacaacaagaaagcagtccaagagctcatacattctatcactgttgcaactcagaaaactccaaaagagtgtctgctagatgtaaagccgacctacaagtgtaattgtcaagcatgtaactcaggaggttccaaatttcaaacatagcaaatcctaaccaaaatagtcaaatataattgacaggttaatgtatgttacataggcgtgaaaccatgaaactaggtggtggctgatcccagagcagagcaacctcttgaatgttccttcaacataatgaacttcaaaatggtaattcgatgttcttaaggccaatctcttgaaatgtaaacaagagtttggtcaagtaggatatgaaaaaggaaagctaatagcctaatacaacttgaacactgtcagctcaagtgctaaagcaataagacatgatatgtgcagggaacagatcaagacagctcatctgctttgcacatatcgatggttgaagcatggatcaccatatcagaacttagatcacctacagttctaccatggaagtcgactgacacagaagtgagaatccaccatgaattgatatctaagtaagcatcagatgctaaggcccgatactaaccttacccctgcaatatatatctcgcctcccgtgtctctttttaacagtggaatccggcactacaggcattttcccaaaacaagatgcattgtaagcatctgcaagcccatgaaccatgtccttatgagtatcaatgtatctcgcaacgaaatcggcctcaccttgcatgattaaaccatataaggaagcacctttcttcatcaaccccctcgcccgcagtatctccatgacagaatgccgtggcaccatacgcttctcaaggctgtacctgagaatcccaaggcactccacaatgcactctagc

SEQ ID NO: 49807 - DNA, 1501 bp, Oryza sativa
cataagaagatccaaacacaaatcttgaaatgaattgatttttaaatatatatggtaaatttctaaatttcttttatgacggttagcatatctgaaaataaattccctacaatattttgcatgttaacaaataaataagttacgttcatcaacctaacacgacaaccattctagagatgttttagatacatgttaaattatgtgacaaaatatgaataaaatattacatgtttatttattgctaatttcttgatttataataatctatttgttatttaaaaatgctcaaattatgttgttatcaagttgtgtgctagtgcaaccacctatgcctagcctatcgttccctcttcttgatcccatctcatgacatcatttgctctaacggtatcatgacgaaaaactttacctccacacgtcagcattggtgtacccctctaactacacccttctctgcctttctccctttactctccttttcattctcctctatgttgtcatcaccatcctttttatcaactttagtgagttttatctcgccttgccttagatggcttacgtaatcggatccgccacgccatcccgtgctcctaaccatattgtctctcttgtccttatcaccgaccatactcatcatctatcgcccccactcattttgctagattttttgttctcattgtaatccttctaactcaccgcttatctactctctcacgctgtcatctaaactgaaaatctaatctaaccatttttactcaccgtacctgaaaagacacccctatcataaactcataataaagttatcgtcgcagttacaccattaagggtatgtttagttccaaagtttttttttccaaacttccaactttctatcacatcaaacctttcatacatatacaacttttcaatcatatcgtctccaatttcaaccaaattctaaactttgggccaatctaaacacagcctaaaaacaaatttaacaatatagtaactctaactcctagctccccgttgttacatcatcttattatactcgctctaatagcgagccctcccttcgtctcatggtctcatatctcccttttatatacaacaacagctttgatcaatcaatccatcaactcaggttaatttggttagtactaggaacaaacaaacaaaaaaaaaggtgaaatttttactgctgttttggtaaagtgggttttggtaggcaactaggcatactgctaactgctctcctctcctgctacctccacgttctcctctcctcttctcccttcttcccttcttcctcctcctcctccagatccaccctccgccgccctcatttcgcagccgcgggtttggattaccgtgaaatgagctttcttctcctctctgaaaaggtcagtttggtggtggaaagattggattttgattcccccgattcgcttcccctccggaaagattcaaccttgtcagctctccatccctcaacgaggcagtactaggagctatcaat

SEQ ID NO: 49808 - DNA, 463 bp, Oryza sativa
ttttttctttcttttctatgtggtatataagggtagaatggtcatttcattcataccgttgcatgtgaggatgacttggcatgctcacgtgacactttttgtgggtctaaggactatattaacccaaatgattaatttggaggacttgtttggacgatttgaaacttcaaggactaaactgagcccaaagagaaacttcagggaccatattagctattcaccctaaaagatttatctcgcaaattagtcacaatttgtaccattaattatttttagcttatatttaatacttatatacgtattaaaagttggatgcgacaggccgaaaaactttggggtggtatttaaacagggctagcgaaagatcggtttgactgctcctagcggctctctctctctctctctctctcccctcttttttaagcagccgcctttccccggcggccggcggccggcgacgcca

SEQ ID NO: 49809 - DNA, 1501 bp, Oryza sativa
tgtcaaaagcaaattaaggccatatgttggttggttggtagagtagtacacaggtacaaattgaaactaatgtattcactagatcattagctctgattgtgggtaattgagaccacatgctaactctagcttgtcccttgctaagcaagtaaagttgcattgttgcaaaatagtatcttgagaacttgggcctttagaaaagcctcgacgtgaagcatctgttgtattttgtataatcggttgcataaggttgcagattttggttcaaaaggttgatacatttccacacaaagagatagttactttttggttaattttgccaagcacacaatagattttttttctgaagcataaggaacttttaatttatactcggttctaaggagatgaaggattgattttaactaattgtataactgtatagttgaggaaaaaaaatcagaccaaccaaaagtacataattgtttttactactgtaaaaacactacacgtcgtcacatccctccctctcacattacacgcacaaccacaccatactcgagaaaaccattaaaaaattaaaatgttggttaaaaagaaaaatagaaaaaaatgagttggttcagaaaaccattaaaaaaatcaaattgttggttagaaagaaaaatagaaaaaaaaagagttggtttaaaaaataagttggatcttgtcctagtatatgagtcatctgttgcaatgcatgagcatggtattatatatattgaagatgtaaaaatcatcgagataatcgaaactaggttttgacgtctcgcaaaaggattgttcgttatagatgaattgaggatgaaagttattcgaccatcagtcccacgaatttggtctaagctattatacatcggattgtcttagatacagtaaacacacacatgcaccaacattgcaagtatagtactctctccgtttcaaaatatttgacaccgttgactttttagcacatgtttgaccgttcgtcttattaaaaaaaattgtgaaatatgtgaaactatatgtgtacatgaaagtatatttaacaatgaatcaaatgatatgaaaagaataaataattacttaaattttttgaataagacgaatggtcaaacaagtacttaaaaagttaacggtgtcaaacattttgaaacggagggagtatacagctacgattaattaagtgaaaacgatgtgctccacacatgtactactgatgaatatatcaggcaacaagcattgtttgctactaaacacacaaaaattggagggagctatagtagtaatcaacagcaatcctgataaacaaatgaaagtgttggcaaccttttgtgacaagttgacaagcacgatcgcaacacctaaacgtcttgcggtgatcctagagtcgccaatcacctcaatctagcaaaagctaaatcgagatgggttttgatagataaccggctagcggagccgactctaaataactacccgtctcgtgggtaaaacagaagtt

SEQ ID NO: 49810 - DNA, 1501 bp, Oryza sativa
tttggttttccctaccatttacccccctctggtaggcttggttacttgtgttcgatcctataccaacacttctccccctcttccttcttggttctacaccggcaaactgagtgcaaaaaatgcaaaggggacactgatgctcggacagtggaacggcgaaattgctaatgggtgcacgactcgcgcgcgtttccggcccaagcctcacgcgcggcccacatcctcatccgcgtatgcgcgagatgcttatcggtgcatggcgctaagcccacaccggcccacagaagcggaagcaagcacgtctgacttgtttttgtctttctcttttctatctcacgtgattagcttcatatcatttatatacacggtgtatgaaaaaaaattgaaattcgaatgaactttatactgaaaatttaaaactttcaatttaaatttgaaaacttttaagtcaagatttgaaaactttcaatttaaatttgaaaactttcagtcaagatttgaaaattttcaactcaaatttgaaaactttcaattgaaatttttaaactttcaactcaagataaaaaacttttgaagtcaaaatttgaaaactttcaactcaaattcgaaaactttcaactaaacattgaaaactttcaattcgtattttaaaattttcaacccaactattttatttatcatttcattaaaaaaatcaattagtataaaccgctaaagattagcactaacacatattttagcggaaggctcggaaggtgctcgcgtgggactgggagcaagtgcgcgtctgcgcgactttgcttggcggcgcttacgcgcctattagcatcacccgtggaacggtggcaataacaacaagaagagatccccataggtgccaatttggtatgactttacgcagttttcataacccatacatatgaatctgacagttatcactcaagtatcaagattttataatccgatccaactaacagtagctcaactagtacacataatacatatcatagagtaccatgaaataactcaagtatcaataagattcactactggaaaaaggatcttcaatcatgcttcgtaaccccgactacgaatccaggactatgtccatctttagtcctggttaaaataaccaggatcaaaaatggatttttgtcccggttggtattataccatctttagtcccggttggtattaactatagttttttttcattttattttattgcattcatattgatttcactacatccccaaatcatccccaaattgtgaaatccccaaaccatctctaaatcacagatcaaatacatcacaaattctaaaaaaaaacatcacaaatacatcacagataacttcacatattcaatacatcacaaattctaaaaacaaatacatctcaaatcctcgaaaaaaaattcttcgtcgtcgcgccaccaccgccaccccgcccggccgttgccgcctcccctcccgccggatctggcggaggggagggagag

SEQ ID NO: 49811 - DNA, 1077 bp, Oryza sativa
agttttagacttggtacggatgctcgtatttaaggccaatttattgtgtttctcaaaaggaaaataatttagtctcgttggtacgcacgatagaaaaaacacacaagaacagaaaaaacgcaagaatgaaagtagtatgtgttttttttttcaattctacagggatcataaacatagagaagttgaagagcagcctttgattgaaaccaagataaaaaaaaattgaacaaacaaagttcccaaagagatatgatctcttgcttcttttttacatggaattggaccataggaatacaatcacatgaatatttcctaccttttcttaagaaccaaaggagcatataggaaaaacaatccttagaaaattaaatctcaaaaaatactttgccaatcctccatttcaaagggcccttgaagtttttcctctacaaagaaagtcaacaaagatatatttgggagcctatttggtcacagtcatcaatagtaggcttcaggacttttgaaaacgataaattctagtactgaacagcatcttacgcacgcagatacctggaattggggcgcaggattggaatttcagaaatatcatgcaatcatgctctaatgatcaaatgcaactagaacaagttaatacttgaaaatcctcatgatattcaagtatatcttgatatcccccctttggaaaagtcaaatacagctcaacatcatctcctcgctgcagtgtttctattcaagaagtaaaagggtcaactactgaaaaagaaagcaaggaaaaggtaagaaacttgcaaacttggcgtccatttctcctgcgcgtccaagattttcagctggcacaatagaaattgacctgcaagaattggccttttctcctttttgttatatgagttcattcataatttctcatcttgaacttcagtgcaacccattgtgttagtttgagactaaaatttatattcacgcaaagatgctgaaaatttgttgtgttagtattggcgaactggcgctctcattcatacagcatcatggcatattggcatgcatagtttgaacacaatatttacttcacagacgaat

SEQ ID NO: 49812 - DNA, 490 bp, Oryza sativa
caatttttataaccgactcaaacacggattacgtcccgcggaaacatctacaatttttataatagtagaggagatatagattaaaaccaaaacataaaattaaaaccaactcaaacacggataatggaccgcggaaacatcttcaatttttataatagtagaggagatgtggtgatagctgcttgtttctttacaatttatcatcaaatcacaacacatatatcaggtgattagagcaaaaggtggtgcaacataaattacgattaaaaaatggtaacagtaaaaacagtaagttatgtaaaaaatgttcctttctgtttcctgcctatcagataattgcataacctactcttgcttgtaactgaaatcatggcacacttgatgaggcgagttttgaaaaagattattttgtttctatgacctagctcatatgttttgtgaaatctgcattcattaattctatatggtttatgtcctgaattgatttagc

SEQ ID NO: 49813 - DNA, 231 bp, Oryza sativa
ttattttggccgcagagcaatgcattgtctagtgtggagtgttgcattagtttatcacacgtcttattgtttactccgacgaaaacaactttatgctgtatgtgtcttactcgcatatctgttttgaaatcgtgttggaacatatagtcaggtttctcttgctgagagtttaattacggctgcttgcttcgtgccctggaaaactcgcctgactcaggtgcaactctcagg

SEQ ID NO: 49814 - DNA, 1501 bp, Oryza sativa
cttacatgggccccacataatatttttatttttattttgctgactaggatgccacatcattaaaagcaggcatctatattgctgtgggatccaaattgcacggttgtgtacagtttagaggtaaaaaaaacacgatgtaaaagtccaggaactgacaggtgggcttattgctaattactactaggaataagtccactttacctccctcaactcatggccgtgtatgaatatcatccctcaaccgcaaaaccgggtataacccatcccccaactctgaaaaccgttacaaatcaactccccggacggttttggaggcggtcttgtcctacgtagcaattgacttgcttacgtggcagttgatttgctgagtcatcaaacgggacccacatgtcagcagtctccacctcatctcttcccctctttctctttcatatcttccacctctcaccttctatcagcagggcggcgacgacggcgcacgggggacgagctcgtcggttggccacgccgcgcgcgggggagtggcccggctcgagcacgcagaggaggcgggaggacgccggggcattgtctgagagggggtcgtggaggacgaggcagcccctccaagtcgccggccatctgcgcgtgtggaggatctcgccggcagggcttgcgcggggaggatctcgtcggccggccacgcgcgggggagaagctcgccggccggccgcgcgcggggaggatcttgccgggcgtccttgcgcgtgggaggagctcggcggccgtccgcgcgcggggaaatagctcggcggccgtccgcgcgcgggagaagctcgccgtccgtccgagaaggaagccactggggatgtcgccgagggccgggttgtgctgcagcatgaggacggagaggctccggcacggggacgacggcggcattgccagcagctgcgtatggcggacacccgctccgcgtcgcgcgcacgctagaagaactccgctagcttgtttgctgtttgctcgtgttcttcgacgatttcgtggtctctaatttgttttgttcgttctcctttcttgtttcgcgtgatcaccggcgtcttctctgaattcggcaaccatcatgtgctacttgtcttgccgttgatcttgctgctcgattctatcgcctcgcctccgcttcttgatttttttcctttcccgtttcttgaagggaatcatggtgagggagaagatgagatgaggtggagaccgctgacatgtgggtcctgcttgatgactcagcaagtcaactgccatataagcaagtcaattgccacataggataaaaccgcttccaaaaccgtccgggaagttgatttgcaacggttttcggagttgggggatgggttatagccggttttgcggttgagggatgctattcatacacggccataagttgagggaggaaaagtgaacttattccttactactactaggaaggaaggaaagggaccgtgtccgtttggtgttgggtaatccagcc

SEQ ID NO: 49815 - DNA, 1501 bp, Oryza sativa
ttaatattgcagataatatcagttttgagctgtaaatttgtagtcgccagaggcatggaacaaatttacattgtaatagtcctctctaatactccctccgttttaaaatgtttgacaccgttgactttgtagtacgtgtttgaccattcgtcttattcaaaaaattaagtaattatttattcttttcatatcatttgattcagtgttaaatatactttaatgtacacatatagttttacatatttcacaaaatttgtttaataagacgaacggtcaaacatgtgctaaaaagtcaacggtgtcaaatattttgaaacggagggagtacatactagatgaaactttcctctaaatggtgcaattttagcaaattttgttattataggcaaattttcctctaaatggtgcaattaaaggaagaaaacagaatgggctcgaatgcattggcccaattaggacggaagggatatgcaaacatattggactcttcagtgcacatcagctatttggatgggcaaatcaacgatgacgatcttggacgtctgatgcaaatccggtggctagattaatttaaggtgacgtggatggctgtgagaatagagaattaaaattaattgcacttagtgatgactaactttataagtatatataggattcattgcgactaccttggaaccttggcttctaaggccctgtttgtttcaacttaagactattataatctaaattattaagccagattactataagctagattataataagcaatagtagaataagctatgagttatttgattatctggattattaatggcatggattattgagtttgacaagccaatgtctataatgcccttggctattttggatgccctcagctattgtggagtgggaggaatatgagacggcggcggcagcgtggcttggggaaggggcccgtagggtggggggcttgggatggatttttgcgcttgggggaaggagccagggcgcagggtgggggctgggggaaggatttgcgcgcgactagggagagagtaagcagatgcacgcggggaggcgctgtattcgcgtgcaactgggcagagaggaagcggatgcgttcaacctgttgggttcgatggcagtggtgggtaatttgcaaaaaaaaattaaagggtagtgggtctttagccaccctataatctgaaaaagcatgtttataggagattaccagattatactaatctgacttatagaatataataatatttctatttgtttcagattaatgctagtaattcatattataataatcgaaagccgaaacaaacatggcctaaagtgttaagagtagagtaaaattcaagcatatgaaaaattcaatttttggttgtgacttgtaagccaataagcaaacaatgaggtcgtatgccatgatacatgtcaaaaataattattccttctgtttcatgttataagtcatttgacttttttctaatcaaactttattgagtttgac

SEQ ID NO: 49816 - DNA, 1501 bp, Oryza sativa
ctgccggcaagatacctccctccatccccggcctcatcccttcctccatccccgtctagctccctccatttgttttcctgtcacatattagacgtgttgtgatagtaggacgcagacggcgttgggtgcttgcgtcccttgcagaggggacggggtcagcggggcgacctcgaccccgtgaagaaaaccacttaggtgtgtaaattagacgatttcaatagttgagggaggggggttgatacccaattttgaagtttgggggtgtatttcgaacaaacattttagtcggatatgacatattttagtactatgaatatggactcggctgtttatattcgtagtctatgttacatccagccaaaaacccttatatttcgcgacgatgggagtagtttgctcgtttaattaccgaagggctaggtggtttttgagattgattaggatgaatatgaagttaaggcacataaaatgagaaagctattagtgcatgggtaattgacttttaattatcaaaaacttgaaatatgtgtttatttatattttaaagtaacatctatatagaaagttttttctatgaaacccatcgtttatcagtttgaaaacacatgctaacggaaatcgaggaaaaatctataagttgacgagagaagaacacctatgtgttcgaattgatttaaaggaactgcataggatgcaaggtccgcgcagttaccaagcttaccgcgggggtacggtaatataaatactgcggtaacctccttaaattcaaataaatttaaaaaataatttgaaattttgataaattttgtacggtttttcacggttatcgtggttaccgcgcggtaaccgtgcttaccaccggggcgccgtaacccggactccggcggtttgggaaaccctggtaggatgtcaattggagtattttcacccaaagaaagaagcattagaattatacatgaacaatgcagtgggtatattttcacatgcatcctttaattgtcacttttggatatggtaattaacgagtcgccactcactgtgatatgtgggctctcatgtgtctatacatgtggggcagtggcaaatcgttgcaaatagggtgaaactaatcacctccatttccccacccttccctctctctctctcctcgccgcctcaaactgatcgaggctgacctcctccgatccagcgattcctccgctcatcctcgcgcgcgccgccgccgccgccgccgccagctgcaagccgccttgccccacggattccctctccccgcgcgagctgactcttcgtcgggcttctcgccattggcgtacgtactcttgctgccgcacgcgccacgcggtgctgcgcgttctactctggtctccggtggcctcttggccggaagctgccgcggcggcgatgcgagctgcttggtgctgacccaggagatccctcgttcctgctagttatcggcgcgccctcgtgtctgcccgagctgttcttgctccgcgcaggc

SEQ ID NO: 49817 - DNA, 1501 bp, Oryza sativa
tccatccccggcctcatcccttcctccatccccgtctagctccctccatttgttttcctgtcacatattagacgtgttgtgatagtaggacgcagacggcgttgggtgcttgcgtcccttgcagaggggacggggtcagcggggcgacctcgaccccgtgaagaaaaccacttaggtgtgtaaattagacgatttcaatagttgagggaggggggttgatacccaattttgaagtttgggggtgtatttcgaacaaacattttagtcggatatgacatattttagtactatgaatatggactcggctgtttatattcgtagtctatgttacatccagccaaaaacccttatatttcgcgacgatgggagtagtttgctcgtttaattaccgaagggctaggtggtttttgagattgattaggatgaatatgaagttaaggcacataaaatgagaaagctattagtgcatgggtaattgacttttaattatcaaaaacttgaaatatgtgtttatttatattttaaagtaacatctatatagaaagttttttctatgaaacccatcgtttatcagtttgaaaacacatgctaacggaaatcgaggaaaaatctataagttgacgagagaagaacacctatgtgttcgaattgatttaaaggaactgcataggatgcaaggtccgcgcagttaccaagcttaccgcgggggtacggtaatataaatactgcggtaacctccttaaattcaaataaatttaaaaaataatttgaaattttgataaattttgtacggtttttcacggttatcgtggttaccgcgcggtaaccgtgcttaccaccggggcgccgtaacccggactccggcggtttgggaaaccctggtaggatgtcaattggagtattttcacccaaagaaagaagcattagaattatacatgaacaatgcagtgggtatattttcacatgcatcctttaattgtcacttttggatatggtaattaacgagtcgccactcactgtgatatgtgggctctcatgtgtctatacatgtggggcagtggcaaatcgttgcaaatagggtgaaactaatcacctccatttccccacccttccctctctctctctcctcgccgcctcaaactgatcgaggctgacctcctccgatccagcgattcctccgctcatcctcgcgcgcgccgccgccgccgccgccgccagctgcaagccgccttgccccacggattccctctccccgcgcgagctgactcttcgtcgggcttctcgccattggcgtacgtactcttgctgccgcacgcgccacgcggtgctgcgcgttctactctggtctccggtggcctcttggccggaagctgccgcggcggcgatgcgagctgcttggtgctgacccaggagatccctcgttcctgctagttatcggcgcgccctcgtgtctgcccgagctgttcttgctccgcgcaggccgcagggggggcgccgcgcc

SEQ ID NO: 49818 - DNA, 1501 bp, Oryza sativa
ggcgtcgtaccagagggtgttgatgatgatgtttgatacgggatccaaggggccgaagcattgtccagacatgaggattgcgcggaggaggcgtccgcggcgcatggagtcatctgatacgggcaggggcagcacggcaagtgccctgatgtagaagcaatggatggtgtcgaggaggcacatgttcagggacaatatgtgctcacatggcggggaggcatcatagttcacatgtccatgttcttcacaaccaccaagcactttcgctacgcattttgatagctttgtctctatggctgcgctatctatcgtaagatccgagatgtataggagtttctgaaattgaacatgatttggtgagattccagcaaaacggtcgggggcggcttgagcacaagactcaccatttgggcagcacaagaagtccatgttgggcgggggccattggaatgcgttgaggagcaggtccttgatggactggacgtcatgggtggtgagcaggtccgacccctgaagcttgtggacgataggggagagtagatgagaggggtactgcgcggtcatggtgcgcgccaggtcgtcgggcgcggggtggcctgctttgagcgcggcgatccggagggcgttcttcatcttgccaccgtcggggaggaggggggatggcgggagtgggagatggcggtcatggtggaccaacttgatggcgaggaggaggtcgtaggaggcgaggtagaggtagcgcctggcctggtcgccggtgaggtagcggaaatagaccttcatgaaggcgatgaggccgttgagagaggtggatgagatgaacccccaccactcgctgtagctcctgcgggtcctcttccgggggagcggcggtgggtggtcttggagttggaggggcggtgatccggagaggtgggcgatggcgttgaggatgatgttgctgacggggtcggcgaggccgaagcagtgtccgacctcgccgaggcagtcgacgagctccgggatctcgtccaagggcagccgccgcgccgcctcgtcgtacagcttctgtatggaccggaggatttcgttggccggagggtgccatcgcttctcctcctccccgtggtaacaggtgaatctgccgaagcgggggccatcggaggaggaggcgccgctccgactcgctgctctcttccctggattttttggggattgcacgccggatctgagcccccggcttgctgtcgatttgtgaatttttcgccgcttcatatctcctactgctacgcctaccgccgccacaaacaacgctagccgcaccgcacctgcccggcctcctctctctttatacgccgcggatacctatcctcgtaggaatcggatacggtgtaccctggagccaatgcccagcccacttaactcgctgggctggattacccaacaccaaacggacacggtccctttccttccttcctagtagtagtaaggaataagttcacttttcctccctcaacttatg

SEQ ID NO: 49819 - DNA, 1501 bp, Oryza sativa
tgacggtcgttatcgatcagtttcgaccgtcaatattaccaaaatagaggagaaccagtgatgcttgcaatgcatatacatgttagaataataatattccactagtattaggtttactaaccttttgcagagaataaccataaagtggaggagaatcgacattaactcagacgataaatcaatcggacgatgtcgacaatcagacttatgcatgaatgggccaagagctcagaattgacatgatgaattgggccaaaattcacaagtctacgaagtgaaacaatagagcaggtcgcctgccgaatttgggccaggttggctggcccctggttcggccgaacctccctctccaccgttggatatggggtttggcagggacgctccagatcttctcctgatggcggttgcggggtacttcagacatttcgcagcagttacacccgtcatacatgcctataaaaggagctcactctcttcacttcaacacacacctcaagcaagagctctgtcatattctctcaagttagtttagtgttattaagctagtagaataggaatagagtagaaatcgggaatccggaagccttcggaagagttcgggtatggctctagtagctcttctcttctctattgtaagctttgtactagtattagaatactcttctttatacatttatggtattgaaatactttttgaatatataaatgactactttacattatgttcatattatactgaatatgttgctaacttatctgggagatgctttagtgcgggtataatgtttgcatatgtaattactctatgtcatgataatgatattagagtagtatctggtagtttagacgtggtgtctagattacgggatattattatttggggttatatgctgcggatgagaggtgggccgctgatggtgacagctcagtacgggtattcctccgcgagtgtatataatcctaagttaattccctggggagggtactcctccgtatttagccccggttgtatggtcatgacgggctgtcgtaaggaactcgacagccaggggtagcttctcgaagtaccaggagggcatcagatagagggtattagctagtatatcagataactacccttggaatactctcgggtgaaacgctacaatagtatatccatgcgcttgcggatgaactctataaccataatataccaggagtatttctgcgccattgctgggaattatatttctagtaatgtcgttaagaaataccaacaaacatttctggcccgttgccggggaagattcataatagagattacctgaactaatactttataattacctctgtataatcatttccctttgcaggctaaccttggttgttttcacttttgttgtgaaaacagggtagtgcatgactggtttcaacttgccgaaaaacttcaaagaaaatccagaagctttcttccggagcgtcagaccgcgagtcactgctccgtagaaaactctaccgacta

SEQ ID NO: 49820 - DNA, 1501 bp, Oryza sativa
aactatctactaacttagagatagtctatagagaaaaacgagacaatgcatgagagagttatagatactcatgtagacatactattgtggtggtttactattaatctagtctattgctaagatgtacatgttttatagatagcaccttactttaccattgcgggtgctctaatgcctcggcatgaaccgcttctccagactgaaacaaaagcattgcagcctcaccatgcagtccaactttggtaaccaaattaactcttatatctccttgcagagtttattgttacccaaaaaaaaaaggatagaatctgtaatcccttggttgcttcttggcatgctgcacgaagccctttgcttggcctggatagaagttgggtcagctctacttgtttcatacttcctccgtttcacaatgtaagtcattctaacattttccacattcatattgatgttaataaatctagatatatctatctagattcattaacatcaatatgaatatggatctagattcattaacatcaatatgaatgtggaaaatgctagaatgacttacattgtaaaacggagggagtatcaatcataaagccgaaatcctttcaaccctacaaaacacaagggaaagatttctgtcaaccctgccagtactacagaaccaagtgtgagacagtgcacttagaagctccacacatcgcatattattaaggggcgcgggctggggcgatgttggtgcgggccacgtcgcccctttttcctcccgccgtccgatcaggcgtgggcggctgggattgaggcgcgcggtggaaattttgcgaaaaatccctccgatttatatataattcaatatgggtccctagcgaacagttcctatgagccgatgttttacgtgaaagcccttgtagtagccggatattccgtgcgtgggagagaaaaaacgcgaatcgggaccgcgctgtacaatcttaaagtcgaggggattttttgcataatgatccccattagcccacccacccccaaaccctagccgccgccttccgtctcgcctcctcccactcgtccccatcctctcgctctcctgcctccgcctccgcctccccctcgcgccgccgcctccgtcccgcgcgaccgcctccgcctccgcctccgcctacgcctccgcctacgcctctgccttcccctcgcgccgccgcgtccacctcatcgccgccgccgtcgcttcgtcgtctcccagcgcctcagcctccccattgcgtcgtcgccgccgctgtcgccccgtcgtctcccagcgcctcagcctccccatcgcatcgtcgccgtcggcgagcgcacccatctccgcctccactagcgtcgtcgcctcgcgccgccacttccaccttcgcctccctccgtccctgccgaccgccgtctccggccaccagcgtccggatctggcccccatgtggtcgggggacggggatctgacatcccccgtgcgccgggcagcatctccgcctccgtc

SEQ ID NO: 49821 - DNA, 1501 bp, Oryza sativa
acatatgaaaattgattttttctgcatcacatgcaattttagccattaccatcacaaataaattttcaatgtaagcatgaaacatgcagttttctaacaatatttttaatataaagagcatttttcactggttctgacaaaattttattcactcaaaaaggatttaaaataaattagttatgatttttttgaagtttacacattttttagttgagagggcatattggtcatttacgaaaaaaaactaatctttaactaacagtcaactaacactatagtggtgggtgtggcataaaagggtagaaaaacttgaactagtggcatataagggagaaaccaattttaagtgacatataaaaaaactggtcaaattctagtggtatataagggattctctcttttaaggtaacatagatactcctatagcttaactaaaaaccaaggcatagtgaaatcaaaacaaaattggatgtggcttttaatgcatggctcaaacaaccagtaccattgttgtgaccagaacccaaatatacaataagtatcctcctttttcttctctctatcaacatgtgcaaatctcttaacttttcagagtgaacgttgttgtaaccagaacccaaatatgcaatatatatctgcttttcttttttccttgaatgtcaaatatgtaatatatactgtatatccgccttttttctcctcaaaatctgcaaatctcttaacctctcggagcagatgtgtggatgcttattgctactaaaaaccacgtaaatatagtaaaatacaccaaccataatttttccccctcctcttctttttccttatctccttttcctttcccccccccctaattttcttttctgtttttcgcttcttcctcctggattggtgactgcaaaccatgcaacttaattaaccgaagctgttagttaatttgtcttattttattcctttttatctacattaattcttttctcccacattggttccatgcatgctattatcatttccattattgctcgagagaaaatataattaagcacgtctcagtatgttatcctaattaaacgcgatctgcaagcattgcgaaattatatgacaagttgtagttgacgcagcacttgttaagtttcttctcaaactaagagcattttaatagatattcttttcaagaaaagttcaagcaaggcaccaaaccgttgaaaggaactgatgattaattaaagctaattaaacgatgttgtttattaggcttaatttttttttcttgatgaagtttttattagtcttagttggcaactgccggttagcctatgtatctctgcagctgacctggccaatctttgttccttgcttccttctgttgcaaacgtgcatgtctttataaaagaaccccaaattgcttgcttgccttcctgctaatcaccgccaatcttgcattgttctttctttcgttccataagtcgttgcatcaatattagcctgattttgagctatcaaa

SEQ ID NO: 49822 - DNA, 1501 bp, Oryza sativa
ggcgcgcacggggcgcgcgctgacggagcgcacggcgcggcccaggtcggacatgagccccggcctgtcggcgcagcacacccacgccctgacgcgccgccgccaccgcctgtcgccgccgccgacgacataacacccctcgtcgcgctcgccctcgtcgtcgtcctcgtcctcgacgccgacctcgtcgccttccccggggacgacgacgtcggcgccctccgtggcgtcgtccgccctgcaccgcagctcccgcacgtgccgcaccacctcccccagcagcgccgccttgtccatctgcacgcacgcacgcacaccaacctcgtcagacgcacgcacgcacgcacacacgccatcgtgggcgtcgtggatgtctcgatctcgtacgtacccgggaggcggaggggacgagggtgcggagcgtggcgaggtgggcgttgatgcgctgccgccgcttccgctccgcctcgctgtggctccgcaccgccggcgacccacccttcctcaccgccgccgccgagcactccccgtccgtcaccatcgatctcacccgcagtccagaatggcaagcgaggtggttgtcgtggggtttaaaagagaggaggcgggaaagagggcgggaggggtatatgtatacgggggggcggggggcgccgacacgggaagctactcttttggtcgggacgacggctgttttggcgcgtttcacttggcggatcgaacgaccgatgtgtgctgcctccgtttcaaaggctgtgtttagatttaaagtttgatacaaagttcagtctttttccatcacatcaacctgtcatatacacataatttttcagtcacatcatctccaatttcaaccaaaatctaaattttgcgctgaactaaacacaaccaaaataaggttaaggttaggctgtttttagttcacgtcaaaattagaaattttgttgaaattaaaacgatgtgatggaaaaattataaatttatatgtgtgggaaagttttgatgtgatggaaaagttgaaagtttgaagaaaaagtttgaaactaaactcgggcttagttatttagtttaaattttaactgcacagctatatttattttgaaataaagagaaggttcagattgtatccaaaatataactttccaaattctggtaagatttcttatgtatttagtaaagtttggcaataaactaaattgatgctcatatttggcaattgtacttaaaaatggtatggtttgaaatgatgtaaatctaaacaacttcatatatactcagttaccaagttgaaaagagtatgtaagattaagtttaataggactccatccttcctaaaatataagaaattttggacggatgagatattttagagaattcatgtgaaatgtcctatccgtccaaaatcctattttagatagaggaagtaggctataagataactatatatactcaggtggaggagagaaaaaaaatgaaaatgataaatgttagctcttatata

SEQ ID NO: 49823 - DNA, 1501 bp, Oryza sativa
gtacgaaggtagtacgtagctgaacagagccgaccaaatcgcgttcgatcgatcgatgggcgataccgagccgtgcgtatgtacacaactcgtatatcattcttttcttgaaacccacgcaatcgtatcatgaaaacgtctacacaactcgtcgtatactcgtatgtgtgtaagtaacggtccggtctttcggcgaggcgtatagtacgtgcgtgtgcgtgtgtatgtacgagcttactagtagtagctactgatcgatcgagttaagttgcttgtttcagagggaactaattaattaactggtcgaacccggccgttacgatcgaggaagattcactggtcggtcggtccaaacgaatgtgtcaattcaagggcatggacgctcgatcgatcggggtcaaggtcgagttacacacggattaatcagaacgtccgtacggtcctacataggcacatgactagtacttcgtatgttttaactttgatcaaaattaaactgctttaactctgatcaagtttgtagagaaaagtagtagtaacatttttaacttaagacaaatttattatgaaatatattcaattattgattcgatgcaactaatttagtattataaatattactatatttatctagaaactcagttaaacttaaaataatttgactttgaccaaagtcaaaatatcttataacttgaaacggaaggagtatcatacacacactacctctatctcaaaataaatgcaaccgtggagattcatgtccaacggttgactatctgtcttatttaaaaaatttagtcacacataaagtaatattcatattttatcacctaataaaaataaaagtactaatcataaactttttttttcagataagacgaacagtcaaacgttgaatataaataatgtaaaactacattaattttgggacggaggggctactaggtctttgtaggagtgtaactgtatatacatgactgattaactttgccttaggagctgtttggttcgttgccatattttgtcacgccacactttagtcataccatagttttttaggcatgtgtttggttcgctgccgcaattatgttatgccacactttgggacccacgtgtcatgctctcaaatttagagctaagcatgccacacttgtggccaactatttctaagccatatttgtgccactatgccacaactagcctaaacttagttatggcaaagttaggcatcaaccaaacatccccttagcttccatagtaatactcacgcgtagcagcactacaactgctgctgcacgtcttcttgaacctaactagctattcgtgttcaaccttggacatggactgcgctgaaaaccgcgtacagtggcatgttatgttgttaattaattagtagtactactggtaaactcgtacgattagacccgttcatctgttaagatttttactagtacatgcagttcaacgtgtggtcaagtcacgaacatatatgaactgtact

SEQ ID NO: 49824 - DNA, 1501 bp, Oryza sativa
gtaaatccaaatgttaatgctttttgtggcactgtaatatgctcagaaatgcatgttcttctctgtgatttagtcaatagaaggtagtatgtgttatttcacatgcccttttccggatgggaaaaggcaaatttattgttggaatattagtaaaatgctgatcacatcaaccttacactttgaatttgcaattgaccccatgcaagtattacttttgcttaattcttctggtttatatagtttgttccgcctacttgtagtgaagatactaagcatgaaataaatgcaggcattgaaatccccaagtacgttgacaccgtgactcctcagtacaagccaaagtttgatgcgctggtgaggaactataagtctatcacccttgtctggaactatcattctgttatatgtgcccgtctttctctcatcttgcttcaacaggttatccttctgtaccctttagatactgatgcaccttttatccttttctcttttatcacgtcatatgcagcttgttgagctgaaagaagcagaaaaggagtctctgaaggagtcagagaggatagagaaggagcttgctgaattgcaggagatgaaggtgaggatgatctctggcgaaacttgtatattgcagtccatttgtcagagattggttgtgcatgcatccattattaagagcatttttccatttgctttaacatatacttgttcacgtatacagaaaaatatcagcacaatgacagcagatgaatactttgcaaagcatcctgaggtcaagcagaagttcgatgatgaaatccgtaacgacaactggggctactgaagagtggaggaactctttgtttccctttcttggaagagttaataattttgtcttgtgtcccagagtgtatgtataggggaatccactatcgcaacaatggtggtttccataccatgtggatggggcctgtttaaactcccaaactgattctaccatgtcgtccgtgctgcagttccaactgaatttgcttgtgttggacctcttcattttctagagggttgacccttaagaagtttatgttttattgtttttgtgttcatctccgttctacatgaataaagatgatcaattgttgaaagattatgttgatctctataatgccgagataatttgtgtatttatgtagatggtttgtttgtcgagtgtagtatttcgccctctgttcacgtgagccccacctgtcatagggcgagtccgctctgacaatctgggcccacctgtcagagcgaccagcagcatctccgtggctacacggaaccggtgcgcgcacccacggtttccacccatccatggcggccgtgcgcattgccccacgcctccgctctctcccgctcctgctccccggaccagacgccgccgccaccgccgccgccgtccaccgcagctgctcctcctgtggcggtagcttggccgcgttggcgcctgcccgcctgcgcgccatgtcgtcgtcgtcctcctcct

SEQ ID NO: 49825 - DNA, 1501 bp, Oryza sativa
tccgatgacaagtaatagacttaggaaaacacctgcagagtctctatgtgttgcgcataggacacccggcatggtccgaaccaccgctcctagtctcgacgtctctagttaattataatttcattttatatgatttttttgtcaattccgttaattataatttcatttttttataatgccaggtcggatagtagtaaattcttgtattgatggttggactagcgaaccaaccaactacctcatttagtactcgtccatatatgctgcttcggttgtagctagttgctggtcacactagtgcatccatcaacctcatcctcactccacagataacagccatggtaacaagcaagaaggtacagaacaacgaagctgcaatggcggacggcgctgttaaggtaaatgaaaatacaagtacctttcaacgatttttcaatttttttttcttcaccgatctcgtgtttgtaggaatatcgccatggtctgtgcatggatgtcccgatgtacattgaagattcggagtattgtggagaggagcttggcaccagactaacttgcaggcatggcctcacgccgaaacggaggacagcttgggaaggacctgacacaggaagaaggttcttaggttgtccgctggaggtgagctcaaaagtccttgaaaacaaaagaaaattcattcggttggtttttacgaactgttattcgtttcaggaagaggatcagtgcgataaatttttttgggtcgacgaaccatggcacccaagagttcagaagacacttgagcagatgtggcatgcagtggaacgtgctaccaagctaaccggttcgaaacaatatgactggtgttgtttcgttcggaatacaaaggccgaggaagaaaaaatgaagttagagttagatacggctgaccatatctctgaactagaattggcgtataaaaaaaattaatgaaaaagaaaaaagagctcgacgatactcgtgcgtggttaatgggatcgtttgtagtaattgtcattatgttagtgaaaattagtgatctcatgtacaacaagtgattacattggatgtaatattttctttaaacttccaacttttccatcaaaattatcctacacaccctaatgttaatttttcgacggaactgcattcatacttaaaccgtgtaaatgcatagttttgttgactgctttcatacttgactgcagtgccgttcttgactgctttattataccgagtggaatgcacgcatgtatatcagttttatgtgtggtgtaccgaggaggccatgcaacaaaagcagcccatattcgctttggaaacagaatagactataatggcattgattgctacacggctgcatgcacctgacacagtggattgacgtataatatatgccgatgcacagtgagatgtgtacatttaaaaatcaaacgacacaaaacctgtacttaagttcaatacaagattattccggtgtcattaactcgtttttttgctacac

SEQ ID NO: 49826 - DNA, 659 bp, Oryza sativa
ctgcagcccagtttttttacaggaaagtgaacgaagatgtgtgattttgctgtcccagagggtggagtacaggatggctgtggtgaacatggatgtttgtatggtccaacatgaagtatattgatgttgtgtgcgtacagtttatattgtttgaacatgttccaaaattgtaatggacctgaagtacttttttatatttgggttggatgattagcatcttaatatgttttgcaattgagtcaaactgctgatgatgttactcagtacttggaaaggttgcatgttggcttcaagtcgagtggatgctgatattgatagcatcatgtctccaggtttagtggatgtgctactgttactcagtactttggataattgtagtgcataccgaagaagtgtcgcaattgagtaatctgaagaataacatcgaagcatccagtgactgacacaacaacacatagatagttcctccatcttgacaagcatccattaacagatagttgacccacataatcaagtcttaactagcacataataagattgtactggaaaggtcaaccacataataaggtcttaactagctttacatcatacgaatttggatggcattacatattgccagacaaaatggtgattttcatccaccacactacttgagaaca

SEQ ID NO: 49827 - DNA, 378 bp, Oryza sativa
ccgtatccaagctttctacaacaacatgagtagtgccttcagatctggcaaattgttgagatggaaaattgatttcccagaaattgtcatgtatatccatgcaaaagttgcatatattttagtcttgaaaacgagatatcttctcgagggacttttgaaaaagaattggtggaacgctctgttgcttgttaaaattgctttgcttctgtgaaataataggaaggtggatgtcataagacgtgtcctgttaatctagttctataataaatgtatcgtgttagagctgtaataactacatatttaatcacttctgtgtaacttgactgcttttgtgcctagtccctaatgctgatactcctaactctactatgtaatgtc

SEQ ID NO: 49828 - DNA, 1501 bp, Oryza sativa
cgccgccgccgtgcccgactgtgcgccgccatgggccccctcgccaatccctcgcgccaccaccgtccttgagctccctaggacctccccaaaccattccctagcgccgtcgccgcccggcacggcctcgccgccattgccgcccgctcccgaagaccgcctctcgtcgccagccaatctcggtgccgctccatccaatccgacgccggaaacggattccttgaaccccggagatgctcccacccctttgaatcgaaccctcgtcgtctcgtcgtgttttccccttttgctctccggtgattgccgccgccgtaatccaccgtcgtcggctcctctcgcgtcgattcctctcgccgccgcgcgtgcgtcgccggtgaccatcgggtcccgcgtccccgcgtgcgcatcgcggtcgcgtaccgtttcggctaggcccgagtccgcgcccccttgtcccttccctcacaagaccacatccccgatccgacgagcttggtcgccgccgccagccaccgtcgtacctcccctctcaaatccgtgccgttaaacggattctccctgacctcctctagctgccggcggtagccgctcgctccggttcaccgctgctcgccggaacgcctcgcgcgtcgtcggccgtccgatcccgggcgcctcctcctcctcctcctcccctttcgcccctgcccgcgtggccgaccacgtggcagccacctcagccccgggcccgcttgactgggtcaagtcgcgcccagtcagcctcctccctccgtcttccctcccgtgcgcgcggtccacggcaagccgtgcggctgcacgtgggcccgccgccatccgtccacccggcgcgccgcgcccgaaccgcgcgcacccgaaaccctagcgcccgcccccgcgtgcgccctccccaccgtgaacccaaccaccgccatgtgggtcccgcgcggtggaccgcgcccaccccgtcgggcctccctctctccccgcgcgccctaatgggccgtctccccatggccgcgctcggcccaatggccggccaagccttgtgaatctctcgagccgcgcctaagtcgcccgaggaagtctaaatccgatccctccttccttttcttttccaagggaattaataattccttttccttgtccagaaaatccatttagacctccaaaattcatatccctcgatccgtagctccgatcgcctccgttccacttccagtaattccgtaaaattgagacctatttaatggcactactaataggtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttatttgcaacttgcattattagaatcacacttaacttgcttggcctcggtttgcg

SEQ ID NO: 49829 - DNA, 1501 bp, Oryza sativa
actttagctagctagctatattaagctgtaagatcgatcaagctgattgttatgaaactattaggaatatagagatccacaattaatctcaggcctatacaatgtaatcagctagagtattcctaatagagtactagtgccgatcgatcgatgagtaagtgatgatctgaatgtagcagccaattaattaagtacgtggacgtactgtcttaattgaacgacatgggacaggatgggtttccttttatagataactcgatcgtacaggtatacgtacgttggccacacgttcaactgcatatggagtatgcagaaaaatcagaaaaacaaacaaaggaccgggtctattgtctattcgtaagtatttactatgactaatgagagtttttactgtccttgaaagggggcggtaccaaatctgaaccgtcgatctagcttcatcggacggctgagattggatggtaccgcgtggtaccgcacgcgcagattggggcggtaccgctggggtaaaaccgtattttcgcgtaacgaggtaggggtccgtgatttcctgccgggatcagaccggggcttctcttccctttctctctgagcgccatctctttccttttctccctgttttgttctgattctcgacgatttcttggcccacgcatagggatttccccctctagaaccagcgcaggggaaggaaagatgggtccggtcgatcggcgcatgcgtcgtgcctttgctgccgccggcgcaggggatggggggatggcgctcagatctggaacgagcgcgcctccatccgctcgtccggtcgatcggcgcgtgccgttgtttccgccggcgcaatgatccccttggagcaatggaggtggtaggcggagggaaggatgggtgtggtgttcagaaccaagcaccggcggggagatgcggctgcataaggtgctgcgggtgtcgtggcgtaggaaaacggagaagaaccggaagatcaatgtgctacactgcgaagagttgagtccctgcgaaggtagaggtgttgcgggcgtatttcctttcgcgcagatggaaaaagctaagccgggtaaggtaacatcaagcacttgttcttcctttcagtttgaaagaaatgttgcaattgactggagcttggaaaatagagatagtagttttgaatacatggctgataattgattggaaataacctagatggaaaaacagtgttgcataatataaaagtttagatagatacacttagatggaaatacagtgtttcaaagatgccactaattggcttcaaagcttcattgtaacttcagatgtggacgaattttctgaatgtagacgtctgatgtcgtcgtggacagcaagcactatatttagagtagtgttgattaggttggcggcgacctttagtctgaaaacttcattcggttcctgaagtcaagagggagtgaaaaatatgtgtaagagatgtgtaacactaataaaatgtgagtcatagtagcttagt

SEQ ID NO: 49830 - DNA, 1501 bp, Oryza sativa
tagttaaaaccaacttatgatgaaaatgaaattacatgttaaaaaataaaaaagaaacgttaaactatgttttctccctatacaagtcatttatatcgggcaaattgagtaaatgcccatgtacacaaattgagtaagccaagaacaaaaccattactacaaaacaatacttatagtgttagtttttccccctcatcaatgttggttttgaaactagcactaattattgagcacttatgagaggatcctcatgttaccggttcctaatccgagagtgatagggtgacaatttgaaaaacaaaagagctggtacgactctattgaagccgagccgatgcatcatcatcgagcatctttatccacaaaacaaaacaatcacgaatccaactaaagtagcagtcacaaaggcatcctaaaaattggtatggttgaatcaaacactttacagaacatagatccagttttttgcataatctctaagcatatacaaacatccatatcgaacttttttcggaacaagcacaagacacgcttgttaactagaaaaaaaaatcccattgagtgtcaactcgttttttcaccgtgatggcatcagatccatcatccctcgctcctccggcatgaactgtcactagctcacacgtcgttgcaatcagtgcttatttatttgaaaaactagccatgtggaaacacattaatactggtttttttaatgaaccagcacttatgtggcatcattaatgatggttattccatgcggatgacgcgcatgggccggcgggtggacaggaaaccgctatcaatgctgagttttccttgtttggtattgatagggtgttactccctccatcccataaaaattacatttctagctaatttagaacaaaacaataggattggaaaataaccataatgaccttatttaatgaacccattgcatgcacacattccatatatacaaatgattaaaagaaagtttgagagaattaacccatataattagcatactttaattacaagctgagagaacttaaggaaacttatctagatgaatcaatttgctagggcccaaatggctagatatataatttttatgggacaaagccttagagctagaaatgcaatttttttaggacggaggtagtacgattaagcagttttgtacttcctccgggctaataatacttatcgttttaggtaagggtgaggtcaaactttagaacttttgattatgaatcatttttaaaatatttgtctttcaaatatgatgactacatgtatagattagtcttagaaagtacttaataaaatcatatatttgttaacacttttatacatattataatggacaataatggttaaagttgtttttttaagaccgtgctcttatccaaaacaataagtattatcaaccgggagggagtagcagtgaacatggcttaacatgtgtcttttagagtctggaccctctgcttcgttgtgcaaaacatggacttatttc

SEQ ID NO: 49831 - DNA, 1501 bp, Oryza sativa
acgcgcgaagacgaaaggaaaggcagcacatgattcgcgacggtagggggtcggagttcaattctccgtcccccttgttttctcgcttgttttcgacttgtcgtggcaacatggaggtagagcagcaacaaagattaccacataagattttcttcatcgtttttttgggtaccatcactcaaattcgagacgatacagtgcttctctatcgaaaccatctgagatggatgcaagcagccgttgaatcctatcgcagctgacattggccgttgaaatgcaccgtcatcgcagacttgcagtatgcaatccaacgaaccgatgctatgctcactgcacaaacaacgacatttcaatctagctcggtcgaccagttccagatgccaaatgtgctgccctaatgcccttatgcatcaataacatgcaacattcgctggcgtcgtcgaagccgtggatttgccatgccattctgcactgattttggataccatatcactcagattggagagcaaattcatgacgaaataacctcgaaaaaacattcaggagatcgggcgggcgtcggtagccgcatcccagtcagccgacaggcgaggtcgaagggtagggggagcacatcgtcaaaaaggaagctccttttattattggattgcccctgcgctgcagatttgctgcgcgcaacgggacgcgcgacatctgcttttctgactgacaggatacgttttctaaacccctagtttatggttctagacctttatcagatcagttaatcagagagagacagttgcttgctgattgttgtttacgctgcatttgtttgctcttccattttagcactaatatattgttgttcagagctgaatgaatgtcttgtggttactctgcatcttcttctctcttttttttggccgcgtgaatgtcggtttggctgtggcagtatttctttagcacaatcatttgttcgtttctgaatgtgcaccggggggtgtcccatatatgagatgcaaaattattactacttgtttcattactgttgggagctattgctgcattcatgcccctatgttctcaactgttaataattcatgtggtcatcagttccggaaggggcaaggtccacaatttcattcaggataatgttttgtcagtcattgagccgcaagcatcatgcctagcacgctgccggccagattgagctcaattgttctccgttttttttactgttgtgaaagggaaaactcccccattttcattgccagaaatgcaagttcaattattgagctcagttggtgacaaggtaccctatgctatctgaatacatcatccacatttcatactttcagacaaaaaatactttggggaggaaaaaacaacaatggtatctttcctaccttaaaacgattaaattgttttctagtgcggcatatgtctgtggcataaatctccctcaggcctcatcacaagaattatatggtttatctgaagaagataaattgacaacctc

SEQ ID NO: 49832 - DNA, 1501 bp, Oryza sativa
atattcaagacagagagtagtactccattttagagggacaggcccataacaatcagaaatgtgtagttcacaatccttacttttcaagaaacacaggtcatatcacatttagttatagacatcccatcaggttggatcaccccagctactaacagatactagcatgtcggttcctgaaacgaagaggggtctcctctcctgtttccctcaaaagaaaaaggaccgaagaagtttcagactcattcagatcgatcggcctgtgccacccaacgcaattgcatcagggtcctcatgtacttacgtttctgtgattacactcaccttgtccactttacttttctttatcaagctgacctcaattctgttggatcgtcactggaattaggtgattgggactatcttaattcgccgtgtcgatacatgattcgccaatctcttctgctacactgttagaacggtgtggtgtcctataaccaacagaagtttctaatgattatttttcatctgagatactgtaggataatagagaataaacttctgctactttcagagactgttcaagaccagtccatagaagagaacgctgttcaggacaattggcaagagtctgaatgtggccaatcatcgctgcatgcgaacacaaggctgtcaaaatcaaacggaaagataggataggaagaagagaagagaggagctacctgacgaacaagtggcagtttcacgctagatgaacgacagctgagttcagacaaaaggtccaataattttaggaaaattacggaggtaatcacgatgcaactaacccagatcaacattgttaaggacggattgggattaacaaggagcatatgcacctcttattaacaatttaattgatattgaaattaaaaactgcacgttgtaatctttaaatgaggacaagaacaaaaaggaaatgcgttcagaaaatggttctctaccgaacgggggataaagaagaattttccatgtcaagtcacgtgaaacgcgcacgggtgatgatgccattaacattttagctgctgagcaagcgcactacctaaccctgtctgtctagatggtcatcaccttgcagttgggttgtttctcttgtcgtctttttctgacttcttcttttctttttcgccgaagcagccttgtggaagttgctactagtggagatagccaaccgggttccagcagctgttcgatctgtggatcatcatcgttcacatcagttgccaatgattgtttgttcatgtgccacaactatttattctggctgattgtatatatatacattcagatggtggtagaattggcagataaacattgaccatctaggcatctatctatatagtagcataaagtaccaatggagcctgcaagactgcatcccgaggtagcaactgatattgtgatcacttggaacttaaattctatgattgatccggttgcgtacgtacaggtacggcttagttcatgagcagcatatacaaactga

SEQ ID NO: 49833 - DNA, 1501 bp, Oryza sativa
tccacgtgctccctttgcctgccgccttctctcctcctcgcgtcgccttcgcgctctcagccccgctgcccgctcatcctcctctaccctcgccgcctctccctccttaggaacgctggggctgcccacgccctatgcctcctccactcggtcgcaccgtgggctgcgccaccgtcgcagtggcctccgcctcctccgtcgtaagcgcaaacccctctggacggcgccatgatctcctctgtcggcaccgcgacctccaccgccagcatcgcgacctcctccacctgcacctcagcctcctccatgggtaccgcgaccgccaccgtcagagccatgacgtccttcgcttgtaccttggcttccttcccgatgcggcacggccagcgccgctccatctcgatctggccacgggagcgccactccatcccgatatgaatgcggggggccagatccgctgccgagggaggtggatccacctccggcatggctggatccgccacgccgaccattcggtcaccacctcccacgacccgctgctaccgagcagcccccggtgtccctgccgctgggcttcctcgtgggggagagcgccccaccgccgccatccatatggccccggctttgctgacgagccactcgggcagcggtgaggcgaaggggaggagggagggggcgatagccgctcactcgaattaaaattactaaacaatatgtttcgtgcgaaaacgttctatataaaagttgtcctaaaatatcaaatatatatatttgttaagtttgtaataattaaagcttaattaattactctctccattctaaattgatctgagtatttcataggtacaccaagaccaaaaaaagctaataactctctcatactatatttactctagcagcaaactcaatgcatgcaccatccccactattttctagccaatagcaaatcaatatattgcatatgggttataaatatatgtgtgcatggatgcatgcatcaatgtccatttactccaatgcacaaataacgaatagaactaataaatgaacacaaatatgtaggtcatttaggaataaacccaaaaaaactatatgtagatcaatttggaatggagggagtatgtgctactccctccggttctattttaattgacgttttggacaatgacacggtctacaagatatatctttgatcttacttttctattatagtatatataataaataaatgcatgtttatttttattatagtactttaaaagataaatctgtatatgttgttctagttcctttaaactaaatatttttaaaggtattgatgattaaagttataaaaatttgacctcaaacttgttcaaaacgtcaattaatatcgaaccggagggagtaatagctttctcatgtgcgtcagcttaattttcttcttcatttatggagtcgtaaatctatgtgtgtggacgtagcagttcatgttcatgctctgttccgagtcctgtgacacgaa

SEQ ID NO: 49834 - DNA, 1501 bp, Oryza sativa
aagtctacaacacgacagggcttgctcctgctgctccggagttaatacatgcaggaaatgaaatagtagaagcaaaggtctaaatgcagggcttagttcacattcatttcaaaccatgtcattttctagtaaaattatcgaatatgttcatccatttagtttcttaacaaactctggtaaataaataagaaattaatcttgccaaaacttgcaatattaccaaattgcaaaaattttagcattgataaggtttattttagctacaatctgaacatgcccgcaatgttgcaactgcacgtgcaaagtcgtggtatctgatagaaattgaatgttgaggaatcattacagctccccctctaagtaatttttagaagcagagagacaatttcactctatattatctaggatcctgaaagcatttggatactccatcccaatttcaagattttcgagattttcccaaaataatcatctaacaaagtatctcttggtttatttgtgctaaaagtaaatgtgtatcatggaatgtcctgcatgcacgcgtgcaaccaatcaattaatttatattggtttaatccatgcaacatttaaagtgtgaattaattttcgttgaacacaaagtgacggagcaccttgatcaatgaggattaattccttggtcttgatgtcatttgcttagaggatgatcaaattgggatggagagaatattatttaggatctaaaagtgtttggtacagcatcaattctacaggataaaaatagcgagtaaggatctcgaagaatattatttaggatctaaaagtgtttggtacagcatcaattctacaggataaaaatagcgagtaaggatctcgaaagcgtttggtacagttccaacttcacgggacaaagaatatcggggtaggagatgtatcaaaatgtcattggaatggtttaagtggaagcccagaacattgctggcaccatttctcttcgtttctctatgtatgacgtttagcttgaagtctactgttaatcttccacatagcacccagttgaaccaaaccagaagagccccttaggaaatgcatggacttgccagacttgtgatgagcattgcagagagctcgaaaagttcagaatgaagaaaggcatatataccaagaaggcgagaacttatgactatcccacacctaacgagtgaacaatgtggccaaaatgatgctgggatgtctaaactcagaagttcagaacaaacccaactaccctgccagactgccacaccatcagttcaagccagaattttcctaacccccctgacgaacaacatctcgagataattggtgccaccaattccaccaaagttcagagccttttatattggatggtgaacaaccaaaccaaggccagggacttcaatagctaaagcacacagatcaactaccaataagaccattgctctggcttacctgatcacagattgctataagtagctccagcatcaactcctagcttcacagc

SEQ ID NO: 49835 - DNA, 1501 bp, Oryza sativa
atgccattcactagcacgctggcatgtatccaagctcaaagcacaaccatgatgtcgattctggcaagaagagtaagattcagcagtgctccgtctgagcgtgagctcgaggaggcagctagccatggcccatgcaaggttcggccagaagcgctgaccccagcgacaggaggtcggcgcaggcgaaccacacactcaacacggacggctccgccgcaggatgctgcgtgctgcgggcctgcggcaccgtcgacgaagaactcggcggcatatgacgagagaagcggccgccggccaggagcgagcctttccgttttcgtgggttgatttgtcagcgtgggccgaaaagaagctagttggtgtgctgtgcttgtttacctccgttcgataccgatccagcggcgtagcggcatcggacgtccctctgacgtagattgctctacgtcagaggatcctgttccgagaacggagggagccgggacaggagccgattgattctcagccgaagggagccagccgagacttgtgctagaggccctacgcgcgctctcgttggatcggtagctgggccacgtgtcgctcatccagattggggttgcacagcaggcccgctgcacccctcctccaaatttttttccttagttaatggcctatatgcatgcatgccttatattatggaacatcttaaaaaagtggttgtgccttatattatggaatggagggagtactactagaaccagaataggataataattctaaatttatatccatgtaattttggcccttttgtcaatcagaatcatggtcagaacaagcttgttttttctgtggattataattcaaaacgattttaaaattaaaagtttggtgttcaacaataactttggatgaattttatatgtcctcataaccatcataaaaatgagttgggaaatgaagtgaccataataccccgaaattaatctaattaaaatataaaaattgaaaatacttttgccgatactttgttacgtcgtatgtatttgagtcgatttttaaattcgttcgcatttgaaaatatataaggagtcgtataaaatatccttttaaaaaaatcacatactaaattgggacgagagtcggactcctaattgcttcagaatttttttcaagccataagaaagcaacatatagaatatgaccatcatccgaataagagttccgaattagataacaatactatcaaaataaaattctcatatatacttttcaaaaaaaaaatctaacaataatacgattaaaatagtcttcaccctttgcaacgcacgagcaatttttttagtctaaaattcaaaatcagttccaaattagttttcagctgtccaagcaacaaatagtagaaaatataaacacattccaaattttcgatctcaccagacattgagtcgtcaacccttcgtgaggtaaacagcaaagttaaaaaccctaatgacttttactagtgagccaacatcaattaact

SEQ ID NO: 49836 - DNA, 1501 bp, Oryza sativa
ggccgattgggaacaagatcaagtgctcaaccgcatttctgagccatatgccgactgaattgaatggggctccaactaacctattgcgtataggccagccacggttactgcatagaaattgcgatggaccttcaattccatctaatagatgaatcgtgtactacttacgcaccgaacaactcatggtggccttcccccatgccctttgtcccggtggcctcaccgtacctatgaaagatacctttcatttcgttttcattttaccactactcctaccttgtactaggagtaactaacttgtcagccttcccgatgtagagtgcccatttcctgaatatggcatttgctgatgaagtgatgacactggctagtggagtggcatgtgctgcgtgtgtgtgtgaactgtttagctgaaggccaagacatcaatcttgcatagcattaaacctgacagagattggtatccatgttgtttgtgatgatttggatcagccatttttataagaaaacaaaagctgttttgattgacaaagagcaccactaatccaccactatagcaagcttagcagatcatactacttgtgcatttccgtgtttgcccccctggttgtgtcatcgcggtttgcaaacacctgcacatcactacgccgacagcttaaaattagacaggtgtacgactaaaaagggcttaaatctactactgtttacataaggacatctctgctcgatcagctatgtactactggcagcattcagctacctccatctgattactccatgctctcaaatcgtaacctccaacagattataggactcaaacagctcagtgactacagatgattcgaccgaagtcgcatacaaatgggtgtgagattgtgagagaatggtcaaatttacttggtatacgagtaaaataatctgaactccgaagcatgttttgaggagggaagaagtgagattagcaccgagaagagtgagcttttgcagagcaaggagtagtaggtaggacaagtggtgacggggagatgagcccactgtctcagagctcacatctcacaggctcacagggtcgcagtgatgagctgccatctttgtactgttccagtgtttctactcctcttgcccccacacgggcacactctttttcaactcctctctttctctctctacgagcaactactacggggttgagagagagagagagagagagagagagagagagagagaatggccattataatagagccataggccaaaagctcaactgcactgagagcagcatcagcagcagttcactgtcactcttcccaagaacgggtgccaaggaatcctagaatccaagaaaggcagcagctgctgcagcaagaacagcacagggggagaggtggtggtggtggtggtggggaagaagaccacacacattcggctgggtggtggtcttcttcttctgctgctgctgccgctgttgccgcttgttggagtgaggagagtgggtgagtga

SEQ ID NO: 49837 - DNA, 827 bp, Oryza sativa
tatagtttggcctgattctaatggagcatagtggttcagatgataatgtctgatgaatgcattgatattgacttgatgtattatggtactagagattgagcagcatgttgctacctagtacctaccgagtacagactatcgtgctcataacagtagctcaaaccgtataaaatctgtcatgttgaggttgagtatgaagctgaatctcgacttctattaatgaaaatgttgtagcgatgtgccgatgtttcataatatttgtaatgcccttttccgtgcaagcaaagaaaaagctttgaacagacaaaatgatgctggtagtatttaagggagttaagtaccctgttcagttaactccaagagagttcttctaattatgagaaaattcattccttaaaatttattctgaatagtatctgccaactaaagacaattaaattcaattcgcccaatctcctgtaagatgctcttgaaatctatgcatatttttcaaggttctaactattaagttctgcaacagtctatattgatgtacctttttgtcaacctgtttgtgttttcttgtatgaaggtaaatgagctgcctaatagcactaaatatggacataaatagttaatacttgtaatataatttatacatatatggcatcttttgctaaatctggatgctgttttatttctttttctgaatgataataaatgatttatcctgagtgttcgaattttgtttgctcatgttaaaccaggaggttctgaggcctgtctcaaacaatgcttcaccacatcttggccaatcacctggaatgccttcaagggttagggatgat

SEQ ID NO: 49838 - DNA, 1501 bp, Oryza sativa
catgtatagtacaacacacagacgtatatgactggaaccagattgctgctgcgcaacagtgcaaatgaccagcagcactagtggttcccaattcaaaaacgagtagcaatcatgcgatgtcccccgatcaagctcctgaagaaccctagaatagagttccttaagtgcagtaccctaaacaaaatcagcagacgcatccattgatagtacaaatcaggtactcattattagaccctcaggcccccacgaactggaatccaggtacagtacaccaccaaacgcacgaacataaactagtcaacgaaatttcagtgccgcacatttcaccgtgagttaaacacagccaactccatggacgcaagacactaagagaccacaccatgcaaaaaacgacacgtgactggtgagggcacaattcacaggacaccgcgcgttgcgcaccaactgttcggagaaatgggtagcaggaaacagagagccgtacctggggtacggacttgcgaacgggggcgtggaagagatcagcggggtcgcacgagtgccagcggcggaaccggtcgtcgaactcgagctccatgaggtgccccgtgacggaggtgacgagcatgtggcaggcgcggccgccgatggagtaatcgaactcgaagacgcggttgtaccgtgaccgcccctcccgcgaccgcatcccgcccgacggccgcgacaggatctccgcgacggacttcgccaccgacggcttctccgccacattcagcacgcggatcgcgccgccgccgccgccgtggtgcatcgcgagaggaggcgcaggctacgctctgggagggggagaaaccggagggaggaggcggcgatttcggccttaccttttcgaaatttttggttctgagcgcgccctcgagagctaggtcggttaagcttttcacgagagagagctgggctttcgagctcaattgttcaaagacccatgaataaaatggatatgggctacatttggcccattcaattttcgccagcgtattacgcggattcgacttcgagtcatcctgaacttttttggggtggagccgtcaattgtgaattcgaccattcaagctgcatcctctttaacatgaagaaaacgagagatttagcattccttactgagccttggagagtacggaatagtattgaatgatcatgcacttaaaactctggaatgttgaaactgtgaaagggatttcgtatgaattctacacgaagactctcttatgccaaaggtcaagctctcttatgcgaaggtcaaggtttacaattacatgaaaaccacgtgatgaatggttttgcaagtcgtagctgaccgcgacaacgcgtcgagccctcgggtaggcacatcgaagcttgacacacaaggaaccaaacgcgctcaagagcattataaatttatacaacatatgaacatatacgtgttgacacagtctttatattcaccccagtttttcagccttcgtaactcgccttccac

SEQ ID NO: 49839 - DNA, 1501 bp, Oryza sativa
agaaagctgcgagcttttcttccccgattcgagctgcacgcgcgggaaggaggaaggtaatgcgggtcgccaatggcggatgatgcaggtgagctcttcttcttcttcttcgacctcgtcgatggcggtgttcgtcgtgaaatctctctgtttttttttcttcttctttctttcttttcttttctttttgagctttggatgctgtgttgcatttatcactttccccgatgcatttattctgctcgggggagagggagagttgagtgcagaagcgagaggagggagatagctgtactggcctcacatggtgaaagctgcaggtggtggtggcggccatggcctggaccccgcgcctttctttcccctccgcttttgagctcgcctcctgctccgatctgcccgcgtgagctgtgaccccgcgcttttccccccctctcccccccagctcagctcaagaggatagagatagagagagagagagagagagagagagagagagagagagagagttattgggaagcaagaagaaatgtggtgttgagattgagagagtgtgtgtgttcttcacggagttcttgcgatgcgatgcgaggcattcccgtcttctccgtgtagtcgttgaattcgaggaggtattaatgcccgccatccctcctcgcttcctgctctacctctgcttgttttttgctccctctcgcttcgttcttggattccctcatggaatttcttcttcgcttcctctgaatatttttttgttctttctgtttttgttactctttcttccgccggatttagtgggaatacctcttgatttgggggcttcgagaggaatttcggcgtcaagctgcaatctttttcggggattttcaccctggtttcttgggttctcttggggaattgcgagtagtcggtggctactgttattttgcactctgacattctctctgtgaaaaaacacttactttttttttactgttttatttgctgctactgcaaaagcatgctagtaaaacaacagggtttgattgggtatcaatggtgataaattccatcttacctccactgtttttttggtacaatgatgcattgttcttctcttgcaatgttttgatctctttgttttctcggcactgtttgtttctgattggatttagtgtcagtaagaatgctagtctgatttaacttttgccaagttgtgctgaaaaaagaaataagtgacagtcttgcagcatgtgctgtgggctactagtcaatgcaaaaaggttgtgtgcttgtgaattgtcacggcattcttctttctttatagtaggtagtgtgttgaggatgttgcgtctttcacaatcaaatgttatcattctcggtgctaattttctactgcatgttgtttgatccagaccagcaacctgcaactgggcgagctgctgatcaatgaaaagcagcatacggtggtaattaagaaatcaggggtttcagctctgatctgttgaacagttgatggtta

SEQ ID NO: 49840 - DNA, 1501 bp, Oryza sativa
gtagcagtggcggttgatgatgattctgtgtttcgctgctgctgctgctgctgccgactttggcggattgattgcgagattccagcgacgggtttttagctaattaattaattaattaattaatcagaggggattaagagtaggtacaatagcacactattagccagctataaatatattttaatgagataaaaaataagagagaagagcagcgggctacagatatatagccagctgcagcacggactccaagacatcgtgtgtatgatatgtgggaccacatatattaatagtgtagtaagcaaatattatatgaattaactattacattgcttagggcagtcccaacccataacactagacatagtttccataaactccacatcatcaagaaactagtacggagtactagacactactcttccaatgcaaacaccactattccatacttcaatttaatgctacttatctcacatgatgtcttagatgttgtgaagaaaccatgtctcatgcaagacatggtttccttctctttcctcatttattcacttgccacatcattttttatcctaggtggcaacttatttaatgctatagacacaatcctagtcattgggttgggaatacccttagagcatgtataatagcaggctattagccagctataaacatattttaatgagataaacgatgagagagaggagtagcgggttacagatatgtagccagctgcagcacggagcccaagacacactgtgtatatgacaggtgggaccatatattaatagtatagtaaacaactattgtatgaattggctattagattggctatagatgaattggagctagtagtgggctgtactattagacttgctcttatagatgaattgaagatagtagtgggttatactattaaccttgctctaatcgctgtgttaagagcatgcccaacagtcacccaatatttgattcccaaaaaatctgaattaggaattccaaaataagaattgggcccaacaatcaccccctcctccaagagaggcccaaaaattaattccctatcatttgttagtttgccacataagcaaggtgggcctagttcggtaccgatcgatcgtctccctccccgcaccagcgccgagacttctccctccccgcaccttctccctcccacaccagcgccgccatctgtgtaaatcgcatcatcaccagccaaccagtgtcctgagtgctgcggtttctacaaaaacggaataccaaggatatgccatagctattcgtgtcatcaaggaggtaatccctagcaaatcctattgatctcttgtgccctagtcaatatctgtctctatttggttatgtggatatctattgttggaaaatattaagtttgatctaataattaattttatagattgattattgttgtattcctgccatcggttctctccattgcacttcatccctgtggtaaacgctccaaccctgtggcaataaaaaagag

SEQ ID NO: 49841 - DNA, 1501 bp, Oryza sativa
gctgggacccacgtgagtgggccatgcatgtcatagaggaattgacatgggttttccctgacatttgggaggatccgaacggttcaccttccagggtgctttcgagaggatatggcgaccggctggtggtccaacttcgccgcctctctctccgactcctcgtcggcaggagacaccgccgatgccggccgcgccggcgagagagccaggcactctccggcggagtcgcgtgaaaagcttctcgagcgtctcgccggttcagatggcatagaagcaatatgcggcaagcaacgcggccttcaaaatcttcacatttctcatttttgtgtacggaaagctaaggtcatgtacagatgtgccctcaatcttctcacatctcaaatctcattcaataagccaatacatacttatatactcactctgtttcacaatgaaagtcattataacatttcacatatttatattgatattaatgaatctagataaatgtgataaatgctataatgacttacgttgtgaaacggagatactacatatgatccagttgtacaactcaaataaatatacaactataaatcaatttagagaacatgtataatgcactgcgactgtttataatcgtcgatcaaattcaattgtacgtgagtccaactgttgggacgtatgcataacaattttgttttcaacttcatgcgcgtgaaagtattgtgttcgtggtggtcaagttcctgcctcttgtgttctcggtcgtcttgggcctcggccaccttacgtttgttcgccatggcctcctgctgctgcagctcctgctgcgcggccacctgtttcgcctgcgcctcctccatggcctgctgccgtagccgctgctgcgcgtccacctgtttcgcatgcgcctcctccacctacctccggtaccacgcacgccacctcggcgtcacggccttgttcttgtgcatcgcgacgaacctctccaccagcatatccccgccgtcctcgagggcctcccgcccgatctctctcgcccgagcgatgaagaaatccaggatcacgtcgaagaatttcttgtaggagggggagttgtccatcaccccgtggtagattttgcgcaggaattcggagtacttctcgtcgtacttgtcgccgccggcgacgaggccgcagtgggagcccggcgacgaggtggccgcgcacagcctgaggaactccagctccacggcgtggaacgccgggcggaagttgtcgccggcgccgcggtggccgccgccgcggaacgcgaggtcgaggcggtcgtgcgccagcgccgccgcgtgctcgtccgggaaggcgcccacgaggcggtgcttggtcgggttggacgggtcgaccacgcatgccgcccatttgcccgtgcccttgtctcgctgcacgccgacgtagtatctctgtgtcgacggctgagcggtggcttgcgccggcggccgctgcagtggcgtcgcggcggcgggaggagtggaggtcgcgg

SEQ ID NO: 49842 - DNA, 1501 bp, Oryza sativa
tgtagtcccacagtgatctgaaccaccgtttgagatcaggaaaaggattcaatttggcaatgactgtacagtttattctcacttgtattaattacttatcttcacttcagttgtttgttcctgttcagggaaccagaagtttggaagatcactggaaaatcctagttggtgagagatattagtacacaaagcatcgtgatgtctgagatatctacatataacatacagattccataatgatctgcgaggttatttgctattactggatcttccttacgtcaaagatgtttcttttagtcatgccatgatacagacagacgagtactgcttgctaaggagtcacaatcaacagaacgtgattgatcagaaggaaacggcaagtgagttcaggaaaaggtaacattcaaaacaattataaaaaagatgtcatattgaaaacaactctgcacaaatcagggcaatcaaaacttctgtacaaaaagaacaaatgaattggctgtggagggttaaaagggctccttaagaataacctctagaagaacaggaaaagaacagaaaagaaagaaaaaaaaaatgaatattgtacatgtacatgtttcaaagctctcatggtgtttggcatcttcttccaggattgttaggatcattggtgcatccagatgcacctggctttgctgaagttaagaacaccgtgcttccctgtcgtggctgcgatctcgctcccagcaatctggatgcatgactgatggtgattgtggtgctgaagatcagcatgaaaatgagagctagaggcagaacttgctgtcttctgatcggcatagttgagcagctgacctcctggtatgttctgaattcttgtggaaggcgagttacgaaggctgaaaaactggggtgaatataaagactgtgtcaacacgtatatgttcatatgttgtataaatttataatgctcttgagcgcgtttggttccttgtgtgtcaagcttcgatgtgcctacccgagggctcgacgcgttgtcgcggtcagctacgacttgcaaaaccattcatcacgtggttttcatgtaattgtaaaccttgaccttcgcataagagagcttgacctttggcataagagagtcttcgtgtagaattcatacgaaatccctttcacagtttcaacattccagagttttaagtgcatgatcattcaatactattccgtactctccaaggctcagtaaggaatgctaaatctctcgttttcttcatgttaaagaggatgcagcttgaatggtcgaattcacaattgacggctccaccccaaaaaagttcaggatgactcgaagtcgaatccgcgtaatacgctggcgaaaattgaatgggccaaatgtagcccatatccattttattcatgggtctttgaacaattgagctcgaaagcccagctctctctcgtgaaaagcttaaccgacctagctctcgagggcgcgctcagaaccaaaaatttcgaaaaggtaagg

SEQ ID NO: 49843 - DNA, 1501 bp, Oryza sativa
gccagcggtggcgggagagtgggagagaggcggctgggacggcgggagcggtgggcagggcagcgggcgagagtggcagcggagcggcggcgctcgtcatgctccagctcttcaccgccggcgtcttcgtcgtgttggttgacctccacgagcgcggtaggcggagcagcggtgggcggagggcggcgggcaattacgacggagcgaggggcctggtcggcgagcggcggggggacaagtgtggctgcggagcggtggcaggcggtcggcggcgacctcttcgccgatggggcgcaccaccccctctcccgccggcctcatcttcgccgatgatgcgacgaggttgatgggctcctcgtcgtcgttgccgtccccgggtgggagcagcggcgcggggggcttgtaatcgtcgtcgtcgggcagggcggccttggcgcccttcttgccggagaggagagagagccagccgagcttcactcgcgagcttgtaggcggcaatggcgtccctccgcgcgcgagagaggaaaggccaaaagcccgtgaacgcatgcatgctagctatgggttctcaagtgagggatacatgcatgcagtagagagaaaaagaccaaagcaaaagcagcttgtgattgatttgcaggctgcacgggttgaaagtgacaagatcgatcgatcgaatatatatgtatatattcatgaatgaatgcatatatgcatgtaactctaggcctcgcccacggcgacgacgacggtggagagccgacgacgacggcggccacggcgcgcggctgctccgcccgcagcctccgctccgctgcctccgctccgccgccggacggccgcgccgcgtagcctcgctcacagcaacgacgacggtggagagccgacgacgaccgcggccacggcgcgtggctgctccgcccgcagcctccgcccgtagcctgaaggagaagaggagagaaggagaagaaaatagaagaaaaaaatatgtgcagctgacatgtgagccctacgtattttttttaaatttttttttgctgactaggatgccacgtcagtaaaaccgggcaaaaatactgccgagggaactccggtgaacggtttgagggagtttaggggtacacatttctggttttgtggttaaaggacttcaaaaaaaatctcgctattaagttaagggacctccggtgaacttattcctatttagataggatagaagaacagtcaccatcatggcccatatagtcttcgttagggctggcccactctctgggattgggcccggtgaccgtcagccatggaggattggaggcgacgaggatgaacggctcaaggcacgcaaaaacatatagtccgatcgagagaaaagaactttaggttgccctagctcgtgaatgcattctattcttcggcttcgcgcaacactttgattgttctttcgtctctcacattttacttggagaccacttcattctcgcactagaacaaaaatgcatgagca

SEQ ID NO: 49844 - DNA, 1501 bp, Oryza sativa
taacatcggatactccgacacctagaaaaactcactcgaaaggatttttcaaacaaagacagagagtgaagttctgtgaaaaatcggatagttcgatacatcggatagtctgatttcaaatcggatagtctgatgttgctcaagtaaaaatgcaataactttttactccgaactccgatttcgaagatcttggactctatagaaagctagtttcgtgggctatcaaacccaacataaaaaatggtccaaaaccttcaagagtatataaaaaacttgcaaagaaacccggtgtaagtgttgtgacaagtgaaacaactcgggattgaaattttggcttaggtttttcaactcacacaaagatgaagcattttgagcactaatattcaaccaattatatgcatgtggtatccctcttaatagtacggcatcctaaactcaaatttaaaaggcaaagttataccaataggagtgccttcacaccatattgtttcttcacttggagggttaccaacgtcaaggtcatttgatcatcgaaaagatctcatcttcttgatctttgacatttcatcttccatttctcaaatgattgatgtggataatccatggcttcaaatggcctcgcacggttcatcacgacacagtcttcactcgcccttcaccaccggtttcggttcgtcggcgccaagccccttgcttgcccttcaccaccgcatggtctattgcagctgagtgtcgcttgcgcttcaccgtcttgccataagtagtcacttcatacccgcatcttcaatatcttctctttaattctcatccatcaataagtccatttcctagcttcttcatcggactaatcacttgcttatacactcaataagtgcattagtcccttaatcgtttgtcatcaataaatcaaaacccactaggggcataaatgctctttcacatgtgttttgtcttaatattttagattaaaatatgtcgaattatgaccaaatttccaacatattcatggactgtgtgggagtacatctctatacattgttaaaggcatactcactctgtcgaaaattaaatcaaattttatcatcccgagccaagtttagtgatgatatagaaatatttaagtgggcttcattaatagaaaattctaattgatgggttgataggtatgtgatattgataggataaacttcttgatttacggagtgaggataagtaaatggataaaaatcgacttattttgaaacaaaatatgaactcttgtaggatcgagatgtcgactagaggggggagggtgaataggtgatttaaaactaaatgacacctaatcaaaactaacctaagttgctaggcttggtgagggtcaactctaactaagcaactaagttatgttttgcaaacctagggtgatagtggctcaattatatctctaggaaagtaaatcacactcctatgtcaatgtttagcaatcctagggtgatatgatctcaagtttgtctctaga

SEQ ID NO: 49845 - DNA, 1501 bp, Oryza sativa
ctgatttggaaggagagaccgggagcacgtgaaaggagaggagaacagagagagggagaagatgggaggagagtgagggttgacatgtggggctcacttccgtttttgatacgtaagcgctagatcagtgaaaccggtcatttatactgtggaaggatttaatttaacccgattttataagtaggtatggctgttaaggatgtctaagacgtaaagatgaggaatgacaagtgaacttattccaaacggtgatacggttgtccagtttgggccgaggaatccaggcccaacaaggacaagagaagattggtttggtggggccccctcggcggttgagggctgctgataaaactcaacctatacttcagggacattaaatggacttgttctttaggccgcggaaggcaggcccagtgaaagaggaaggagaagatttggtttggtggggccagcacaaacgccggccgcaaacgaatccatcatctcgcaccacgcaacgccaactctccacgcgccgccgcccacgccgacgcgaggagcactcgccgcccgccaccgcgctctccctctccccccaattccatccctccacgccacgatcgccttccgcaaggtaaccgccctcccctcgccgccgcggctcggagcttgcatgcatgcacgcatcatcatcatcggctcatcgcagatgtagggtagggacggtggtaagtgcagcgccagcttgtgtggcgaaacctagagagagaacactgttacctgcagttccaactacccgttggattaactatccctctctgtcccataatactgttcatttttttggcctcttctgtttgtcccaaaataagtttattttgatttttgagtgatcattgcatcggagtttataaaaatagagaataaatgtattgagagtaagataaagttagcaataattgcattgtgattcgataaattatgggtattttagattttttggttttgtattttggtacgtgtgggatgaatgaaaaatgggatggaggtagtagcttttgtcaaattctcttcttttgggggcattgcatcgcgtcctacatgctttgatacattgccaaagcaatcacctagtcaatttttattttgtaatgagtcaatcagtaagtggagtggttgcacaattacgatgggccgcccaaagaacgaaccttgcagtttgtttgtttgtttgttgcatatatggattttcctttacatattgcaattctaacctaaaagttcactatacaatgggcccaaaggaggagccttgcaggctgcagcctgtttgttgcacgtggaatttgtttgcatattgcaatctgacctacttgaaatttcagttatttatttatgattctgttcctttaccttgtgagattcatatctttactatgcaggtttcttcttcagtgcacatgtgaaactgtacttcacctcccatatataattcagtgcagagagcattcttgaataagta

SEQ ID NO: 49846 - DNA, 1501 bp, Oryza sativa
gattcttgatttctagctttgcaattgattggtgagatgttgttcgatttgttgatggggggctgaacgagctgtgaatctgtgatggcacagatggaatttgggtgggtttcagtcaggtctggtggtgtggattagtgtaaaatgatcactgcctaaagtcggtataggagaataatgatctcctggcctgattattgccgatttcgatcggtggacaaactatattattaaatcaaatctgcattcgtgatgtgatctccaaatctatattggatagagtctatcccttcgaagtctatctgtctgtatacattttttttgttcttggaagttgaccatagtggattttcagaatatgttatccgacctgtcgttttcctttccctttttgcccagttttttaggatctaagttgccctcgaggtcattgtcgtgtatatcctgataatgcattgattttgccaacgttattaaataaacggccatgctatatttgggaggaatcatctgcttatttcttaagtactgttctgtaatctatattgcagggccatgccattttcagaagaattgcggctacagtaaatgtgtcattttgtgcacaggcacatatatagaactggagttaaccttttctgaccactaagtatgtaatttgcttctaatttttgaaatgtctacctgtttttcttggcagatattctgcataataatatgccaaaaaaaaaggatgtttcctgcatacatggcctgtgccaaggctaaaactatacttgtcgattgagagtcctgcagttatgcagaagaattaaatctagaatattgttcaaaatttcttattacataggataggacatggatcgtttcgttagggatgaccaaattgttgtaaccagatcttttcaatggtttgctttgcttgctttgcaaaatttaattctgttgtatgtagcatctttcctcgagctaatattagatccaaaggaatcagttcttctcattatttgcttgtctatgtacttccctttttagtttttttagggaattcgtttttgtgtctttcatttgaggaggaaatgcaattatttgactagcataaatccagaaattctattggctagcataaatgtgattctttgagctggcttccatttatttccagtaattcacctatgtcgtgctaagctgctcctatcatgtggggtgatagaattgtttacttataaactaatattgtaagttatcatgaatcagactcattactctggtgacaatgaggggttgttcccttatctcaatttgtaatctttgcttgtttgttgtatgacttttgagaaagtgatatattcagctttgccaactaggccatttattgagttctaaagaaaatatcaaatttgttcaatcatactcccttgtctatcatgcagaaagaaaacaactctggtttgcctatatacatacatgtagacaaatccacaagctgatcagccaacct

SEQ ID NO: 49847 - DNA, 1501 bp, Oryza sativa
ataaattggttaatataaaaatacttacttgccagcctttcggaatgtgatagccatggtattcgatgtctttgacagctgttcggaagcttccaaatattgggggaacagtccgcagcgtctccaatgccaccttccatgtgtacttcatccttgagacatcatcccaggttaaaggttcattaggccctttcctcctagctatctcctcttgttctgtggttcatgataggtgcaaatgataccgtgctactcagaagattaaaacaccaaaatataggcacacgatacaatatagagtactaggtgctcaccctcggttatcttgccaaggatgtctggatcattagctaggtaccggagcaagaaggtgataagaacagccgaattcccataaccggcagtcaggagtacgattgcattgtccacaatgtcctccactgtgagcgagtgtgtgccttcagagcgcaaaacaagcatgtatgtgaagaaatcatcagctgaactggaatggccttgctgcaatgctgcttccctttcgcgagcaatttgcctgaggaccttcctgatcctccggctcgctctcaggcccttgatgaacttggtgaagggtatattcactggcagagatagcaaagcctgcacaagtgtctcaaagtcggtggcaagggcttctctgatgggacctatcccttgtccaaagacgactgagcagatgatgtcaaaggtgagcctcttcgccaagggtgcagcctataatcaccaaagtagctcacaaacatgtccatactacaaaaagttgtttttactatacataaaggtctaacaattcaaacaacagtaacacaatgttcataccttgacagttttatgaccaacccagttcaggtcaatgtgcctcctgacctcctcatccatcttacgcatatacttcgtcaccatctctagcctcagatagccctgtagagcactgcggactcgctttagctcctcacctgagagtgtcagaatggaccgcccaaggatggtgttgatcgcctttgtctgggtgaaaatgaggtcctggttgctgaatacaaagtgattggccgccgggccagccataagcactgttggtgagccaaaaagtgacatcttgaacacaggaccatacttcttgatcctgtcctggtaccactggtaatcagtattactgcggagggcacgaagaagggagatgctctggccaatcaatgggaagccaagagaacctggagggagattataggatgagtacttgcgcctgatgacaaagcggaggagggtgggtatgagcaaggcaagcagcagagcaaaaggcatggaggaatccattgatggagtatgttgttatgcactatgaaggttggctgatcagcttgtggatttgtctacatgtatgtatataggcaaaccagagttgttttctttctgcatgatagacaagggagtatgattgaacaaatttgatattttctttaga

SEQ ID NO: 49848 - DNA, 1501 bp, Oryza sativa
tgatcttttaattctgaaaaaagatttggttttagtgttcctctggtaaacttggttcttgtatttgatcccacatcaatatttggtagaaaacacccaaaattttatgtctagattttcaaatataatttgtatcttttcttttttcttatctgcatgtataataatggatttgtaagcagtattcgaaaatatattgttcatttctggtgtattattttcttcttttttttgctcgtataatgaatacaatagggaaacaatattccaaaaaacctttgtctgtttcaatgtcctaatattttttcccgtttccactcctaatctctttttttctattctttcgattaacgtgggattttgtaaaccgtgaaagccaacctaaagactctttttctactactttctaagttaatagatcacggcttaaaagtttatacacaagaaaagtttatatatctgatttggattcatattcaaatgtttctaataaaatgtttgtatattaaagtatttttacgaagcttgtatagtttttctcgatgtaaagtttgtacttataaacttatattaactttcatggatagcatttcgtggtgggttacatgcccggatgcacgtgcgcgaacaccccccattagacccacccgaagctattgtagtatagatttactccctcggttcttaaaaaagtcaatttaagggctcctttggatgcacggggagaaaacccctaggaaaaaaccccatacagggattttccctgtaccaagtgaatccccccccaaatctctagggaagcactttccgctaagggagatttccctgctaccatttggaagcagctcacgggactgggggatgattagggtttttaagttttgagcctactctaccaaataatggctagttggagcgcacccaacaagataaaaaatgtctaaataaacataaccgagcacaaaaatagaataattaagttaaaaatgcaagaaaaaaaaaatctgaaaatcatatgaactccaagtagagcaataaattctagctaaaatagagaacattatagatacaagcatcaacttagttcatgagatgatcaaattgaggtaccatctacagtatttagccaagtattatatgagcatccaagaaatatcactttcagcaaatacaagatgtaattcatacaattatcatttacaaatatcttggaagtgttttcctcctgcattcatgagcatcaactatctccatcgctgctccaaattgagaacaaggctgaatatacaagggcaaggcctgttgcctacatccaagaattaaaaacacaagtaagggtgcaacctgtaaggcttattcgtttaaaaggaattgcaaagaaaaagcataggaataggaatatgttctaaactaccatttgtttcataggaatgcaccataggaaaattataggaaaattttcaattcctccattttcgaaggaaaagcataggaaaaaata

SEQ ID NO: 49849 - DNA, 625 bp, Oryza sativa
ggggccgcctgcaaatgggcggcgagggggcatggaattttgcaggcggcccccttgccgccctccgctagggcgattttgtactgtggggggggggcgcctgcaaatgggcggcgagggggcatggaattttgcaggcggcccccttgccgccctgggggagggcgatttttgcctcccccctataaagcccagtcccccctctctgaaatttcattatattcactaaaaatccaaaaaaaacgaaagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcagatctgtagcacacagcacatatgtgtagatccagagcatagaatataatagtatgaattgagacatagacagtagtgttaattgtaagatgtagtttagtttgatatggagaatgtaacatacttttagaattttggagaacaatattgtagagaatgtaacttagggcgtagtacagaaatgcgaggttaacgcagttattgttttcatcaggcacaa

SEQ ID NO: 49850 - DNA, 1501 bp, Oryza sativa
acggcggaggccggatctgccgccgcaacgacgggggagaccagatccgtcgccgcgatcgccgcagggccactagtctctaaagtctaaattatatatttaaaaaacattacgaatataactttatgaaagagagtttctcataaaaatataccaatataacttttcatattttaaatatttttacgtctattaaatttttaaggtttcaagatttgactgcacttataggagatactactatacaagaatcaacgagaagcgaatttttaagttgcgataaactggtagtagtaagattttgtgaacaaggataatgcatatctgcgtaaaaaaatatatagtgcaaatcacatgtacattgaaaatctagaaactattgtcacaagagtaaaatttttaccaaccaaacggccacaatgtcgcgcagggcttatccggggcactactgcccttgggctgaaagtgcggccacaagcccacaatatcttgcggggcttagccggggcaccacggcccatgggctctatctccctcaccagtaaagccctagcctccaagaccgcacccgtataaagccgcagacctctctctccttctcctcccccgccgccgccacttgcctccgaaaccctagccgccccctccccgcggccgtgaaaatggtacgcttctccctcctcctcctcctcctcctcctcccctccgccgcacgacgggaagatcgcacgcgtgcttgtcctcgtgccagtccacggctccgcgcgcgccgtctttctcatggtctttctcgatgggtaggatgcgttctttattcatgttgatctgccgtagatggggggatcttgagccggaggagtagctagtttctttgattatgcgttttggggtctagcggattttaacatgagatggtttctctttagcgacatttttttttgttcatgttgatgtccacggtgattgttctagttatgtcatttttatcttcaagacttaaatgctttgaatcgccggtatagaccagattattgtcgtgaagatcgacgtattttccgagctgaccctctgcatgctgaaaattttgtagtgggttatatctagattatatgtgtattgttgtcattcaattagcacttaaacttctgtagcataaacattttcatcatcttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgaggacccaattgaggttttaaccattggtttgctgaatgtgtcttcagtgttgaaaaatttggacacatttgcttcaaattatgcacattcgactgttgtttataggcctgcgatgtccattccacattcagtatttgttaagctgactgcttttgtttcaaatttgttttgtat

SEQ ID NO: 49851 - DNA, 877 bp, Oryza sativa
ggcgcatcgggtcacggtggttacgtcttatcccctcggccaaatcttgtataaccgagagggtactggacgggtggtgaaatgggcaatcgaactctctgaattcgatttgcgctttgaaccaagccacgcgatcaagagccaggccctcgccgactttgtggtggagtggaccccagctcccgagcttgtctccgcccccgaggccagctcgagcccatcgcagctgcctcacaccgccctttgggtgatgtagttcgacggcacctgtaggaaccggccccacctgtcaccaggccttagaagtggcgtcacgcccgaccgcttccctcggggagggcgatcgccctggcataacgccgggggctactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccacacgtaatgcagtacagcgcgctcgttcatccggtctgtgatcagtcacaaaccggtcagatcgtgggttaggtggcgacaggcggtctgacgcacgcctcgccccatcccgtcaggacgagagcctccaagcactcgtccctagccggagccggcgtgttacctcctggagatggcacgttggttccggtcagatatatgccaggcttcatcctaaccattacaggcaaga

SEQ ID NO: 49852 - DNA, 588 bp, Oryza sativa
ttattttaatgccgtggagaaatgaggggacatcggcatggagggttaaaagactctcctgcatttataactgcgtatatcgtaattaatttaaacattttgctacctactccctctgtcaaaaaaaagtaaaccctgggttttttgtccaactttgactgtccgtcttatatgaaattttttcataattcgtatttttattgttgttggatgataaaacatgattaatattttatacgtgacttgtctttttaattttttttcataatttttttaaataagacggacggtcaaacgttgggcacagaaaccagtgtttgtcttttttttttgggacggaggaagtatttgtttccctatatatgtttttctatttttttggagagaattatcgtcccatttgtccacaatcatgacgacagagtacagtgtaagaggtagagtggcaactagctagcgagccatggggtcctgagtgtctgtctgatcggttaggtacacgtcaccatgccacgtgtcacaaagggattagcaacgacagtgcatcagctgcacctgtagatcgcaaggtgcatgaagacaatcttc

SEQ ID NO: 49853 - DNA, 167 bp, Oryza sativa
ataaatgtgccgtaagcatgcatcatatatagattagctagccagctagctgccacaaaattaaatcatgaacatgtagttgtgtgtagtatgttattagcacaagaaatcatgtactaggtgtcatgtactgtttagtatatatgtgcatcttatgtatgcaaaca

SEQ ID NO: 49854 - DNA, 1500 bp, Oryza sativa
aaaaggacttttaataactaataaataagtattaactttttatatcatatgtaaaagtaaatttgtcacaaataatatggtgcattacatactcataaatataatagtctcatccaataaatttttacattccaacaatatacttcattaatttattatgtttcttcatagcaaagggtaaaatggacttttttaaaaaaatttaacggtcaactagcgaaaagggcatggaagggatccaaactaaaattcaggggtatgtaagggattgagcaaaattcaagagtatagaaaggattaggtgaattatgtttttttttttttgcggggaagggtgaactctgttcataggtacataggggattttatcaaaatcaaaagggtatctgtgattttatactgtggaaaagcgcccccaaacacgaacaaaagtcaggttggcgtgttccgtcccgtagaaatttttaggattttgatttgaacggtcgagttgcgattttgcgaatctgaatgtagtgcagtagtactctattttcggtaggacgagagagaaattctttcagtgtatatgcattttggtcagaaaaagtgcacatcaactgaaataatgcatagtacgtagtagctgatagctctcgcgagatgtttgcacaattatcaccgatccgatagctttcatcgtactatatctgtcattgacaaattggtactctctccgtcactataaaatatcagcacgtttgaagtatttttatgagataagacagagagctgtattttataacgaagatataattgaagcatgattactatttatgttgtggataggcgattatgataaattgagggtattcgaaatatgcatggctggcgaagccatcgaaatgtcacatgttggatggagaaaaaattaaccagtgctacagctactaaaatagtttattggtcatgttacgttacgtattaaggaattgaccaaatttattacagtaaattcaaccatacactcttggtctcaataaaaaaaacttctggaaatgaatctgtatgtccaaagatcaaagacttcgaagtttgtttttttatagagggagtgtgtgccgtttaacgaaaataaccgagaaaacccagatgtagtcctagacgtcggtccgttcgtttctactttaaattaagatttaaagcgggcatgtaaaacgagaaagctattaacgtgtgataaattgagttttaattactacaaacatgaaagatgatatatttgatattttaaagcaactttcatcaagaatttttttttcacgaaacatgtcgtttaatagcttgaaaagcgtgctaacggaaaccgagataaaatcttaatccgcatgagaaaataacaaggaaataggacattctcccactgctaaaagagagttttactcaaatgccactccgcggattgttaaagtcactcccaaccgatgccaaactattgtttggcatgtgttctgaccacaa

SEQ ID NO: 49855 - DNA, 176 bp, Oryza sativa
tattcatgcctgaacaactatcgatttgcctcgtgcatgtcatgtacgggagcaattccttctctatccaaattctaccatatgagcgggagcaatccccacaattcttgaagacaacaaaaacaatgctagctaggagggcgaggcatgcagatttaaaatacacgtcgacacca

SEQ ID NO: 49856 - DNA, 1501 bp, Oryza sativa
  unsure (1)..(1501): unsure at all n locations
attacttaaaaataactgaatatattttaaaaagaacctaaataattagggtgtagctatatatatggcgccatatttttcatcaaaaaaaagtcagcatgtatttacattgtaagtccctaaattacatatgtaattttagtgtatttacaatgtaagtctcaaaattaaattacatatgtaagtactaaaattacatatgtaaattcgaaaattacataccaattacatacgtaagtggggtgtaaatgaggtgtaactactctgtaagtggctgaaaaaaaatcgactgtagtatatggcgccatatttctagcaaatccgaataattaagctacgttttattcacagcaacgttgtatttcgttatactagtatactaatgctccaaaaggcagtttacaaaaataaaaaaacaacattatcttgtcagtactaaagtttttacacgtggacaccccatcgcacaaatcttgtggggcgcacgatgccaggctcacgtgacccgaatttttttaagcctactttggttaatctgtcccatcaccagaacattttggcgtgttatacgtcgccagaaatctctacggccacctatagcatcacgagccccagtctatggcacgtggtcccggaggacatcgtggcccacgtgccagtgacacgagcgtgcggtgcaggcggttcgcgagggtgtggatcgcatgtgtgccccacgcgatgcctcccatccaacggccacctgtccatccccaattccaacctcgacatggaaggttccagaagcttccggaaacgaccttccccatgttcgcgtcgcgtggcttctcgtcgaaggaaattttgccagaattttcgcggatatttccttcacgaaaccttggtgggagaagggagatggaattcccaatggcgtgtagaatttcaatttcgaattatgttttaaaaacggcgagaaaatgtggaatgacgcaaatgcccttctgcctcctcgcttcttttattgtcctcctccctcctctctgtcggtggtggctcctcccctctcgttgcttgcctccccccgatctgcaaagccggaggcgctcccccggcggcgaggcaggcacggcgtggacggcctcccccatctccngtcgccaccgcgccctagccttctcactccctcccggcccccgcgcgcgcgcgcgcggccgaccagccggtggtcggcttccgtctccactcgaatcgaattcgaggtatcatccattcccctcccgtatcccgccctcgtctccctccgccgcttcacgtgcccggcgtggcgtggactggagacccctccggcttggattggattggattggtttggttttccttgttctggaattttttaaaaatttttgatgcgtggtgcgctgctgattttttgcagtttgtttggagagaaatcgggggttctaggtgaacccccatgcccgacgttggcgcggtgatcgaaggatcctcgcggcggaga

SEQ ID NO: 49857 - DNA, 1396 bp, Oryza sativa
gcaccccgatcgttttccttccgtcttgatccacccacacacacgatatgacgtttctacccctcacaagtacaagtataatgcatgtcaatgaggggtataaatgtcatatcatgtgtgtgactggatcaataacgatcaagacggacggaaaaattgacggaagtgctaaaaataggaagatggtgaactttggatgctattaaagtgaaccggtaactttcggtgctataaaaccaaaaacgtgaactttcgatactatataatcaattttgccttaaaattatccggtttctttatttgccattcaaaattgactctttgctttattgctattggacaaaattttgctacacctaatatgccactaccgttagcccctgcacgtgaactcgccgttagttcctcggatcatgtcaaggttttctcagaaatgtcgatcctactctcatggccttgtcattcttcctctctttaagttgtcctggcaagcgccaactatcattcttgcgcgactactatcctcttagctagaaaggtaagtgcatgcctagacctataggctacaacatcagatctatgtccttgttccgatagttattttcggataatttgagacttagtggaaagagataaacaaggatattttggtctttttactgttcatctaacggaccgttgatgcaagattgacggtaatggcatataaggatagcaaagtttcgcctaatgtcacgtaagagaaaagtccattctcaatggcatataaggaaactggagaactaataaatttcgtcttgtaagaatgtatattagacgcgcacacgtgtacatgatatcatgggacaacgtgtgcgtccaatcgtactcttggtaaaaagggacacacatgttggtggtctcgtagctgctgcagcccgacgcttccatgcccgatcgacgtcaggatgttcatctcgtgggctcgcggccgatgtgaaaccgcggcgccggccagtgcccccagccaggcggccatcaacgcatgcggcacgcacgcacgcacgcacgcacgcacgcacgcacgccacatcacgcagcctcggcgtggacggctctgacatgagccgggacgtcgcggccttcgcgtacttattaatctcccctccccgggggggaacaccgactcaccaagttcgcgtcctgctcccgcgtcgcgcgcgtgcacacacacacccacagctagcgcaaactaaggctaggctcgccgcgagaggaaggtaagtaagtacgtacatttgcgcgaggtggacgagcttgacgatggcgagtgggcaacgagcggtcggcgaggggagcggtggcctccgcccgacgacgcacgtcgcgggcggcggcgggagcgcgcgcggggagt

SEQ ID NO: 49858 - DNA, 1501 bp, Oryza sativa
gctctccacgctgatcgtcccgagtcgaaggcgccgacgagggagtagcagccgaatggcgtgcaacagccgccgctcgccgcgccctccgccttgacgacacggagccagtggtagcggcgccggaggtcctggtggtggaggaccgtccaccagcacccaggcgctgctgtgccgtcatgaccaagttggccacgtcgtccagccatcgctgggctggagactccgggtcagggacgacgggcgagtgacgtaggagcgcgccagcagcctgaagcgcgccctggggcgtgctgccgtcgccatagacgaggaggcaacgctccccatctcgccgttctcctccatcgcccgcgatcggtgaagccgcggatctatcgaccctctcgagcgcctccccctgcttaggactttggtgtggaggaggcggtggagtacgagctcgacggcgtgggtttggctccccgtcgtcgccgctcacactcggagagaggtcgtgcgcctttgcttgcccggccattaggctgaacaagaaaaacttggcgcacacagaaaagtgcgagagctcagaaaacacacgctgagccccctacctggcgcgccagatgacggagtgtgggggctcctcaccgggagaccgcacaggcccccctatgccggttcggccgggggctcagggtgaaatcccaagctctgtctatatgtggaaagatcgcgacctctcgaaagagcatgaaacaccagcgatgtatacaggttcgggccgctgagaagcgtaataccctactcatgtgttttggtggatctgtgtatgaaggagctacaaagtatcagccagcctctccctccttctgggttcccgatctgggaaggtccagtcccagcccaagcctgctctccctatgggcaaggtcctccttttatatttcaaggggataccacatgcacccctctctctcttttcataaatggacggagatttgtatggttgccgtctgaatgaccttttatgggacagcccacacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggaggtaacacgccggctccggctagggacgagtgcttggaggctctcgtcctgacgggatggggcgaggcgtgcgtcagaccgcctgtcgccacctaacccacgatctgaccggtttgtgactgatcacagaccggatgaacgagcgcgctgtactgcattacgtgtggcgtgacgtgctcacccaaaccgcaataaatgcggttaggtgagccccgctgcgctcacctaacccatacacgcggcgcaaaacccacaagg

SEQ ID NO: 49859 - DNA, 1501 bp, Oryza sativa
attttcccaacaatatactcgtaacgctacctagctcacttttttttagaattacacagtacaacgcaaacacttaccgatatgaacatatacacacaccatatctttataagcatattaaaaaaactagactagttgacgaagttatatggacatctcgttgttgacaaatacgccgtcttactactaaaaggataaatagccgtaaatacgaatgctcataagtctatgacttaacctgtaaattagagtcaccgtaaatatgccctttccaattcatatagtatttttttatccatatataaaaacacgaggcgtgaaaattactccctataaaaaactgtgcgaatcgtaagataatcttgtctatatataaacataagccatttatattgttccaaccatcaaataattatatgagatagtaatatatatcaaaactgattcgcagccatacaaaaaactacgtccccctgcctctctgtgttgtctggttatgatatacaaacgcaatgcaacaatttatagtgtatgttaaatttatatcgttgctagtacatcggcatgtatcactggtggagaaaccatctttcgtcggtcggccgatttccacaatagtcccggatgcaataaaaaccagggctaaagatgatctttagtcccggttcaaaagggtaacgggcatatttgatctttagtcccggtttgtgttaccaaccgtgacggagtgtgggggctcctcaccgggagaccgcacaggcccccctatgccggttcggccgggggctcagggtgaaatcccaagctctgtctatatgtggaaagatcgcgacctctcgaaagagcatgaaacaccagcgatgtatacaggttcgggccgctgagaagcgtaataccctactcctgtgttttggtggatctgtgtatgaaggagctacaaagtatcagccagcctctccctccttctgggttcccgatctgggaaggtccagtcccaacccaagcctgctctccctatgggcaaggtcctccttttatatttcaaggggataccacatgcacccctctctctcttttgtgtggggacttatcctatcttttcataaatggacggagatttgtatggttgccgtctgaatgaccttctgatgggacagcccacacctacctccacttccgccggaagcaggcgcgacgtgggaacatggctgtctgctgacgatatgaccagtgtcagaccggtcacaaatcggtcattcttgtccaccacgcgtcagtttatcaatctgcatgttcgcccttcttcatacaatatcttgcctgtaatggttaggatgaagcctggcatatatctgaccggaaccaacgtgccatctccaggaggtaacacgccggctccggctagggacgagtgcttggaggctctcgtcctgacgggatggggcgaggcgtgcgtcagaccgcctgtcgccacctaacccacgatctgaccggtctgtga

SEQ ID NO: 49860 - DNA, 1501 bp, Oryza sativa
gtcccacgagatcgaggaaaaggtgcgcgcgcgtcgcagacgcagatctactcccccgccgcgcccgcgcccctgccgtgaggcaagggagttgaacagtacacaggaaatgggaggaagacccgtctcgcctagcgctccaagacccaagtgagtcaactcttgtgctctgtaaatttccggtacacgttcgttggttgtccaggcctgggaattgcttgtatctgaagaaaagttgctcgtctgatccacgaatttctgtccttatctttgtggtatagtttcacacacgggtgaggtgataggactccaagaagaactggagaatggattatcataatttctggtatacgtttactcgaatgcgtgactacaatttggaaatttccttgtttcacactaaggtctggtttagttcccaactttttcttcaaacttccaactttttcatcgcatcaaaactttcctacacacacaaacttccaacttttccatcacatcgttccaatttcaatcaaacttctaattttggcgtgaactaaacacaccctaaggtatggaatacccccaaactttttataagaaaatgaacatctaacagcacacgcttttgttttggatgaaagctcatgtgaagtttctaatcaagacaccagacacatctaaagtgtgcctggaaggtttgatcttatttaagaaccattagttacatagggtccagtgacttggacttatgtcacccaaataatcttatcttatgttccagtggtggttagtgccatataccaaaaacacaatttccccgccactacctccagtcctccaccagtccaaccctccaactatattgtcatctacatcatacgttttcacagttttgcagtctgacttgctcttagttgttgcagagaattggatttacaaactgagcatagcctagaaggatctccaccacctttcccttggcaaaacagaaggtcagttcaatgtttctactccatatgtccatatgtgtggatgtccactaaatttgtgctttggtcatgcctattctgctctattcttacgtatttgctcttctacaataaaattaggatggcaggagtaggactggtagttggaggatggattgcaaaggcagtgattgccaatatcttgtccagagtacgctccctcctccacgataatttcagtctgcaaaaggacactgaaaaaatgctgaatgacttggaggttgcgcttcctcgcattgaggcggtgattgaagcagcggagcggagatcaattgaaagcagtgccctttccacatggttgcagcagttgaaggatgctgtttcccatgcaggagatgttgttgatgattttgaagccaagacaattaaagatcaggtcgaaagcaagagcaaggtcagtgcaaaggcatactctaccgtcaaggctttaaaggctttggtcttttctgatagtgaattgaagaagctgaagcatgctgtaagaagac

SEQ ID NO: 49861 - DNA, 394 bp, Oryza sativa
ggggaccgcagacaaactcaacataaagttgagggacgtcaggtgaacttattcccttgtagttaaggaagtgactttatccctcaaataagttcacaataggtcccttactttgtcgctccgtatgtttttggatctttttcgcacggtttatgattagttaacttattcccttatagtcgctaagtctgtttttcatccttatccgaaaaccatatactcgctccgtattttaatgtatgacaccgttgacttttcgaataatgtttgactattcgtcttattcaaattttttgtgcaaatataaaaatatttatgtcatacttaaagaatatttgatgataaatcaagccataataaaataaatgataattacataattttttgaataaga

SEQ ID NO: 49862 - DNA, 1501 bp, Oryza sativa
cttgtttaatgctgctcatttgttgcctcttttcaagaaaatgaaaatttgttacaattgcgtggtctagttcttgttttcttccatccctgtattagataaggagtttggtaggcactgtcacatgattttgtgccgcaattgattttattcattagattagtaacctaaggaatccaagaacattagggtacattaataaaatgcaaagaaacagggacagaagagagtaggttctttactttgcccagttggcatcccctgaagtgatgcttgatgcttccttccattttgattatctcttgctgctgttggtggtaaatcattattattagtactaccttttttatttttcggaagaagaaaaagaggaacaagccaatgtggcctacataatatgtggtctagaaagttggcatcagtagtgtgtagatgcaatttgaggaaattaaggcagaaaggaagggacaggaaaaggggctgaaaggtttgcttgagcatagtgcatctccacaccttaaaattgctggtcaaattgtccttaaaatcgtttatatcacgcagacggcatatcgttttcgacattgccttccttaactcctgtgttaattcgaccacaactttagaacagcttgttgagatttcttaatcccagtgttgtatgtcaacattgcattgattgtagtattattatgagaagattagatactgtaacccctccagagagtgacatccattgccttctgttactggatttctgccaattcttagttagatttatggataaaaagtttttaaccaagtagacttaacaggaccaaaggttgaatttgttcacctaagaaaaatgtacaatttgttgaacaaacagcacaattcttgaatgaggagatttttagtagtcaggtttgttgtttggatatcatagtttttgaatgaggagaacatattggttggatttactgcgtggacatcacaattattgaatttggagaacaaattggttagatttgttgtgtggatatcatacttcttgaattagaagaccaaactagttgtttctttgaacaaattggttagaattattttttttttaaaaaaatcatttttcccttcatgaattaggaacagacagattgatgcccatgttaccatggtggtgtctgactcattgcagtcttatctttttacactctctagttttcccaagctgcaatcatggtggccaagtgcatgccatgatgcacctctcatataccaccatctctgcatgctcaagaacatcatgattttttgttcttcttgtcaccaactttttttttgtttttccccctaacttcttttcacccttgcaacgcacttctcactcgtagctttagttttcctcttgtcagtagcatatgtttgtttagttgtgataaattatcttttttttccagatcatgccttgtgctgcggccgagctcgccaatggcgaggcggcggcagcagcagcatgcgc

SEQ ID NO: 49863 - DNA, 221 bp, Oryza sativa
cattggctcagttaatcagtgattagcagtttagcactactaagtaatttcgaaatcgaaatctttgtaaattaaacattttgaatttgaaatggtgacatagctcattccccaagaacaatgaggagaggaaaaaaaaaacaaagcatggagtggtgcagtgatgttctacagtacttcgattgagcttgtaggcgtgtgcattctctgaattttttaga

SEQ ID NO: 49864 - DNA, 1501 bp, Oryza sativa
tgtttatgatgtcaccgacgagtcatctttcaacagtactgtctccttacatatataccttccttaattattccattttgaactattttgtcactgctgttttatttgacaatacagacattcggaactggattcggaatattgagcaacatgcctctgataatgtcaacaaaattttggttggcaacaaggctgatatggatgagagtaaaagggtacatcacagtttttatccttggtgttcattcataccgtatccccactttgaagttgtggtcaaatgctcagttttccctgaggattactagttagaagcttatttgtttcctgttcttgttatttctccaggctgtccctactgcgaaaggccaagcactggctgatgagtatggcatcaaatttttcgaaactgtatgttgctgcctgaattgtttgttcttttcactgtcattttttttgaaaagaaagtggcctttgcagtgacaattgttttgattttacactgcactgtgtattccagagtgcgaagacaaacctcaacgtggagcaagtttttttctccattgcacgtgacattaagcagaggcttgctgagaccgactccaagcctgaggtacagataactgtacatactgaattatgtctcaaacatcatcttgctctttgttctaagaaacatatgctcctgcactgtaggacaagacaatcaagattaacaacaagacggatcagggtgccgacaaaccagcagcttctggatctgcatgctgcggctcctgaggagacgttcgccttctcggcctccatcgtttattatttgacattgtttgttccctgtcttgctgttataggaagaatgtcaagaagacacactatgatacggatctggttgtacctatctttgcttccattctttgaagcaactactcatgcttttgacgtagctgttgcaattgcctggggggctactactgtacgctggatttcaatccgttgaactgcaagctacagtgtgtaacgtagtccatgctgtattgctattgggttttcagttaatcaatggatgcatggaatagagtgatgctgttcctgcattttggctcctcttcttcagtaacttatagaggtttattatatatcttttgaacctttttaattttaaaagtaaaccacctcaaaacttcaaatttaaactcttggttcagctttagaaataagtttcgggatagtctatttgtaaaattttaagattgaaaggttcaaaaaatatatagaaaaatctttatatgattctatagcgtgcaacaaaacatataaaggctagataaatacaacgaaaacgtatagaaatcagtacaataatgggtcagctcaaaggggacggtccagtagtatcgttctttgcacagagttcacggcgacgccgagctgggcgtgccggcacttgtcgcagttctccgacggcgtcaggttcaggtccaagcaaatcccgccggtgcac

SEQ ID NO: 49865 - DNA, 416 bp, Oryza sativa
accgaccgaaccggaccccataaaaaaaccgaacaaattacaaaacccagctctgatcttgcacgcgctgatcagtcgctcgctcgctcatgcggccggcgacgaatcaaccagcaaactaaaaaagcgaagggaaaaaaggagagaaaaaaaaaaccaactccctcctccccgttctccagatccgcaccgccaccgccgccgccgcgcgatcctccgccgcgcctaccggtgcggtctccgatccggccgccacccgcgcgggatccgccgccgccgtcgtgctgccattctcacggtgtctgtttttttttttttccgttcgctgcaggtcggggattggtggaggaggcgcgccgggtgggctgtggagtagggggaggaggaggaggagggtgtgaagcggagcgacgaga

SEQ ID NO: 49866 - DNA, 416 bp, Oryza sativa
aaccattgtatccattcctttccatattgtgtgaactcaagtcattttaatttgatcctaaatcaaacttctctaattctaattgagtttaaagaaaaatacacaatcagctataatattaaattagtaccattaaatccaccttgaaatatgtgttatagttctcttatttgttatattcggagtattacagatgttgccgtatttcttttatagactcatgggctgtttggttgctaccctgagaagaagtggcctgacctaagactagcctggcacattttaagtgttgtttggttaccagcctgaaggttctttgcccttgcctgacctgatgcatgctgtctcgtgattagcctgaccttcaggcgtagcagcgaacgtgtattatcttctttcatgtagcacaaagccaa

SEQ ID NO: 49867 - DNA, 1501 bp, Oryza sativa
gtttcaaaatgtttgacaccattgactttttaatacgtgtttgaccattcgtcttattaaaaaaattaagtaattatttattcttttcatatcatttgattcattgttaaataaactttcatgtacatatataatttttcatatttcacaaattttttttaaataagacgaacggtcaaacataggctaaaaagtcaacggtgtcaaacattttgaaacgaagggagtaactatcaatgctggcctggcttgagctaaaaaaaagatcgttgattttacttccaatcaagtcgctgaagattcaaatagcggcgctcacaattactgtatatcagtagatacagtccgtggaaactcatacagatcacattggacaaagatatgcggacagtgtatgtacatcgtaacaaaagatttggcaagattggaacaactgcaaacagcaaactacagtacctgagatagcatacagagctacagttttattactgtgtaaacacaatcaccagaccgcctcacaagataacatctactctctccgttttacaatataagtcattctaacatttcctacattcatattgatgttaatgaatctagacatatatatctatctagattcactaaaatcaatataaactagctgggtggcccgcgcaattgcgcggctagcacccaaacaaattcatatattttttaggatgattttacttaaaatttattaaatagctatcttattatcttaagactttaaaagaccaaactttatcatcctcgtgtttctacatatagtttttaaaagtcacaccagttgctaccccttctttatttgcttgcttgatctaccactatttctattcattcttcttggaacctttaaaaattggattttatagtttttagagtttattgtcacattgggttttgtttttataatttctagatgtcccgtcaaacgttgccattatactcctctatggcccgtccactgtttcttctctttattatcattgagatttcaaaaatcgaacataattatcgtttgggttcatttttactttctagaagtcccgccaaaccgtcagcggctttgccactgtactcttctacggctcgcgcactgcctccgttctttattgtcattgagatttttaaatcgaacatgattatcattgggtttttttaatttttggaagttccgaacctttaaaaattggacttgtattttcattttttataatttttagaagtcccatcgaacgatgccacaatgcccctctacagcccgtccgccgcctactctttattacactatgattttaaaaatcaaacataactatcgttggaattcattttttattttctagaagtcccgtcaaccgtcggcggctctgcaactatactcttatataccccgcccgctgcttctcccttttattgtcattgagattttaaaaatcgaatatgattattaatggggtttatttttttactgtctaga

SEQ ID NO: 49868 - DNA, 341 bp, Oryza sativa
aaggaaatggaataaggttggtacattgttcttctataatcgtgtggttttcattttttctggatgtgttctttaggattatagctgaaccataggtagactgtgcactgaaaaattgttacagtattacaagttgctgctaaaacagtaactagcagatgggttcccacaatccaacatatgtcagagcatgcctgcagatcactgtttctgaacaatttagtaatgctgatacttgttcatatgtttttatcggtgctctagctgaacagtgaaatggtgtccttggttcttggtattgtagctgaacagtttttatctctcttttgttttctgacaga

SEQ ID NO: 49869 - DNA, 394 bp, Oryza sativa
taggacacaaatttcttgcaaccacactagagtaagttattgtttttttttaagaaaatggaagtcgtcattggtttacacgagacatggttttcactgtttttaggttagtctctaattttttattgaactggacgctagtgtatattgtataatttgatgtacatgttttgcaactgcttcaaacaactaaataaatgccctcaccttttttcatcgttttcaggtgcccttggtagctcaaactcatccttcaacaacatagatcatctgagacaatcctcaagttctggacaagctaggagctacacatcttcacccctaggagctctgagaccaaagatgttcccatctggaaaccgactcctgcacacaagtcgtcccctgtcggctc

SEQ ID NO: 49870 - DNA, 1501 bp, Oryza sativa
agcgaatggacttaaaaactgactcaaacacagatgatgtaccaaaggactggcaaaaacatcttttataatagtagagaagtgattagatgaattgtacacccacgtgtgacgtgaacgtgacagaccaagcacgcactcttataatttgacacttgacccctacaactttatctttcaccaataaaaacttttatgttttggttagtctaagtaatatagttgtatttaggatgcaaaatgctttaataatatgatgtatttttaataaaagaaacgatgagggagttagggcggaactgggtctagggcagcttgggcctgagccctactcgtgagaaaaaaattagttgactagtacttataatttttttagattttcctaaccactcgtggcccagccctactcgtgtggcctagcctcacacatagcttttcctagcccaggtctcccagcccatcacaacccaataggcaatctaccctaatcccacttcctctcctcttcgacgccgcatcccaaaacatttacgccgcatcacgcattcacactcgtctcctctcagctcctctcctctcaccacatcgattatggttgcgggcctgcggcgcacatctgctatggcgtgtcttggtggcggtggcgacacgcatcgggcgcgcagagagtggcgtgcattagctgcggcagcaatgcgcatcaaccgtggtggcaacgacacgcagcgacgcgcatcgatgacgacgacaccgacgctacaaataatctagccccaagagcaatctggtccttttgaattgtttctctttccatctagcccaaaaatgataaaataatgatgaaagtgtctaacaacaaattacacatttttttaagtgtttctcagtcgtttcacgatcttgtggtgtcccttagctaattacacattttttttatgtcctgtagcaaattttgtcttttttaaggtaaaatttgattggaatcagcacgagactgtgctatcattaaataaaatgggagaaaaatacaacccctagggttagaaaaaagtaaagttgtacagagatgaaactcactagctttttaacaccagctagggtccaagttcatgtttcttccattattttgttgaacaacctagggccaggggccgaagtcttcttttgtttgaagttctctccattccagatctcccaaataaccagtaggatcaaggtacgcaagcatttcttaggcgcatcttttttttttttggctagcatctcccaccatgccaatgggacgtcgtaacacggttcctattagcttgggtccagctgctaaaatatgaatgtcaaataaaaaaactgcaaacaattctactttgacatagttgttaattacatatgaaagcggcttaaatcagattcctgtcaccccgttacgaaagaagtatgcggatgccattctgtcggtctctctcaagtctcaacacataaaccctttcacactcatcgtccc

SEQ ID NO: 49871 - DNA, 173 bp, Oryza sativa
tccttactccataactctcccctattgtttccgccactagaactatgacgcattcacgatgggtgatggagctctaggcaatatgactgggttgcgggcgaagcgtggcttgaggcaacgtgagcggatgcggagcaccagacgacgtctatctctctttcttcgtccacagc

SEQ ID NO: 49872 - DNA, 161 bp, Oryza sativa
atgttccaatgctgtacgtaaagtagaacatatgcaggactaaattctcataattctatttattctaatgtttctgcatgctattacaggttttatcagaatatagaagaagaggatttgattttgtaacgcaggccatcacctgtccaacatatttgaaa

SEQ ID NO: 49873 - DNA, 446 bp, Oryza sativa
atataggaagagagtgaggggaagcttcggaaggagtgcccgaatggcggttttctctctgggatgttctagagatgttggcctacattcgggatagttctgaaggagcgccacagttgttggtcctctctccaatcttgtatctcgagaatgtttcttcgatataagttatttgtgatatcattttagtatttagtttacttacttaagtcagatatattctcatcgttgtggtttcgccgcttagtttatactgagtgctctagaacaaagactctagataaggaagaagatttttgcccgaggctagagtagtaattaattaataacgtatacgtagtgtctaggttaaaggttaccttcgtttattgtgtgctctatagaaagtgaggtaggcggtagatggtgatagctctgtcagtcccttgtatctctccacgtttagg

SEQ ID NO: 49874 - DNA, 532 bp, Oryza sativa
aactggagtcataagtctaaaatccgcttttctcataatacaagtggctcatcgttgccaacccgcacatggtataggggcgtcacatggagctaagcctctcccaacatgcaacatgagccattccttgccccgccctggcgaatcctaacgaggaacacatgtcttacttggcttcacgttcttcacttggtaatagaagagacagatatagcgtgaaatctttaatgtggcaggttggagctaaacgataagtatgtgtgctgtgaaagcctcttatcggactgaaaagaactcacggtcaatatttccatttttcatgaaaaccgttagcaaaccggtaaaaactgataaaatttgaataattttattgtttcttaaaaaaacaaattgacgaaaaaaccgagtggtttgtggtattgcaaaccggttcgagaagtctggttttcgttgggattgtgaaccttgtttcagcctagtctttcagctagtgactgaatacagatgaacctatgtgacttgtttctggcta

SEQ ID NO: 49875 - DNA, 1501 bp, Oryza sativa
ggttcagtcaaattttaaaatcccaataatcaatataagttcatattattatgagaaatataatttctttttgacgcagaactacatatatcatttctttcgttttcaaactaagtgtttgagaaattattgatggttaggaattttaaaggtttgcatgaatctttctctaggagtaaaatatttttgaccaaaggaaataatatattctctaacataaaactacctttttaccaactagttatacacacacaacaatgtgtctatatatcatcccactttcctcttgttttttgacttatcttgcacgataacatcatcaaaaattacacgtgaaggttcgttactcctacacggcatgcaggcgacaaaagtatatatggtctagttggtcacaaaaaccaattcgtgaatcgtgatgaggtgtgcttaaggcgatccaaagaaatctttttcttgtgcaaggtgcgcagcacacactggtccaaacctctgaacaataaattattaggagacaactaagtggcaaaagatttatactagcggccgaccttgtgaaagttgcaatgggacaccagctttaattagctttaatttttttctcttggcttgatttggttaatttgctttgctccaagtagtgtggcccattgccgattaagcaatgaataggtgaaaccaaattgcattagcaaacccccttttgtggtggccatgcatgatcatcacttgctatcacgtaatgctcatgctgtttcttcttgtttggattattgttgctgatagggtgcatgatgtggtttctgatgtgaacaataatcaggggcaataagaacaatgacttaaaatccttacgaatatgttctttgtgatccacaattttattattatatggtgtaacaaggattttagatttgtaagctgtaaaatctgtttgataaaatcaaattttggccaaaaaaaacagatatccagatattcccgtaggcagtgtttaagcgtttatttcacctgttgatatacttatatattgacatgtttgtacatatctcccgagcaaatcgaactatttagggtcagttcggttcctgccttactacaatataaattaattaggagagttaattttttgtttattgaataaagcaaagtgtggacgtatcatgccacctttttgccatgttatatacgcatgtgagattaacaatgggccaacttgacatatattttcccattaaatcttgtaattacaaaaaaaaaagatggtatacaaattaagtggcaagccacacggttgtagccatgattagtttacataagcataattttcatagatagcggtgctaaacatgatgggctatcaaaacattgtgtatttttatggtggttaattcttaatgctgatagataggatgaatcattggtttgcacagcaatctatatatgtgttgtgcatgatcttgatagggggcatgactagtttctttatccaattgtcagg

SEQ ID NO: 49876 - DNA, 1501 bp, Oryza sativa
attgtggccgtttggttggtaaaaattttactcgtgacaatagtttctagattttcaatgtatatgtgatttgcactatatattttttttacacagatatgcattatccttgttcacaaaatcttactactaccagtttatcgcaacttaaaaattcgtttctcgttgattcttgtatagtagtatctcctgtaagtgcagtcaaatcttgaaaccttaaaaatttaatagacgtaaaaatatttaaaatatgaaaagttatattggtatatttttttttatgagaaactctctttcataaagttatattggtaatgtttttttaaatatatagtttagtctttagagactagtggccctgcggcggtcgcggcgacggatctagcctcccccgtcgtcgcggcggcagatccggcctccaccatcgtcgcagcggccgaatccggccccgagcttatggcggctagcggtggagaggaggaggccacgccccaccaccgcggagaggcggtagaggcgacggcagccggcggcggtggagaagggaggaagaaggtgaaaccgagagagaaggaagagaggcggcggaggggccgcgcagtgggggaagggagaagggagcggtgggggtgggggacagtagatttatatattcgcccaaaacatttttcgcagtggtcctccttacctactgccggtgaaaatgagatttttcgctggcggacacttaagaggtccgcctcgaaaaactggcagacacttaagaggttcgtctcgaaaaatagagtagtttttttaggcatttctcttagcgtggttatcagcaaaaattggtttctgctggtggtccgtagccccccacctattgttatgtttttttggcggtttttgcatatggacgccagcgtaaaatatagggtaacatcacgaaaaatcgttttttatagtgtaaaattgttatgatgataaaatgtgtattgcggactatgctgatgatgtcactcatctgaaaacagagatagtaacaaggagtgaacacgttacatatgcccacttaacccttacgaaaatgtattcgagaattactaatctaaatgctccactacgtacagtacatcgtcggagattaattgtgtgatgggccacaagaatgagctgccatgcactcgactgaattctgatggaacaggaacaccatacagtattggtaccggcgacagcaacagcaattggtttctgcttctcgcgttgacaatttcactatgctaaccaccactttgtccactaaaacgcgctcatgaccaatgtcaaatcaaacccgtggatgaacgtgcacggcccgagtactccaccaagcaagattcagctgccgagtgaaagaagaaaaagctatttgcaattgctcaaattaaatcaccttgggaacagatgcaaacctacagctaacacagttcgttacggtcctaaccgtatgttttttatacctcgagaaataccaagt

SEQ ID NO: 49877 - DNA, 555 bp, Oryza sativa
gacagagcaagtactgcaatgctacgaaaagaattcactaatatcacaagaccttccaagatactgaaccacaagaacaaatgaattatcttgcaataaaattacgtccctacattccatctctttcgaaagatactgaccaaacgccagtacagttaacaatacaacattcagtctgaaaaaggaagttcactagactaatctctcgaggtcatattcatgtcacgggaagtaattaaagtgggtcgctctatgtttgctaactactaatcaaaagacagcaggtaagataacaaaaaaagaaaagggatactgaggactaaggtaaatagaactgtcgtaagataaaattgcagcaaaatataaacacatgcatcacattggattcaacgagcattaagcaacaaaacttgattcagcagaaagccaatccttgctagagtaaatgtcagacgatgatacttgaatacattgatatggtctgcttaaataagctcctaataacattgaaatattgaagcacagtagaccaacaactatagtatccagtaggta

SEQ ID NO: 49878 - DNA, 1501 bp, Oryza sativa
ggaggccggatctgccgccgcgacgacgggggaggctagatccgtcgccgcgaccgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctcctcccctccgccgcacgacgggaagatcgcacgcgtgcttgtcctcgtgccagtccacggctccgcgcgcgccgtctttctcatggtctttctcgatgggtaggatgcgttctttattcatgttgatctgccgtagatggggggatcttgagccggaggagtagctagtttctttgattatgcgttttggggtctagcggattttaacatgagatggtttctctttagcgacatttttttttgttcatgttgatgtccacggtgattgttctagttatgtcatttttatcttcaagacttaaatgctttgaatcgccggtatagaccagattattgtcgtgaagatcgacgtattttccgagctgaccctctgcatgctgaaaattttgtagtgggttatatctagattatatgtgtattgttgtcattcaattagcacttaaacttctgtagcatgaacattttcatcattttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtat

SEQ ID NO: 49879 - DNA, 1501 bp, Oryza sativa
tggtggaggccggatctgccgccgcgacgacgggggaggctagatccgtcgccgcgaccgccgcagggccactagtctctaaagactaaactatatatttaaaaaaacattaccaatataactttatgaaagagagtttctcataaaaaaaaatataccaatataacttttcatattttaaatatttttacgtctattaaatttttaaggtttcaagatttgactgcacttacaggagatactactatacaagaatcaacgagaaacgaatttttaagttgcgataaactggtagtagtaagattttgtgaacaaggataatgcatatctgtgtaaaaaaaatatatagtgcaaatcacatatacattgaaaatctagaaactattgtcacgagtaaaatttttaccaaccaaacggccacaatgtcgcgcagggcttatccggggcactactgcccatgggctgaaagtgcggccacaagcccacaatatcttgcggggcttagccggggcaccacggcccatgggctctatctccctcaccagtaaagccctagcctccaagaccgcacccgtataaagctgcagacctctctctccttctcctcccccgccaccgccgctcgcctccgaaaccctagccgccccctccccgcggccgcgaaaatggtacgcttctccctcctcctcctcctcctcctcccctccgccgcacgacgggaagatcgcacgcgtgcttgtcctcgtgccagtccacggctccgcgcgccgtctttctcatggtgtttcacaatttgtaggatgcgttctttattcatgttgatctgccgtagatggggggatcttgagccggaggagaggagtagctagtttctttgattatgcgttttggggtctagcggattttaacatgagatggtttctctttagcgacattttttttgttcatgttgatgtccacggtgattgttctagttatgtcatttttatcttcaagacttcaatgctttgaatcgtgggtatagaccagattattgtcgtgaagatcgacgtattttccgagctgaccctctgcatgctgaaaattttgtagtgggttatatctagattatatgtgtattgttgtcatttaattagcacttaaacttctgtagtatgaacattttcatcattttcctgtgaggacatgggatgagttcctttttttttctcttgttctaaaattgttcggtaatcttgtctggctttgactaatgggctccgatgatggcatgaaatctttgagacctgacattcttgtgatgacaaacataagcatatttcctgagacccaattgaggttttaaccattggtttgctgaatgtgtcttcactgttgaaaaatttgtacacacatttgcttcaaattatgcacatttgattattgtttataggcctgcgatgtccattccacattcagtatttgttaagctgagtgcttttgtttcaaatttgttttgtat

SEQ ID NO: 49880 - DNA, 157 bp, Oryza sativa
tagcataagttacccaaataatcataagcctcaacgtgaagcaataaatgtacggaaaattctggtctttctggcagagatccaactttgactgatactgcttcagactctttcttaaagccagagagctctacaaatcctcacgagcaagaatgaa

SEQ ID NO: 49881 - DNA, 177 bp, Oryza sativa
tttttcaaaattggtgatatgccactgccgtcgcgtttccatcctcccccctgccttttccgtcttctttcactgttgttcacttcggcaaggttagcgccaggagccggacgtatggcacgcggcgctcgctggcggcggcggggatctactcggcgccggcgttcttggcctacc

SEQ ID NO: 49882 - DNA, 681 bp, Oryza sativa
atcgtgcaacgaatactacatatgcagttcaaataaaaaatattatatttatatctagtgctgttcagattaatgccattttaaatcatatatcattttttttaaaatgtcaaatttgtgcaccatttagtttttttttaccaaactatgctaaatacataagaaatcctgctaaaacttggtaatattgctaaattgtcaaaattttgacaccgccaaaatttaaaatttggtaagatttaaattaactataatctaaacataccatttatatagaatttggaattacaagttggcttatatcaattttaatccatcttgttaaattttataaaaaaaataataataagttactccctccatttcagattataagacgttttaactttggttaaagtcaaactgcttaaagtttaactaaatttatagaaaaaaaatattttcaacccaacacaaatttattataaaaatatattcaattattgatttaataaaactaatttgatattataaatattattatatttgtgtataaatatctactgaaggagtacttggtagaccgcatgcggtactttctggtataatgaatgcacattggtccggcagctagcgatcgagctgtgctagtgctaccgctactaggaggcgactctgcgccagctgtcatggtcgacgcca

SEQ ID NO: 49883 - DNA, 206 bp, Oryza sativa
ggcgttgatttagcttccaggcggaggcgcgtgtcaagatttggtcaagatagggtgggtccccacccaaaagaagagtaggtagaagtggtacatgtggtatccccttgagatataaaaggaggaccttgcccacaaagaaaaggggggacgactctgagaagacttgagctgggggaggagatcgagagaaaaaagaaccagaa

SEQ ID NO: 49884 - DNA, 566 bp, Oryza sativa
atattaatttgtcgacaaattttctaccaaaaatttgactgatgtaattacagtaccatcgtagtgtaattacattgtaacttgcatgtaattacactgtaactataatgtaatatgtatgtaactttcaaaaatctctccataacatttatttcgataaaatggaggttgtgagaataaattctttcacatatatgtgtgatgtgatttttttttcttcctcaccagaacaaattttgtaatagatctaacgatttaaaattacgtttaacttatatacaagttacactgtagttatatgcaagttacagagtaattacatacaagttacagtgtaattatactacgattgtactataattacatctgtcaaattttcagaagaaaatttgtcgacaaatgtataggtggtcccgtccttttttagccaactttttagttgttcatcggtgttccgcgcgtgccaacactgtagattttttagagaggaaataataactgtagatggttccagaacctacacacattgacacatgtaattctcacctctcttttttagtaacaga

SEQ ID NO: 49885 - DNA, 1501 bp, Oryza sativa
gtaaaaatttgagcatgcatgcctgcttcatcattgacgtactggtttgaaccatcgatagatgatctctcaacaacttgctaactaaagtttctactattaaatctttaatactccctccatccctaaatctttgacactgttaaccttttttaacatgtttgacagttcgtcttattcaaaaaatttaagtagttattaattattttcatatcatttcattcattggtaaatatacttttatgtatacatatagttttacatatttcacaaaagtttttgaataagacgaacggtcaaacatgtttaaaaaagtcaacggcgtcaaatatttagaaaatgagggagtaataagcacttggggtttttgttaatacatcgacaagggtatacacggcgtggcagatctgtactccctccctttcacgatgtaagactttctagcacttacattgtgaaacggaggaagtaactttttaacccagagtcgattagtagcaatttatattttagtgaggccatttatgtaaattggacttacatatactccctccatctagaaaagttacacatattacttttaacaccaagaccaataagaaattaaatcaccttagatgttacaaaatcaaggagtggatgcaagcatgcaaccaatgagtatttagatgactccttaggttctaataaaacatttaatttattggtaactaagtcttgaatgcaaccatgactcctaagcatgcaaccaagtcttgaatgtataaagactacaaatagaaacaacttatttagaaaaactcaaatgtgaatatatgtataaccttttgtggatggagggagtaaaatgtacttacaagggtgttcgtgaaaaatttttggaggtcaactaaacccacatccaagggcggatccagcaagagagcggcaaggtctcgagcccccactactggcgtgaagactatgagagtccccacgaagaccccattaaaatgttttaccatatttagatagaagggggattgtaactctatctataactctatctagtttgctcagatcttactactattctttctggatctgccaccggcatcttatggatatgcatgtatatttttctaggtgtgattttatagtactacattaacaatttttattgtaaagtttgatgactctcagttgttagttttgaggagatatgaaattttctagtacttaaaagttaattatggtactcacctcttgatggcgcttacttcttatttccaatggatataagccatacccgctggctagcttacaccaaaaaacatctaaataagctagctataatgctatatggtccaaagcaaaagattacaacttctattaacaacttttttttcgaggaaccaacggcatgagtttctcctgccagaatttatagaagaagagaattggcccagttaataagggaaaccggacccaaaaacagaacaaacatggataattaaatggg

SEQ ID NO: 49886 - DNA, 1501 bp, Oryza sativa
ttcgagtccacgttttctttaagtacctacatttggtaatcacatatttcgtttggttcgttggggagattttggcattcgtttttggtagggatagccgaaagcacgttagcagctttaccaaatatgtttggattttggcttgcaataatttggtaagatttagaacgtgacagtgcaaacttatttcttagcagagcacgttgcttactcatctaggccaaagtagggactagggagtaccggagtactgggccttttttgatagttgctgcactttgttaaacttttgagccaaaagtatggtatattttggctagaagatgagtttatgccatgtgaggtataaaagtagtaaaatttggcacaacacaaatgtgtcatgtaactaaacaatcacctcaaaaagttaaagggtgttcagctgaatggcaaactttagcgcacctaaaagttaaccaagattaacttttcgatgtggttgtttggttacatgttacacttgtgttgtaccaaactttacctcttttatatctcacatggcataaattcatctcctagccaaaatatgccacaagtacggccaactattttggtactgcaaatactacaacatgccacacttttgactcaaaagtttggcaaagtgcagcaaccatccaaacaggcccttaaacttggccaactttggtgcggtaaagtttggcattcaactatacaccctccctttcctttttctagctgataaccaccggattattaaccgaattactcgtgccaagttttcaaaagtaaatcttcatcaccttttcccaagttatttgctaaattcgtaatatataatattttaacttatccatccccatcagctttcattcgtatttcattaaaaaaaaggccttaggccaaatgcaaaacaacaattcctcatttggcaccatgtacagtgtcttgcttcagttaaattaggctactcaatccttgtgggactcctgttgataatccatccatccatggctgatgaacaggtatctaaattgtaataagctacagaggttccctactgttgtcgctaacatacaatacaaaggtcttttttttttcaaaaaaaaaatacaatggccatttggttcgtgtctaacctagacatgcaaaggtttagtcatgtctagtcacactttcttagcctgatgacctgcacacttcaaaccttagggagttggtggatttttacaactcgagtgcatgcacactttgtttgcttcccacttctcaaataccaatcaaaagagttacaaaataaaaaacactttatgtaatagacatatatcttcttgcgaaatttcaagtacaattctcagtttatacaacaggcatggcaaagcgggacaacttccaagtgtaccaatatatccggttgttagtggatcatgcagaacttcacaaggaataaggaaagcaaaatggcaagatggcgataacatagaaaaagaataatata

SEQ ID NO: 49887 - DNA, 625 bp, Oryza sativa
ccaaaagtctcaaagctgagagcggagcacacagattcctttttccaggaatatgcaggaggcagtgtgctgttgtcccagtatggcacggatcaaatttatccatcttttttttcacctttactttttactgaaatttatacacatacccttttgaagcagagttgcatacccattttctttttttggttgctatacaacggaatctccttcagacgtgatgataccgattagttatcaagtcctaatacctaatcggtatcgggtgatacatatcaagtatcatacgattctaccacgtattaggtgatacttggttattcctattaggtatacgattcttaccacatagaaggtgatacttacgagatattaggtgatacctattaggtatcatgcgattcttatcacgtagaaggctatacttgcgagatatcaggtgatacctatgaagtatcaggcgatacctactagataataggtgatttctactgggtatcagaagctggacatacctgacgccgacgccgacgaccactaccgcccttcctccccttggctctagccaccaccgccgctccctttcctggctccggctaccaccgctgcccctccctcctctagc

SEQ ID NO: 49888 - DNA, 1501 bp, Oryza sativa
gagtgtgtttgtaatttcttaaaaaaaaagggtaaatagccaatatggtccctgaagtttcgcttcgggctcaatttagtcctggatgttctaaattgtccaaacaagtcctctaaaataattatttgggttaatatagcccttgggcccaaaaaaatgcaacgtgagcatgccaagtcatcctcgcatgtagcaatatgaatgaaatgaccattctacccttatataccacaataaaaaaaaagacacaaatagaaaaaaaaataacaggctagtccaggcccaacattgttgcggagggtgaccgacaaaggaatttatacaactaggtgaaaccccgcgcattgctgcggaaatttagtatgataataataaaaaaataacgtgtaagatagctagataacatcagattaagtgaggatgaactatataagtatataggatatcataaaacataataaagatatacattgaaacattatgtgaattatgttggatgataatttaacatgtttctatttgaaaagctcttaaattataaaaactataaagatatagcttgtttgcatgatgtttaaatatgatgattgttagtggatgatgatgtggcatcttgttaattagtggatgatgatgtgacatctttgcatgttaagcttaaggaccccactaactttatagtaagataggattagtggttagctgcagcaatcgtaagtgacaattctaaaacgatcatacatgtgtgagacatttatctttttttcttttcttttctatatagtatataagagtagaatggccatttcatttatatcactgcatatgaggatgacttggcatacgcacgtgtcactttttgtggtccaaggactatattaacacaaatgattattttggaggactttctttggacgatttgaaacctcaaggattgaactgaacccaaagcactttaggaaccatattagggcacccacaatggttatctataggctctctataagagatccatgtcagcatattttcctacttggaaggtattaaatgaagagagagagagcaaaactatctactaacttagagatagtctatagagaaaaacgaggcaatgcatgagagagctatagataccaatgtagacatactattaaggtggtttactattaatcgagtttattgctgagatgtacatgttttatagagagcaccttactttaccattgcgggtgctcttagctattcaccctttaaaaaaaataaagtctcgctgtcaacgccggtcataccgcaatccaacatttttagggcccctttgatttgaaggaaaaacataggaattttagaggttttcaatcctatagaaaaatttcctatgaagccctttgaaacaaaggattgaatcctatccaatcctttgaaattcctatggaatggacaatcctatagagattttggaggaaatttagcaagagcttcaacctcttgctaactttccttt

SEQ ID NO: 49889 - DNA, 278 bp, Oryza sativa
atatccgatgtgacacgccaaaactttatacccttggatttaaacaccccttgaagcacttcgagacatcgctccagtaagagttggatcaagattaagtttttcatggcacgcttttcaaactgctaaacggtgagtttcgtgtgaaaactttctatataaaagttgttctaaaatatcatattaatctatttttcaagtttgtaataattaaaactaatcaatcatacgttaataccacctcgttttgcgtaaaaaacttaatctttatcttcagg

SEQ ID NO: 49890 - DNA, 1501 bp, Oryza sativa
tttaaatttttgcttataaacataaaaggaacgttaggactgccaatctctcgacattaatcgaacaagtcctaaccagtactccctatgttttatattataagtcgtttcacatttttcttagtcaaacttttaaaagttgaataagtttgtagaaaaatatactaatgttttcgatacaaaacaaatgttttaccaaaatatattaaatgttaaactaaatgaaactaatttagtgttgtagatgttgctattttttttaacttaggtggtgtttgaaactcatgtagataaagatgaagattaagagttttaattattacaaacttgaaaaatatatttatctaatattttagaacaacttccatatagaaagttttcacatgagacacaacgtttagcggtttgaaaagcatgctacgtatatccaaattttcatccaacttttgttagagaaaagaatggggccttagtcaaacttaaaaaactttaactaagaaaaaatcaaacaacttataatataaaatggaaggactagtaatttaaagttagactaggtgtgtgacaaaacggttacacgtaaattttaacatgtagaattcgtacttataaaaaagagtaaaatgcaccaacgaacttgttattaagtttcatttaggttcacgaatttacaaagcaatcgaagtccttaaacttggtttattgtatcatcccggtctaaagacttgtttgaccatggtcttgcctatgtggtacgccatgtgaatgatgacatggcttttttttcctttcccccttctctttttcatcctcttcttttatcttcttcctccgctagagccacctcgagctcctccacgccaactgccaccgacgccaagtgtcactgctgtaagaggaagaggctaaagggcatgatgcctaattggtggtggattggaggggcgaagttgcggccaggacgcagagcgcagcggcaaagccatctatggtggcggcttagcacgatggtagctagggtgtcggcaatgcacggccagagatcggcggtgggcggcggagcctgtgctcgtggtggaggtagggttacggtggtggattgggggagcggagcggcgaccacggtagccctcagagcagtggtgccggcggtgtgagtggagcagcgcggtggcacccagccgaaagatggtggcaagagggagcggcacggaggacgcaatagagggtacgacaggctcggggagttggggaaaatggtggaggggagcacaggggtggaccttatatgcttgggaggttggaatcgtgctcgaggcaagcagatttgaagtaggaggagaaggcggcgacgtcggctcgggcggctcggctcagctgccggtttgcgtacggaagtggggaggtgggcgacgaccgcgtcccccgcacgtgtggatgatgcgggaaggcgcgaggacaatggcgtcgtggggagcgacatgcgcatgaggggtggcca

SEQ ID NO: 49891 - DNA, 1501 bp, Oryza sativa
tgagaggcttagcgcggttgaaatgatgttcatattacaactctacacccaatttacctcaaaattcttcacgaaacaggccaaaagttctggtactacccactctcggcgcaggccactctctggtaatttcatctgttaaacctcagattttgaggcatctgtaaatcaataccctagcttttgtgatttgcttcaaagaaagccttgtcagccagaaggtaaccaggagttgaaaaaataattcagaagacaagactccggcccatgcaatttagcttttgcgattcaattcattcgtgaaaaaaaaaattttaggtgtcacatcagatgtttgaccggatgtcggaagggttttttggacacgaatgaaaaaaataattttataactcgcttggaaaccgtaagacgaaacttttgaacctaattagtccatcattagcacatgtgggttactgtatcacttatggctaatcatagactaattaggtttaaaacattcgtctcgcgattttttccctaactgtgcaattagtttttttttgcatttatctatattttaatgcttcatgcatatattcaaagattcaatgtgatgttttttggaaactaaatagagtctaagcgaaaagttccagtcagttataaaactagccactgtgatgtagataaattatgtggaacccaaatgacttcagctaaggcagtgttcggctaatgggaaagggaaatgatttcccacctacaaaaagacatctttaaatcgtaactgttcattctccctctttcatttaatcttaacccttcattcatttcccaattctaatcccatcccccatttttcattatccaaacacaccctaaaagaatagaatcacgacattgtacaggtgacttatcatctcttataaaccatctctttgatagataaaccaatcgctaatcctaatcttgcaagttcttataaacatctctttgatagataaatcaatcgctaatcctaatcttgcaagtttttataaactagaagctttgtaatcctaatcttgcaagttcttataaacccgaagctttgtactctctgtttagggagaactgtctgttctttgttctgaaaaaagtccatttttcaacacgttgtgcctgcaagaatgcaaagtttgcctgtgttaattttcagaccatgaacagagagttcccatcaacaaacgataccctcatataactactagtaggtctgaccatttgcctctttttcttactattcctttttaagaattgtgcatagataagacaccggtgtccatctttcataatgaaaagtatgctttggtatggttgcaaaatttgaacaccacatccagttttacaccaaactgcacatccattttttacatcaacctgtagcaaaatcagcttctcgtatttggattcaagaaactctgcaaaattgttgcgaaagctccaccatatgaatttctgggctctcatgctgcaacaa

SEQ ID NO: 49892 - DNA, 1501 bp, Oryza sativa
ttgtgtcttctttgctctcctcattcttcactccacctaaatgtttgattgcataatgtggaaggtgcataatccatgccacgcttctgaaaacacttctgcaactgcctttcccattgccaaatcttggtcggtatagattgttttaggctgctgtccattatgagcttttagaaaggtctcaaacaaccatttgaggactcaaaagtctcatcatacatgagagcagcactaaaaattacagtttctctaaagtgattgaatcccacaaagacaccaaaaggcctactctcattgtttgttccaaaagtagtatcaaaactaacaacatcaccaaaacgtgcgtagtctgcgatcattttagcatcagcccaaaatatgttcgctatttgttcttcacaatccatttgcaatgcatattggaatgatgggttctcagcaattttgtcttgaaaatacttaagcatgctacctgcttggccatatgccatctcccgttgtcgcttggtccgtagatagttcctatgatctcggagtgtgtagctaaggttgagggatccaccaacttggcgactagccaactcatgtgccgctttcggtcctattcctgcatcatcggctgtttcaatttgaaaagcttgcaaatctgaaatttttctttgtgacaccattaaatgtatggtttccggcaagtgtagtgcatggttgtgttccaatatcagatcagacactatataatttcccttctttctattcattttgagattcatgtggacttgacaatcggttctagtttcagctcgaggacacttggttaaatgatcccttttgtcttgcaatcgatgaccttcatttgcacaaacaaatctacatgatgtaacactgccatccgacttgcttctgtttgtatacctttttctaacctcaaaacctttctgcccactgtagctaagccaaaatgcccaagcctcatctgaatttgtaaattccatgccaacccgaggtaccaaaccaggcatcaagttatctctgtattaaaaaaaaactaatgagtatgaaactagtgcatagatatgctgaccaaaaatcgccaaaaccatgctgtaaacattgattacatattagcacacattacatgctgtccatggccttgtataattgtattacacaccaatgtgcttccatcgcaggactgtttgacattgtttgatggcaggtctcggcaagattttcagctagctgcttcttccatgagaaaaggggaaacttgatcgatttcaaagcaacctaatggtggaagtttgattcagtgagccattcatgagaagtagaggcctagagggcataagagagggtttagacttacaagattgaagtgcagaaaagctcctgtccggcgatcacctcctccactcacgccaaaacttaacaaaattgttccatccgggtacggcgatcgctgctcattggccgctcgcgccaaaacgcgcgagtgtgttcc

SEQ ID NO: 49893 - DNA, 1501 bp, Oryza sativa
gcgagcaggccggccgccggcgcgaggggcagtgcaccgtcgcggcgccgtcaggactcgggaagggggccggctggccgccgcgcgaggggcagagcgccgttgcgccgtcgcggcctcacgggacacgggagcggtggcggcggcatcaggcgtcggagcgacggcgcatgcgcgtgtgactgggagtccgggaggaggctagtaggaaagttagggttttttgttgggccagactttgtttatgggccataaaaaatgaatatatgctcctttctgggccaaattctagggtagtcctgggcctacctggactaccctctgggcccgcctctgtatgtacccctgttgaactgtggatgttcgacaaggcattaaacttgtaattttagccgatcagcttctacttttatatttttctattaaaataatattatttctaaaaaaaattcatcaagtctgagggacgagggtgaaaacttgagaagtggaaagtgtaaaggctagtagtacgtagaagcaccgttcgtgcatggcaagcggtagtggagtactgctaataacgcccatttcattattgaaactttattcgaatttcatttcagaaaatttcagaataactagtagtactattcgatcactccattttagacaaaacttaggctgcgtttgttcatgtaggttgggaactcattccatccgcacgaaaaacggaacgatccattagcgcgtgattaattaagtattagccttttttctaaaaaaaaatgatcaatataattttttatgcaacttttgtataggaactttttcttaaaaaaaacgcaccatttaacagtttaaaaagcgtgcgcgaggaatacgagagagagaggggttggagaacactgagcaaagaacacagccttagttactacttttgtatggcttcgccgctgcttacttaagaggggattaattaattaaataatcacttcctccgtttcatattatataaattgttttaatatttttagaattttttaagattaattaagtttgtataaaaatatagcaatatttttaacataaaacaaatatattgcctaaaatatactattcaatattacatttatctaaactaatatatggtgctgcagatattgctaaatttttctataaacttgattaaacgtgaaaaaagtcaaaactaatatgatataaaacggaggagtaacaacatattacaattcgaatcacagaccaaaaaaatcgccgaaatctctactattataaaaattaaaaatgtttttacaggtaatttggtacgtcatccgtgtatgagtcggtttttaagttcgttcacttttgcaaatacatgttcgtatttgagtcagtttttaaatccgttcgcttttgaaaatataggagtcgtataagaaatctcttaaaaaaaattcgcatgctaaattgagacgattggactcctaatcgcatgctaaattgatcatgattttctaaa

SEQ ID NO: 49894 - DNA, 1501 bp, Oryza sativa
cggattataaaaaatagaatctaagagttgtatataaaattcagatgctcatagaaatataagccaagggttgtatatgaaatccaaatagatttctacatgcaatgatatcttttggggcaatcctctagttttattataagagtgctaagttttgacttaactatcaatagcaaaaaaaaaaaatcataaaaattcatggcataaaaaggatgttgttagatttatcattaaacaaactatcctaacatgcaacttttttaaaaaaataaattatttttatatatattattggtcaaaatagtacattgaagatcgatcatgtgaaagtctaaaagtacttatatttgtggatagagagaagtgggcttatttgggaaagcttatagcagcttctctaaaatcaaaagctcctcaaatattacagcttttgtccacattctaaagctgatgtagttgcgtaattcaaagataaactagaagctagattcaccttagcttgctataacacaacttgccataacccaacatgtcataaaaaaccatccttatttaaacccatggataagatgttaatggttttgagatttaaagtaccaatagtagttggttttataattaagggatcaaaatcagacaagtttatagtgaaaggagctagatacatattttttttaattaattgacaactctgatgtcattgcggggaaaaaaaaagaaaagtcagattcatcttaattcattgtctgaatgtgtatttaatccctattgagaaaaaacaaatgtaccttatgccactaacaacgaaggtcgactactgtagcattaagaatgctcccactcagattccattagctggctatgacccattcgcacacatgcccacatttaggtcaatgactgaacacaccaattagctggccatgacccattcgcactcagattctattagcttatgagaacatctgccagtcctcttctactaggatgcaattctgaactctctttcctgttccgtgctactagttgaagccttggagttggaggggcgacctcgacatggttggaggcggattgaccatcggcggatggttcgcaggagctgtgatcgccaacttcgtgggcaaggcgcgttccatcctggaggagcgccatgagctgcatggtgacgttgcgggtgtttaacgtggaggcttcccttgttcatctgcaagcagtgcttgatgtcgcggagcgaaggcccgtcgtcgatgataatttcaccggctggctggagttgatcaagaaaattgcttctgaggcggaagagctgctggatgactttgagatcaagagaatacaaaagagccaacagaacaaggttagcggttttctggcatacatgatgaagaatctgggttttgttgatgatgacatatacagactgaagactctcctggcaaggctcgacaagattgccagtaagtctggaaatttttttgacttgttaaaattgaatgat

SEQ ID NO: 49895 - DNA, 1501 bp, Oryza sativa
tccatttcaggagcaatgattttcttgaattttgcagttttcaggttactgtgtataatatattaagaagttggtggctaatcttgaagaacaaaacaattgagtgaagaggccacggtgtagcaggtaaacaagttccctgactaattgcaatctcggaccataggaagagcaagaggaaaggcaaaccttttaccatcagatagtccacttctgtttatgttctttttacattatgctgtaatctgatatctacaggtttcttattgctcctattaatatagcaaaagcactccactggattttcgaaaaaaaaatactatgtacttcctttgtttcacaatataagatgttttaggttttgaatagattcatgcatggatttatgtatgtactccgttcttcatttatgtgtccaaattaatatgtatatgtgcgactctagacgagagatggagaagccaaaatgtctaataatatggaagagagggagtattatattttctatcaaccttttagctctcagagttacccttttttcagaatcattgacagagtgaggtacaatgtacatgggaactgctagtctgtagattgttcgttatgtattcagaggctgcacaaatagacctgaatgtttgaactatctatgatttgaagaattcgcccacttgaaacatgggaccttctagcaacatgaacagggttcacgcggagattagccatgccacaagaaagataaacatagcccgtattaccacacagaatgctgcaatgctatattatacacaaagagccgaagaggacaatcatatttaatactgagaacggcaggcgcgcgatggggggcgtaccttaattccgagttactccatcagaaagataccactgcattgtcatcgaataggacggctgcatgccaccgcatgattgcggattcccggccacttcagatgatcaaatcgacgccttcatctgtccgcacctggtgcagagcgaagagcggagtcagggagaagtgcgcatttcgtcgagcaagtggcgagcaccactcacctgggcaaagagacggcccgcagaagcaaccagcggaggagaggagggggagctcgcctgcatcacctaggcaccgcctgcctcgtgaacgccgacacggttcaggagcccgtagaggtagaggtagagcggctagggccatcggcctccgccggcgtgtcctcactcgggactcgggagagggcgtgaggctcgccgcctcgcgcccttcggggaagatgcagaatttttattttatttttctgttctgacctttattgacacgtctcacgcagcaggggttaggccttgttcagataaaaaaaaattgtggcaaaaaatgtcacatcaaatgtgtgatattaaatagaaaaaaaaaccaatttcacagtttacatgtaaattgcgagacgaatcttcttttttttagaaacacaatacaaacgcagacgctcacaacgtgcgc

SEQ ID NO: 49896 - DNA, 1501 bp, Oryza sativa
ccttaaattagccataaataataccccattcgttttaaaatataaatatttttaggatttaaaatttatacctcaataaaaatatttctacggcacttatttcaatacaagaaaagtccacacatttttaattcaaattcaaattcaatcgtaataggtgctaaacaacccttttactcactttgtttcataatatattggatatgtttttcttctgtgcaaaaaattaagaaaatagtataagtaagtcatggtacaaaagttgacaagtgagaaataaataggaaaaaaaactaatataaaagttactaaatgtttaacaaagtttcttatatttcatataaacgaaaaggcacataatctcttatactataagagggatgaagtgttttggagaactagggagggaggtaggcctagtacataactcgaaccctactcctatctccaaaattatggccttgtttagtttcctcttttttaaaaaaaaatcattagacacatgcatggaacattaaatatagataaaataaaaaaactaattgtacagtttgtatggaaaagcatgggacgaatcttttgagattaaatagtccatgattagtcctaagtgctacggtaatccacatgtgctaatgacggattaattaggcttaataaattcgtctcgtggtttctagacgagttatgaaattaggtttttttcatttgtgttcgaaaaacttttccgacatccgatcaaacttctaacgtgacacccaaaaattttctcatcccgaactaaacaagacctatgtttattcataaattctgtagaaatcagtaattttcggcttcgccactatttagatcgtagagagtaaaatcgaaaagaaaaactcggattcgcccatggttttgcacggagccattcggtacgggctcgatcgtgggaaaaatggtattgaaagcgaaaaacccaaaccatggtggtgccgacttgaatccaaccatagcatccactgcgtcgcgggctcgcggctgcctgctttggtcaactgcccacttcgaccaccgccgagagctcgaggaatggtcgggccggagctgacggtcggcgggtggttcgccggcgccgtgatctccaacttggtggcgaaggtgcggtccgccatggagcaccacgccgccctccgggccgccgccggcgacatgctgtacggcgtggaggccgcgctcccccggatcaggatcctcgtcgaggcgaccgagcgcagggccatctccagggccagcttcgccgcgtggctgcagcagttcaaggacgccgtcgccgaggccgaggacctgctcgacgacctcgagacgcggaggatccgggcggcgctcagggccaggggcagcaagctcggctccgccacgtccctcgcgctcaggttcctcaggaacctcgtcctctccgatggggatctccagaggctcaaggacgtcctggccaagctgaacaggatcaccagcgacg

SEQ ID NO: 49897 - DNA, 1501 bp, Oryza sativa
ccaccattgtttgggcaaaatttatcttccatgtcgattgttggagtcaattgaagttttgaatctccaaagatgtgaagtttatttccagggaggtaaagaacatttaatgaaattgaggaggactgtaacaaatgatgttcatgaattgaatttggatgaatcgaaagcaatcagtacagagctgttagttcttaaactttctgaaggtatgttcaattatttctttgtccaaaattactttggacaaataatttatgaaatagtatcttttatattcctgtgtctatattattggtttagaccttggaagtatagactaaagcttctttgaattgttttatattttcagggtatcactacttgtcttcatgctttcttaacaaatggaattttgaagcatcttcagtttcctgaaacaagttggtctgatgcaaagttagcaaggatgaaagaaagtttatgctactgcttttagggcatactttagtgggttcactctcattatacaagctaaaatttgtataggtgagcttgttgaacataaggtgcttctgcagggtgatctaggaggaacatgttggattttaagaggctaaagtggaggatttaggttttgttgaatcacttcaagtaggtttttccatgttgatagccaggccggacagaacttatcaaattctagggtacttattaagcattagttcattagggatgctgattaagaattctgcttattaaggttctggctccgatcagcacttgcaacaaatgctgcacattttagtaggtaaaggtgcaaaatgtgcatcgtgttgcctccgatttgtagttatgttcattacaatgaattagagctgagaagtgcaacaaagatgaaaagtatcaagaagttgaatgaagaaggtttgctgtttgcaatccatttttttatgcattgaaaaatagtttaaacaaagtagttgctggctagctgcggactgcggtcttgttatcgtcttatcctcttatataactagtataaatttagtacaaaaaatgcctagatctgtgaatttgcactttttcactctgacaacccaactagtgctaatttggtctagattccttcatctgtgaaagtgtgaatctgcccttctctgacgagcattttttttttttgagcaaagggcagagccctccatttccattaaagaaacgcatgagttcttacaaaaaaaggagtcttggaaaaccagaggggaagaacccccaggtgctcacaaaagaaacaaaaacaaaacgaaagccagctagcacaggccttagagtttaagctatctctccacaactcatctcatttctctccaattcaccattgtgtcctcaactaccagctaatcttctttgcctgatgcgccatccgaactgcgagttgaagacctcatttgccacttgttttagcagttgtgctccccattgcaaccttccttgtctttcccccgaattctgcaaaacagcc

SEQ ID NO: 49898 - DNA, 1501 bp, Oryza sativa
tgatgcaaagcctagatattatttcctggaacgtgagggggctcaattcggctgcgcgctgtaacacgatccatgagcttatggcagacacgaagtgcagcttggcatgcttccaagagacaaagctacagaatatagatgacggtctcgcccactttttaggaggctacaagctcgacaaatttgcctttaagccagcaagaggcacgagaggggggatcctcctcttatggaatagcgcagtctttgacgtccaagaggtccgagtcggccgcttcttgatttcggcgcaagtgacggtcatactcacaggggccacatttctgctcaccggagtttatgggcccacaaggcaccacctcaaaagcgccttccttcggcacatcagaagaataaggcccggccccgaggatggatggcttatccttggagattttaacatgatctatcgagcaagggacaaaaacaacagcaacgtcaaccttgcacgcatgagacgctttcgctcaacaatcgatcgatgtgaactgcatgagattcccttgcaaaataggaagttcacctggagcaatgaacgacgaagggctacacttgttaagttagatcgctacttttgcaacgagacttgggacttggccttcccccaccatgtccttcacgccctacccacagggccttctgaccactgccctctagtcctctccgacccccaatgtccatgtaggccgagtgccttcaagtttgagaacttctggacaagaattccaggattcaaagacaaggtcaaggatgcctggtgtcagccttcgtcacacacagagcctatgcaccacctaaatgaaaagcttcatcgcaccgcgacctgtcttagagaatgggcaaaaggaatctgcaccgaggccaaactgcagtttcacatggcggtcgacgtcattaaaagactagatgtggcacaagaacatagagacctctctgcccaggaaacaagactaagagcagccctcaagcgtaagatccttggcctcgcttccattgagcgggcaaggaaaaagcaagcctccagagtaacacatatccgtgagggagatgcgaacacaaagttttttcatctcaaaatgaatgcgcgaagaagaaagaacaccattcatcggctgaaaaaaagacaatggttgggctgtgacacatgaggagaaggaagcaacgatccatgaccattttgcgagcataatggagcggccggcgccaagaccaaatgagctaaattgggatgcccttgacatctcactgattgacctagccaccctaggggagcccttctctgaacaggaagtacatcaagcaatcaaggaaatgccaagtgacaaagctccagggccagacggcttcaccaggattttctttaaagtctgctgggaaatcataaaggaggacgtccttctggtcttcaactccatttacaatctcagatgtgcacacctgaatctgatcaactctgcgaaca

SEQ ID NO: 49899 - DNA, 1501 bp, Oryza sativa
aaatatataaatataatacgtgccgtgtttggttgtacttatcgagcgaacatatccgccccatcttttttataaagctgcgtccgccactgactagggagagaggaagcctatgcacacgtggctgggtgactggagaggaagcggatgtgcgcgtggcagagagaaagaggaagcagatgcagatctattgggttcgatggcggtggtgggtaaatttacataaaatttgtaaaggtagtgggtctttagctacccaataatatataaaaaaagcatgtttagaggagattgccagattatacttttctagtttatatattatgataatctatcataataatctacttgtttgttttagattattgcgaataattcatattataataatcctaagctgaaaaaaaatactcttagaattaaaacgacaagtaatttaaaatggaggaagtgctacttcaatatgaatatatgttctaccctaaaaaaaatgaatatatgttcgatgcccagacctgtgtgctgcaaagattaattttgctaactacgaaatcatcatctattcatcgcgagcactcgttgatgcattgtgggctgtgcgacgacgaggacgacgtgttcgtccgcgtcagcgaagccttggttgtttcgcctgccataccgtctgattgacaagcgccgccatccctgcattgcgatgcagctgttccgtcgccgtcgccggccacgccgtcctcgtcgtcgtcgtcgaagagttctccgccttggacgtacacgccggcgagcctcccgacggcgagctccatcctgaccttgttcctggcgtcggaacgcagccaccctgtcaccacctccgccgccgccctgcaccgccgccgccgccacggccacggcgccgcccagcaccaccgcgccgccttcttctccgcctcgacggccgcctccatctccccgacgaggtcctccagctcgttcgtcgccccgtccagccgcagcttccactccaaccgcgccacccgcacgtcggggtcgtcgtcgtcgccgccctcgccgcgcccgccgccgccgagcgggagcgcgcggagctgcgcctccacgatgtccagcgccagcagcgcggactcgtacctggcgtagtcgtcgccgaggaaggcgcgcagcttcctcgccgccgccgcgatcgcggcggacaccagcgcgccgaggtcgtcgcccggcggagaaggagaaggagaagccatgtcgctccggtcgctcgtccgtcgtcgcggcaaaccacctgccgattccggccttgactttgatttatagcagcggcatatgcaggggtgagtgcacgtgcacctgcgcgcgtgcacgtagtacgtgtccgagctggttgctgatgtgatccacttccaccatgtttcggactcgatgatgggccgcgcgaggggggcggagtagtgggcttgatgggctgcgcgctacagattgggctggcttggtgcgcgttgtgaga

SEQ ID NO: 49900 - DNA, 811 bp, Oryza sativa
gacttctcgatcgctcatgcttgtccacgcgcgcgcgttaatccccggccatgcccgctgactatgaaaatttggaaagcatcaactaaaattagtgccatgcatgtcagtttgatcagagatttggaagggcgccatcaacagccgagatccatctacgcctattgccgcatgtcgacggcgtcgtcacagagcacttgggcacggctgagctctacttatacttgccgccacatgcggacggcgtggacacagagagagcacgcgcggtcgaactccatctatgcctactgccgcatacatatagtgcttgcgaccatcgactcgccaacctgccgcctcgcatggtttcgcatctggaactcctcccgtgcagtatgctctgtcaacaccatcgtcggccaccatggtaagagcaagctttattattgagaagaaaggctcgcgggtagtgctgggagagagaagcttttttaactaaccaaactcatcagcatatgttgcatgtgctgtaaacgggagttgagaaggtaagtcttgaatgcttgcatgcatatgtattggaacgaacaaaacttcaatgcttgcatgcgtttaaacggctgccgaggaggtgccgccttatattgtgggatttgagaaaaaatacaggtgccccctatattttgggatggagggagtactatagtactagtgtctatctagttagatgatattctcaaatactggtacataaaaaattttgatcttgtgctctgagcgatggctaatcgatggcaagaagtggcgacatcataagggttggaggtaa

SEQ ID NO: 49901 - DNA, 1031 bp, Oryza sativa
gtttgctatggcggcttgttgtcggtgttaggctgacaagaaagaggaggaggggggattctttgcagcatttagtgcagatcatttcattttgttggtagagagaattgtggctgggttctgttaccttgtattatatcccaacacgtacgatttacttcgttttaccgcaagatgcgctccatttggatatttaatttcaattggaatgtagcggagaatggctacgtggaaatcatagcataatttagcactaaccaatccccatgcctgtctcgtggtcggtcggttttaaattattaaaaatggctgaggctgaggcaagtaaggttgaactgttttgttcctgtgtgatggaagcgtttcaggatcactaacctatcctctccattgcgggagccatgttaaagttgtgtggtcgactgaaatgaaatgcccctacagttttttgcaacatacagcaaaagcatgtatggattagtggatatgcctacagaacattattaaatctatgggaattggtcccacatttcatgcatctgacaccacaaagttagagctttggctccaccactgatcttcttcactagcttctcagtcggagaagcttctgatagatcttctttgagtaggttgagcttagttgttttcattgacatgcttctgttgctcgtccaacttgaaggaagttacttggtagtcctttggacttggtgtgcttctagcagtgagagctttgtgcagtttgtcattttaccatcatgatagtttctcaatccttggttaactggacttgtcttgttttcttatgtagtgcactagtgcagtaatcagttgtcatccttgatccttttctctatactactattactattattactacctattcactattactattatccttgcttttgttcttgtctaatacatgtagcttataaagttcttttgtatatctactatagttctctatcatcagccaattatgggaagccatagtactgttgaacagattgaggctttgtattctt

SEQ ID NO: 49902 - DNA, 695 bp, Oryza sativa
ctattgaactttggacatatcactttaccaattcgtgttactaaaaagactatatatgtaagtcctctctccggtttcatataaaaccattaacttttgaaaatacatttaaccgatcatcttattaaaaattaatacaaatatgtaaaaaaaatgtaaaccatatttaaaatacctctaatgataaatcaagttataacaaaaataaatgataattaaatatttttcaataaatggatggtcaaacataaatctaaaacaacagttaattattaaaaactgaagggactataatttattttgttacaaattattttatcggtaatggtaatttaagctttttatatatttgtactaatttgtataataagatggaaaatgaaatatcatgttcataaattaacagcgttatatattcccttaaaaatagtgtcatgttttttttattaaagagggaattgaatttagcaactgtctgcatatatatcactattttcactgtgcttgttattaggctttagagcatcactaagagattacgtataatccccctcaaaaaaaatatttttgttttcctaaactgaaaataggaaacacaataactcatctctccaagagaaaacctaaattttataaaaaaacaaaaaagtggaccttctattaaactaacaaaatttttgttttcctccgtcagt

SEQ ID NO: 49903 - DNA, 1501 bp, Oryza sativa
actgtcacaactgtcattgggaggctatataaggagctcactctttccatttcaacacacacttcaaacaagagctctctcatattctctcaagaccattccaactgtcacaaaccgtcattgggaggctatataaggagctcactctctccatttcaacacacacttcaagcaagagctctctcatattctctcaagtttagtttagtagtctcaagctagtggagtaggaatagaatagaaatcagagtccgaaagccttcggaagagttcgggtatggctctagtagctatcctcttctcttttgtaagctttgtactttatttagaatactattctttatgcatttctagtattgaaatactttccgagtatatgaatgacaactttactatatgttcatgttatactgattatactgctagcttatctgggagatgcataggtacgagtataatgtttgctattgcaattactctatgtcatgacgatgatattagagtagtatctggtagtttaggtatggtgtctagattattgggtatcattatttggggttatatgctgcggatgaaaggtgggccgctgatggtgacagctcggtacgagtattcctccacgcgtgtatatagtcctaagttaatttcctgggggatactcctccgtatttagccccggttgtattgtcatgacgggctatggtaaggaactcggcagccagaggtggcttctcgaagtactaggagggcatcggaaagagggtattagctagttaatcttataactagaatgtatgtatactatgtatactagaagtataggaatatattcttttatatttttttccacttagcttagataatttagtatgagaatgagtagttctatgcttgtgtgtcactctaccctatagattatattaacccctgcttagacatgattattacaagtaacatataaactattagtacaattctctctactatgatcttcccacgggattaaataaatatagtacccttggaatactctcggggtgaaatgctacaatggtatatccgtgcgcttgcggatgaactctgtaaccataatataccaggagtatttctgcgccattgctgtgaattatatttctagtaatgtcgttaagaaataccaacaacgcgtaaacctgtttcatttatggctgaggggactgcttcacagcatcccgctgagcacacccctcacccaagctggtcctgaggtcacacccctgcgcattttatggcaattgttcttagacgagcttcttgaagatgtctttgataaagcgatattttatatatctagtatgtttcgacgctcttctttgcaaaagaatgtaaaattataaggactaagatgagcctggatcccaagtcgtggtcggggctaaggcagactttattttatatcttctaatcatccgcacggtgcggagtgggttccggcggcgaaatccgacgggggaggggtgga

SEQ ID NO: 49904 - DNA, 257 bp, Oryza sativa
agagatacgtggatatgccaaacagcattgcttagatccaattcgcgaaattttagttaaagaaaagttagatattcttgatgattttgataaggcgatgcgtataggacatgggcaatttaattgggtaagtgcagattatttgaataatgaacagagcaatgaacgctatcaagaactatttaagctagcaacccctacggtgtcatcagatcaaaaaactaatgttcagcaagagtcggtacaaggagtctaaa

SEQ ID NO: 49905 - DNA, 1501 bp, Oryza sativa
ctgttagataagttaggttttatctagtcatgtgtccccggcatcttcttaattcttatctttatctaaaaaaaaccttcttaattcttatattaattatattgttgtatgcaaaacagcataggtcttgactgaagaaactaagaaagaaaacctgacctagtttcaacagatttatttttttttgaaaaaaaaatggtcatgcatgactgatcaacggccaagatagaagtgtacgttcagtacgtacatgcaagctagttaagcttaattactcgctatatatgaactctagaaaaaaatagttaatatcaagagtcaaaattttgattacgtcccaagcatccagaatagtagaaacaatctacaagctagctcttgtaattaattaaaagcaccattctagaaggtcaaaattaattaagaacagcggattcccctacacacacgttcttaactactattaactccaagatgcgcgggatggatggtttatctagagcatggattcataaatttttgtgtacgtaatctcgtatattacgacatctttcaaagctagatgtactataagtaagatcgatctctgactcatgaggttttcattatgaatttaacatatgcattaataattaattaatgcactaccacagtttaagcaataacatcacgtatttttataaaattatttggcgagataaatccagcaatatatcattcagtagtccatcacaactaagtactatccccgattttaataattggtgtcgttgacttttaaacgaacctttgatcatatcgtattattcaaaataataaattgtattattatttattttgttgtgagttgagttatcattaaatgtgctttaaacatgatttatatttttcatatttacattgattacattgaacgagacgaatgatcaaattcatgttcaaaagttaactgcgtcaacgatcggcattccttgcatttccaatatcatcaaaacatctttctcatgctactcctagtccttggcactcacctcctgtaaatcattctaattaaccactgaaccttcctacgtcgcctcgagccaattaattataattcaattgatttgatcaattaaataacgacaacgtgcatttatcttcccgttaattagttcgttctccaggaccaggaaccttcccttcaaggcttcaaatctgcagcgtattatataacacatccggaaaattcacacggacaaatgctgacgtcgacgtacgtaaggtcactgtacccagtcatacggtgcggctgattaatccaactccctacatatataaaccccccatctcccgccaagcctagcaaccacacggcgacggtcagaacgaacgcctcgccgccgtcgatcgccggcggccggaactatctcgcaaagtaatcgatcgaaggtatcaaaagcatcatctgagctgagctgagcggcggcgcgatggcgggggagataaccccgtcggggag

SEQ ID NO: 49906 - DNA, 1501 bp, Oryza sativa
acgacgtcgccccggccgtgccgcagcgcggcggtgcggcaccgccacatgaacgcgcccaccaggtcgaaccgcgagcaggccgccactacctgcgaccggagcgccgcgatctcccgatctccgaagaagaagacgtggtgcgcgtacgcgttggtcgacggggagagggagagcagcacgtcgtcgtcgtcgtcgtcgacgggcaggggcgcgtactccacgtggtcgcgcgtgacggtcggcggccacgatcgggtggtgagcgcctcgcgctcccacaccggcggcaccgtcggggcgcccggcacgccacgggcgaactcggtcaccgccgtcaggaactgcaccatcccggagccgtccgccatgcagtggcatatgtgcatcccgaacacgaagccgccgcacgccagccgagtcatctgaacaaacagcagggggcggtcgacgacatctgccgtcgggctctccgcctcgcacagcagcatgtcgtagcacggcaccggcggcgcaagcagcggcgacgacgtcgacgtgccgtccccgaggtcatccatgcggaagctggcgtcggcctcgacgaacacgacgccctcgccggtgcactccaccacgagcttcctggtgggccgcagctcgcggagccggccggcgagcgggtagaagtgtacgagcgcctcagagagcgccgccctgatcaccgtgacaggatcgacgccgtcctgattggggttgtggcggtagaagctgatgccggagcggttgaagcggaggatgtcctggtcgtcgatgtccgacagcatcttgaactcgtacggcgtcggtctcgccggcgccaccagctcgcgctcgcggcgcctgacggagaaccctaagctcgtcggtgctccggccatttgcaccctaactacgtacttagacaatgatcaggtgcgtggggactacttgattctaaaacagcattcgttggtatggagtcacgttaattttgctctctctctatatagacgtggcgcggcgtgtgagcctacagagagtggatagattctgatccatattcgacgtggacagacgaaaagtataagttggcgaaatgatggtcacaactaaataactcgagactattagcctggattttaaactttctaattatttgcatatcatatcttaacaaaaattagaggatatattaatatgtgttatatcacctcataaacatacatgttaatattcaacttctacaaattaaaaataaataaatacttaacgtatattcacattaaaatttgtttttttattacaacatgttaaatttgacatcgcatgtttatggagtgatgattttatttatattaatcttattgatttttttttaaaaatatatccgtttgagtaacatggaaacgataaaggatgtttcctcgcgagagtagaataattccccataagccgagagaatgatctatgttgggaactaaacataatgtgaacggttttt

SEQ ID NO: 49907 - DNA, 1501 bp, Oryza sativa
cggggagaatgaacagggctcggggagaaagaagactatataggggcatctttgcaggcgggccatataagcgacgcctgcgaagatcgatcttcgcaggcggaccgcccactccaccccgggtactttttttgccggcggggttttggctccgaattacatgcccgcctgcgaaaatcgatcccctacgacgccgaaaaataaaatcagacggtgcctacccaatgtgtatgaaacagccatcagtctcacatatgaagggatgcacatgcgagcatccaatagagtgtagttttaaatattgaatggcttgaaatgatttgttttcttctaaattactctctccttcccaaattgatcatcatataagtttatacaccaagactaaggacaatttaaattacatcaatcaagacaccatgcatatattctcccacaatgcatgcatggattaaaacctcatgccaattataccctagcatacacacattctcccatactccattaattgtattctgacgaaatccgtatccatatggttatatgatgatcaatttgagaaattttagattctattacatgatgtggttatatatttgttataattaaattttagaacaagatcttactagattatattttaattaagaaactatatatgtatgcacaacaacatatataacggtgttgcaaccaactttttaaagagagaatctattctataccattgagtttattcgagttcaataatttgccattgacgttatctctttttataatataccgacgactttatcaattgttttacaatgcaccattggatcggacattcttttaaaaaattcaaaaatacccttatagatacaagattaacaattgatttatctcattagaagtttcgaaaaactatgaaaattttcatatggcctccttacacaatatgaagtttgtatttctacatttttcaaaaatataacttatctgtaatatgctatataaaatatttttttggtgtttttaatataaatcatcatttgtgtaagcaaactctctctcatataccacacaaaaataatttttctagaaaataaatatgttagaaaaacttgaaacttatatacaagtttccatgttttgtaaggaagctacattaaaaatttcatattttttatgaaacttctaatgagaaaaaataattgttaatcttgtatgtctctaagggtattttgggtattttttttaaaaaaagtccaacccaatgtatattgtaaaacaattgataaaatcactggtatattagagaaagagacaatgttagcgacaaatcattgaactgtgacaactgacaagttcagtggcatggagtagattctctccttgttaaagtaaatacattttaccaagtgctgaaacattttgtactaagtaatgaaacatctgaaacggttataaccatgggatgcaacaccggccgctatttaacaaatatcgggcatctagt

SEQ ID NO: 49908 - DNA, 1501 bp, Oryza sativa
aaacataacactcaaattacagagtttttattcgtatatttattcactccattatatcatactcattcatatgcagataccaatataaatcatcaccttttattgttttttaaaaaacacaaggatgcctaagtcatattttcataacagtaatatccttatattcatgctagttaatgtacactttattagatgcatatagggaataccattctactttctcaataatacataatgtgaaataactttaggagaaaaaaaagggatggggacaacaccaattaggattcaagactaaagaggtattaggagttggttattgagatttactcttctagcatacttcattcgtctctaaaaaaggaatctagaactgaatatgacatatcttaataatacgaatttggacatacgtaggctgtgtcacatccagtactatgttggttttttagggaaggagagagtagtagggtatttattgttgttaaacgtgtgatgagaaaaaggataggctctgaataatcaaatcatgattagaaaagggtgaaagatgaggagggagggggtatcatatactagttaaaaaaagagatcaaatgcacatttcaatctaaatgtataattattcaaaatttctttagtcatgatctgaggatatcgtctaatgaaaatgtttgaatttttttccaatggcatttagcatgcaaatagcgcaattgcttaataatatcctagctattatgtcacttatctttattttacttgttaaacatgaggccgaagatttaccgatgatcttcgtccttagaaaatgttaagaggttataaatatccgtatacggtacatgtacatgatgttacatgcacatgtgatgtgtcttagtagtgatatgtgttacggttacgtatataaccagaagactaattctaaatcactaaggtcctctttgtttaggcttataagccaacttataagtcaaaaagtctaagcctaaacaaataagcagcgttttcgtttggcctttttgaagccataagccacttttacactattaagccaaaagctaggttggagaagcttttttgacttatatgagttagatgtatgactctactactaaacttaggatattaaattcactgccttataaatcatataagccaataagctgacttaaaaaactaaaccaataaccctaagcctaaacaaagagggtctaaatcaaaataaaactagcataagaattaagaacagaaatacaggccgaggccaccaccggcaccggggcgagagaagcaagaaaaaaaaaagccaaagaaaccaaaaggaaggcaggcaaagtaaaccaacccaagcaaggggatctctcgaatctccccattccaggggcctcgtctcctcctcctccgcctccgccttgtagggtttcgccgccgccgctgccgccggcgatggagccaccggcgggaggctcctccgatcatcgccggggtgccggga

SEQ ID NO: 49909 - DNA, 341 bp, Oryza sativa
atcaagccaagctgggcgccgttggcagccggcggggccaaagccagctgctacggaagagccagcacagggggccccgggcgtccacggtgactagagctcgatgcagggctaggataaagctaggaatcgtagcccccacgcttttagcaaagaatcttttgaatggatgaagcaaatacaaactttttgttaccaaggagggtaaacgagcgcgcgacacgtgggtaccgcgggaccgcgaggaagagataggtgagagataaatataagccataataactttgctgataagcatgaacaaagtagatataaacttaaaggaagtattacaaatgcta

SEQ ID NO: 49910 - DNA, 1501 bp, Oryza sativa
aaaaagaaacattatcatgaaagttaccttttgcctgcaagttgtccaaattcttatcagccttcaatttctcagctctttggagaacaagttgatcactgtcacttgcccttctcttgctcttcctggagggagaaattactgcttcaggaatagcagcgagcttttcccctagactttgctgggtattaaccttcttaaccattacagaatcctcatctaagccatcaaattcctcatcagatacagtcaagccatcagattcaggtatcagactcaaatgagcagccggtatagaaggaccacccctctcactaacctgaccaccagaacctattaaggaatcgttaccaggatcacctccagatcccttccccaaatcctggttcagattcccctcctccttctccaaagtcccatcatccagattctccatatccattggtacaggctcgtcagacccattgtcaggctccactataaaagataactcgtacaagtggtccccaataaccacatcaaccacatctgggatcaaagatggatctaggaccaaaacttgtaaacgagcaacatcataccttctagtaaagttcataaacggtatatcgatctccttctctatctctggtgagttatggtatgtagttccataaacggctgtgttgctaaggtaaagaccttgttgtggcaattaacaggtcgtgagagatcgattaaacccgtacaatcctgtttttttttctatttgttagctaagcagttacataaatcttaaagcaaatctagctaaatagcacgatctaatctagttaaatattagcacaaatcctggagcaactcatgagaccaaaaaatcgtgtgatttcttaacgaaaatcacccctgtgatttatagcaaaaaaaccgttcacattatgtttagttcccaacatagatcattctctcggcttatggggaattattctactctcgcgaggaaacatcctttatcgtttccatgttactcaaacggatatatttttaaaaaaaaatcaataagattaatataaataaaatcatcactccataaacatgcgatgtcaaatttaacatgttgtaataaaaaaacaaattttaatgtgaatatacgttaagtatttatttatttttaatttgtagaagttgaatattaacatgtatgtttatgaggtgatataacacatattaatatatcctctaatttttgttaagatatgatatgcaaataattagaaagtttaaaatccaggctaatagtctcgagttatttagttgtgaccatcatttcgccaacttatacttttcgtctgtccacgtcgaatatggatcagaatctatccactctctgtaggctcacacgccgcgccacgtctatatagagagagagcaaaattaacgtgactccataccaacgaatgctgttttagaatcaagtagtccccacgcacctgatcattgtctaagtacgtagttagggtgc

SEQ ID NO: 49911 - DNA, 1021 bp, Oryza sativa
cctggatagttagttggcccatcatcatgatggacctagtttaaacatctagtgcttgtaatagaccgccctcaagaggccccacctgtcagctagacaagctgcccgaatgtcttaaggtaataaggtcattggttagaagcaataatgtaaatttggtaagcctagagtaatcatcggcttcgaagtcctgagattagccgatgagagttatcaagtcgtcagttgtcggattcttgctatattcgattaaggaaattgatctactaaaggaatcttatccagaagagaccgagttcaaagagtatgcggcatagcaagttatctattaattaggaatagtttgttagtttccttttatctttaggaaagtgtgtttagtgtcctataaggattttatcttttcctttttatccttagtttatttcttgtccgacaaggactggtatctccctatgggtataaatatgttcacccggggtcattgtaatctatcaatctctcgatcaataaaaactactctcggtgcatcgccaccctttttaccgaggtttttacttatcatccgacggaacttggcacctaacgcggggctgcatcggctttcgatctccggcaaaggggtaagtcctacgttccgccggccctggtgaatctgttggctacattggtgttgttcaaggctgcatcgcttcgatctcttggatcgctctggtttggttgatatatttgcctacctgatatctcaattctatctctaattacattgtttttagtgacgcatcggtttagttggaactgtctcggttaggtccgatcttctgtcttaaccgatatatctctacaatcataatgttgttctaaatagatttgtcatatccatcacattagatagatctatcggctcatcgagtattagattatcatatacaatctcgtgctgcatcggttaggttcgacctaccatattgttattgataatatgaatcttgtaaagccgataggttcatgctagtgtttt

SEQ ID NO: 49912 - DNA, 1501 bp, Oryza sativa
gcatggaggctctgctgctcgatcggtttctccatgggctgatgtactgggaatggtcgatcacaagttcacaacccagacatgggctctttgagctagttcctcggcccaacaggaagatccatagccggttcctccatagcccgctagtacatcgcgcaaaatttgcgggggaatcaaaccaatctcacttcacttgcatggtttggagcatctccacagaatggccaaatggctctccaagccaaaatttggctaacttgggtaaaaaatgtgctccaacagacttgctaactggatggccaagctatttggctggctaaattcctcaccacactagccaaagttggccagccaggagggctcgccatcggtgtgggtcccacaccctctctcctctctctctctctctctccctttccccatcccatctgctgctccctccctgcccgccgcgccatccgcccggtgccgccgtcgccgtcctcccggcaccgcagttgtcgtcctcccggcgccacagccgtcgtccatggagccgagtgagaggcggcgcagggagaagatgcccgtggggtcgagctgcacggtttggtggaccatgaggtagcgcagctcctcctcgagaagcgccatggcaagctgcacgacgaccccggtggaggaggaggactcctcgccgctgtaagatcaaagtgtgttttgattcttattctgtgatgaacaattggcatatgtgattattggttttgatatttggagattatcgtcgaagtggttttggagataatcaattttcaggtgatgatcggattcactgttattttatgtgtccagtccgaccgggcggaggttgccggtcagaccggcgctatgtgtgctgtcagaccggcccggcccgcggtctgaccggccgatgctgtgtcggtttcggtttcgggttgtttgtttgaatatccgtgattgtttcatggttatggcttctagatggatactatacgtatgtaatactgttgtttgctaacaataagtcaagttggggatagcttggtcttggaatatggtttctttgtttgtttcatgtgtaggtgactcgatgcctcgggagagtatttgcgttgatagaccaggagtcggcttggtaagaagatgtccgtggtggtcagatatcatgcgggatactaaggctagagttgatgcacgtggttggtgaagattccatatggcatacgatggaggtattgtgtgcgtatgggatacggagtcgaatttggaaggagtccaaatttggtacgattggttatgtaaagtttgtgtcttgtactatagggtttcctaaggtgtttaggactcttactatgagtttggttcatggctttaggctgcctacctcatgtataaatagagggggagcatgaggcttcccggtatcgcttttgagagcaattgagttgctagtttagttagggtttcgagtttagtcgagatttttgtaaggagt

SEQ ID NO: 49913 - DNA, 1501 bp, Oryza sativa
tgtctgtcatttgttggaattggcgatcgcttatggcacagtaccgtggaccatgccccctcattcctgtctgtctatctcggaattaacatctcgtgaactacaatactccttccatccaaaagaaattatatactccctccgtttcacaatgtaagtcattctatcatttcctatattcatattaatgttaataaatctagatagatatgtatatggaaaataatagaatgacttacattgtgaaacagagaaagtaattacaataaaaaaaactaatatatgaaaggaaaatgttatagatagtcatagctaattaaatgatactccctccgtcccagaaaaagccaacctagataaggatgggatcatgtccaaattcgttatactatgaagtgtcccatccttgcgtaggttagtttcttttgagatggagtaggtggttaagagtgaaagagagcatagtaaagaagatgggactgaaccggccgttggactggaaaaaccaaaactagcacctttgatgactcactttgttcacaagaccaagccaatcggtcttatgagccagctaaactggacggttttcttgtaaagccatcgaaccagcacagattgaaccgatcggctcattcacataacaaatggactagtggtggagccagaaattattaaagcctagcgctcaagtatagctcaactaatgagttattgattttctcaaaaaaaaattgcttgttgatttaaggggattcaagcccaagtctaaggctcaagtccaagctactgtaggcttatctccgctcgtgaataggacttgggccattttaaggcccatgattgccgaatagatgtttgaagcccattgtttggaataaattaccaaaaaactttcaaaaatgaaatgcaaatataagagcatctccaacagcctctccaaatcggactctccaaacacctatagtcaacactccatctgatttggctagtcaaactagttactcgctccaacagcctctctatccatatgtcaattgcatcatcttcttcctcctctcccgttcttcctctttctcccgcgcgagtcgacggcgcggcacctcgcgcgagcctgttaattactcaactctaatctatttaactaccaagcctgttaatttgcactctacaggcgtgcattggcaatgacatccaaaataaaaaaattcaccgagatgaaattggtacgcagtaaaattccaataactggtaggactgcaaaattcagtagcatacacacccgaaggacgaagtcctcctgcttccagacggtcaggcagcggaaggcgagatgcgcgaccgcgacgccggcgctgctgcacgagtccgactgctgctgctggctcgccgtgaacacaaagcagaaccccaggaggcggcagagcaggaacagatgctgcatcgaagaagaagaagaagctgcccacattggcgtgccactgatccccgtgccctgactgct

SEQ ID NO: 49914 - DNA, 800 bp, Oryza sativa
ccatgattttttgtgagttggatttgaaggatatgggtgctggtttttaatacgggtacagataaaatccgcaagtgcacggatataccgaggtagcacttcccttacggagtattccaaggatatcgaatccaaaggaacatgtatggttagatcttcctccagtttatccaaggacaccaagcaaatgataggccaggatagagaggatttactagtgagaacagtgtctagggaaagcttaactttaatcctaatgcaatacttcaggcacaggcaacccgttgttcccaatgtcgctctagtacgtacccggacagggaggacttaagtgatctcaagagctgtcaccacctctacacctacctcaaacgtactgtggatacgcagcaattactggataacaaatacctaaataccacgtctaagcaattaatatctactttagtgtttataactcatcaaagcaatcactatattttagttgattatagtgaacaataatcccgtatgctatttaggaactaaccaagagataattctcacaagataaatctaaattattcaagaagaatattatattgaattcagagtaataaatagaataaaagaaataggagaagattaccgacaactccgaaattcttccgactacttctactctactctcttcctattctagtgtacaatatagtacaatagagcctcttataattcagctcaatcttggaagtgtgtgtgagagtgaatgaagtgaggtccttttatagggcagttatgacggttgtgagaaggggaaa

SEQ ID NO: 49915 - DNA, 421 bp, Oryza sativa
tgaccgcccactcaatgccggtctgaccggccaggccgatggggccctctgacagctcttcaatggctagttttctagccgttgagagtagcacggtctgaccggccacatacctccggtcagacgacagagcacaatgatttgggatttcccccccaatggctagttttggtgggtgggagtataaatactcccccaccagcagcaaggggactctcttggcacccaattcaattgcatacatcctttgcacctctctcacacctacttgagttttgtgttcatccatctagtgtgttagaaggttgattagccaagagtcaagtgcattgctttcatttgtagagctagtgtggcacttgattgatcatctccacgccgggtcattgcttgttactattggaggttgccacctcctaga

SEQ ID NO: 49916 - DNA, 350 bp, Oryza sativa
atttgatcgccctacacctcgatcaattctaaattaaagcactagttttacggtcttcttttcttcgcttcgcgccatcaaattttaatccatcgatagtcatccatgcgcacacatgacgtcgacctaacttaaaatatatagctcaaagacaacggttagtccacaattagcgcttgtcattaattactaaaattaacaccgggggcctagatgcttcaccgcgtgctgcccctcctcgagccgccgccgcgtcccatgcttcaccaccactgaaaccgccactgtgccgcgtacacttcatcgccgccagctccccttgccgccatcaccgccatgacggcttctct

SEQ ID NO: 49917 - DNA, 234 bp, Oryza sativa
gttcaatcatcatatattaaaaatattactgaattttaaattggcaaatcatgatatatgggttcttgttctctcttgtagctaatcgctgtaatatgtatgatatcgagttaccgatcatacatcaacgctacaaaatcactgttcactaaaccttaagtgagttgccatgtctcgtagatggcaccctccatctctaaatcttggcttcgccactgcaaagagaagccgtca

SEQ ID NO: 49918 - DNA, 234 bp, Oryza sativa
gaatttttgaagattaaatcggattaaaacacttatatggattttaattgaattatgacgcaataatgaattatttttgaaaaggaaaaggggtttattgcgtcagcggctagggtttgcggtggaccgggcgcacggcagcggttcacgggaacgaacggccgagatcgatccatccaaaacggacggccgagatcgatcgggtctacggcggctcacggcagacggccacga

SEQ ID NO: 49919 - DNA, 875 bp, Oryza sativa
agaacaagcctgaaaaagcatgcaataataacgaaatcatttcacacacaagaaagattgctcaaactaaaactaaggaggttctgactaagaggaagggatgagcagaaagcgatgcatctttctagaaccatcaacatctcaatgtatagatgagtgtcaaatcgagacttatacaagttgaatgataatctgatgatgcatctatttgatgctagctgttgctgttcaatcaaaggttcagttgtagcttgcttctcagcatatgttgtgatctgctttcttcttcgtgtatgcaacatcactccttggcaccagaaggttgctgagcgtcctcgctatcttatatacctatatagttcattctcacttagtttatgctattttttttctctcattaagttatatcacattaattatttttagtctttagatgattaatctatggttcgaattatcttttttttctctcattaaaccatatcatctcaattttttagcccttagatatatggcctaaatgatctttcttcttttgttctttcataaaaccacatcatcttactttcggtggcggagccaccatgattcccgggaatacccaacactttttatcaaaaaataagtatacttctaatatatacacatgtacacatatttgtacacctaaatcctcaactcttttatccaaacacagcccaactagtctcttgcgatgcctccaaccaacccgacccactccatcatgacccatcagacatcaattgacccacttagccaccacttttccagacagccccctctcgctctccctccatgacccatccctccctagctcggctccctcgcgccactccccatttgcaaaccctagg

SEQ ID NO: 49920 - DNA, 153 bp, Oryza sativa
cagtacctccgtcccaaaatgttgctatttctagctattcacttggacaggtgcatatctagaaataggtacattttgggatggaggtaaccttgtgctacacaaaaagtacaatactgacaggtttaagtttctgacctgcttcatatattt

SEQ ID NO: 49921 - DNA, 302 bp, Oryza sativa
tgatatgaatatttcccaaagtctatagttgtaaaaccacctaatgttacctaattagattgcgaagcatctacctaaaattatactagggataccatgagtagagtgtccactagttgaggttttgtttgtctagggtgaacaaggtaataataataacaataacaataataatatggtcctaacaaaggtaaataggcatggttaaataaaacagtgataacgcgggaatttaaataaagcgataatgcaataatttaaatcaacataattttataaactgggattcaatatgatcaaga

SEQ ID NO: 49922 - DNA, 1501 bp, Oryza sativa
ccgagcacgtctactccgacgccagctagtgttgagcgcaacccggtggagttcgctactccgctctcccacgacggggagcgcatcgacgcgtaccacgacggcgagcagctacggtaccgtacgatggaggatcttctcggcgaccagccggtgccgggactggtgcctcccgacctggaggcgcagttgcaccttgcgtgcgacgacggtgagcctcggtctttcgcagaggccgagaaacacgtggcatggcgtgccgcgatgcagtcggagatggacgcagttcaggagaaccgcacctgggagcttgctgaccttcctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttgcgctggctgctcaggaaggctgggcgtccatcacatggacgtcaagtcggcgtttctaaacggcgacttgaaggaggaggtctacgtgcaccagccgccaggatttgtgatccccggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcagggaggagatgaaggccaccttccatatgagtgatcaggggcctctctctttctacctggggattgaggtgcaccaggacgactccgggatcacgcttcgacagaccgcctacgccaagcgcgtcgttgagctggctaggctcaccgattgcaacccagctctcactccaatggaggagagactgaagctgagccgtgatagcacgacggaggaagtggatgctacacagtaccggcgtcttgtgggaagccttcgctacctcacccacacggctggacttggccttctccgtcggctacgtcagtcggttcatgcaacgaccgacaatggagcactagcaggctgtgaagaggatcatccgctacgttgcggggactctcgaccacggtctctactacccgaggtgtcctggcaaggcacacttcgtcgagtacagcaacagcaaccacgccggtgacatcgacaccagcaagagcacgagcgggattctcttcttcctcggcgagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagatactggagcgg

SEQ ID NO: 49923 - DNA, 334 bp, Oryza sativa
tcacatgtatcacacttaatgatactttttgagtaggatcatgtgtgatacctgtaaagtatcacaccattaagtaccatctgtgaaacccatagggatcatgttagaagacatgatacctaagtaggatcatatgtgatacctcacatgtatcacttaatgatacttttttgaggagaaccatgtgatgctacaaagatatcacatgatcctacaagagtaccatgtgatcctcaagagtatcatgtgatcctactagcgtatcacatgatcctaacagagtatcatctgtgaaaaccacatgaatcatgtgctacttgtgtgaaaattttta

SEQ ID NO: 49924 - DNA, 1163 bp, Oryza sativa
acttcgtgcacaccaactagcaaatgtcacgaaaaattctacaaaaaattaaagtccactcttttttagtcagaagatcactttagctaagtagtccttcatcaaaattgcatatctggcacttgcaaacatatcctatgcacgtaagcttaccgtgcacacttcatgcacaccaattagcaaatatcatgaaagattctataaaaaaaatggacatttactcatattagtattacacatatctacgaagtctcatattcaaattcattatattttagtcgttaccaaaaagtgaaaaatatgatagtttcaagggtaaaaatctgtctgaattttatcttttttattacggctaaaatataatgaagttgaagataaaatttcatatgtaggtgtaatactattctaagtatgtgtacaattttttgtagaatttttcgtgacatttgctagttggtgtgtatgggaagtttgtgtggatattatatgttcccctggcattttagggtcaatctttcatgttgaaagctaaagaaaaggtactccccctctttttaaaaggatagacaattgagagaatagggcgataacgatagacataggaaccgaaataggtcccctttttcattcatccaattaggtcagaatggatcagggaacccggctctgagaaaaacacagtaagagcgcccaaccctctgaaatatagcattctctctctgctcgggaatttaaattttatgccaaaatttaaattctaaaagagtagcttgaagtgactggacctggttcgaggccagttcatgccttcctggctgaaactaagcagggaatacattttcttctgcaattacgttgaaaaagacataagacataattgggttcctgatcgaagctacagtggaacgatgacatatccttcctcccaaagaatatatacacatttcatgatgtttgtttcaacttacaatcaatagtgttcccgcgtatctaatctaacccaggaggggtctgtattataacagtaatcttgcaggcttatctttttttttcagtaaattttagcatctccacggaaaatatggtggtcaggtggatgcagttacaagtgctggaatttcacagctaccgttggtcagtgatgaatatctaggcggcaataa

SEQ ID NO: 49925 - DNA, 1501 bp, Oryza sativa
gtaacatgaatgagaatcattaaaagtatgcacctacagcatgacatagaatttgaactgggtaatataaataaaaaaaagatatgttacaaattcctaacaaaaggaactatgtcgtgtgacatgttaaaaagaaatgggccatatccatatatcataacaagaagaaaacaattaaattgagcaacttattcttagacttgatttcccattattcagttacctaattatttcagcttgatgtgtgcagaagggataatctctaaataaatgtaaaaggatgttgttatcatacaaaaaggttgatcacatgtcaaatatatacatcaccaattaactggcaaccatagttaaacattgcaatttaataggagtccaatgctttgaagataatcctcagccaactcagggggaaaggggaatttttcaaatttagccaaacagccatgggtgattatttttggccctaaaaaaagataaactgcagtaaatgtcatcatgccaccatttcatctacaagcagatttacatacagtagattaatttggaataagtcatgataaatatatgcagagaactagagactctccactgatgttagaagctttcaactattcttttgatttgagaagatatgagattttttttatgctctgatgctgttgaaaacttgaaatgtaaggagtaattgcaccagtggtacattttaggggtcagttaatactaatccaagattttaaccgtccagcatcactatgcacaagagatactactgtttttttctttcttcaatttgaccttaagggcacaaccaccgccagaagagtacaaatacactgaccagtaaccaataacaactacagctaggtaacctggttcttgtaaaacaaccagataacaccagcaagtgatttacttatatttagcttatggtataggttaacatattttgataatatgagacattaaagcatgccgcaacccattgttgattgatccttttcggtgtaaaagtgcatctgatagagtgtacttatttgacatgatttccatggctcatatctgggaagcctaaggaaatttaaaggaacatgagaggtctctgaagaaagctcacaaagttcttcgtaggagtcacgatcatcaacaccaattctgcacttaacgctgactgggacattacaattggcagcaatagctgacatagcatcccctacaaacttcagataattgaatcaatatttactaagggtggagaaagaacaaattgatgctacctgatggtttactgcaatgaattcataaagcaaacctctggatcaaacattaagcgagcaccgaagcaaccatgaccagcaactttgccactggggcagccacagctgatacaaaacgtttggagtaaattatatgtaataaaagaaatgtcatacatgattagatgagattgagtgacgcttttttactttaggttgatctcatcgtacgaataagcatttgc

SEQ ID NO: 49926 - DNA, 1501 bp, Oryza sativa
tcagcacgattgcattcacctcccatcccacaacgttgctctcccccgccacgactgtacttctacatattttgtcctgcaatgtttgtaaactaccatctaaatttgtacttgtaagaaaacatctcagtacaacatcaaccattagattagtacaacatccgtatttcaatgcgatcacaccaacaacattttagtagaaaattatctcagtccaataaagcagcaagcaaaccaacataaccagtaagcagcagccagccagccattacgagcaatggctacttctaggatcagcatcagttcaacacagtagcagaagcaacaagcagcagcggcaggccagcagatcaacattagcaccagcacagcaacatcgatcagtagacccagctacaacagatcgcccctaggtgtggtcgatgggaaccgactcctaggctactccgagagtccgctgctgccgccgccagcagttctctaaacaacggcgatggacgggacagggaggtgccaagccgacatggaaagcaggcgggagttggggtcacctacggcgatggacgggaccggcgaatgtctagccagctgcgtggaagatggagccaccggctgcttgggaatagcatcacgtttccggtcgttggcgagggagttggggtcacctgcggctgctggacaggtcaatgcggtggtggacgacctcgccgaggaccttctgacgggcaggattcccctagcgcgcaccaaatcgcgacggtggaggaaattgggagggagagggatgcccgatttgtggagaacgagatatgcggagaagggaatgtcaatttttgggaggaagagtagggatcctgttggaggtcaaattttacacaaaagaccgaaattttgatattgggaagagtatgggggaactgttggtgatgctctaaacatggctcctaaaatttacgcacacccaaaaccagcaccaatcataactagatgttgggcaacttgacgcgctcccaatcgcagaaatcgtgtgtggtcgcgccaatttttctttccctccccatgctttccccaaccgcgacagctatttccccgaaacaaatcgccctctttcgttcgtcgcccgctaggtcgagaggagccacgtcaccttcccctcctcgcaccagctccgttgtcagctccatctaggtcactgtcggcccgacatccatagcgccaccgacctctaaccaggttgccatcgactgtccatctagggcgttgccgaccctccatctagggtgccaccgtccgtcgatctaggacaccgttgcccgcccatccaagtcgccgtcggggccatcatcatccacttcattggcatcatcggtagtctctgcctcttcggccacctcgatgacgtgtgctgctactgaatttttaggtaatttcagagtaatagatcatttcttttctctttctctccatggatctaactccctttgagttcaattgaggttga

SEQ ID NO: 49927 - DNA, 1501 bp, Oryza sativa
gaagttagttaacattatgatgatgccagcggatttcctgtttttgcaattgtcattggttctggaaccactaacttctaaaacgtttgtttacttgattgaagattcttatagaggttgatagtctacaaggtgagacaaatccgtatcttcagattaaaggaacgaacaaggaaatagtttcctctgctgcatctgcactcagcttagatgattcatacacgacaaaggtctcctagaaaatcctagctagttaaattgattaatttgcacacacattattgcatatcagtttcatgattttattctgctctgcagagctatcttcaaattattctggagagtttgccagcggatgaaaatgttcatactggtattcataaccaacaagctgctaggctacaagaacttgttgagtttatccagtcacaagtatgttaattcaaaccaactagttgtaaatactactgttacattatgggatattttttatggctatgatttagggtagtcagaacataagtatttgttctttacaactgtttgtgggagaacatactaccaaattgccttttgtgttggacgcggttatgtttcgtagtgtggtcacctggtcggtggtttaaaatagcccattgagcatggttgcttgattggttcaagtccatgtagcatgcttatccatacattatttaccaaacatcagacagttaacagatgatttaccaaaggctgcgatcatgtttaactgtagctattttcatctaaaaaaaatgtctattggtcctttaaaagaagttagtgtcagtggtagtatcttcctctccacatcttatacacttaattttatgaattcaatgttacttttattggatgttgtaaatgtctccatcagctatatgtatgaatatgtgcatgtatgctatgacctgcaccttcctatatcaaaaagttatgttacttttaatcatttaatgtatgctgtaaatgattccatcagctgtgtgactgcatgtcatgcgctagttttgatttgaggattctaagttaacctttccggtttttttttgtttagtttacaacttgtagtatacttattcgagattttcctcgacggaactgtaatagcagatgtgtttgtatgatcagattctatggctaattagctattgttctttcttaactttattctcatatattgaataattctgtggtgcagggaggtagcttcaattcagatttatcttcacctacaagagaagtttcttctacagatagtgtgcttgatgatgtgcaatctaggttaaggaggcttgagagatggaatacaattaatatggtaatttctctttattttcagatgctgttcaagacccatattctttctcaactgccttaagatttaattcagtttgcatgcgttggcattatgttcgattaaacaattaaatattgcatatcatggttcatcagttaaaaccccttgtgttctgcaggtttt

SEQ ID NO: 49928 - DNA, 1501 bp, Oryza sativa
gaacggtagataattacccgtctcgtgggcaaaacggaaggttttcaggacaaacctacaaagaggtgtcgcactctcgtagcagtggcggacaatttacagcacaaatcgacaaagatggacaaactaaactagaactagaagcaatatgaaaaaacgattctattgattgattgtatgattgtctttacaattgaaccggccttgtcccttatataggggttggtcttgccctctacaggccctcctccacgtccaactcgggataaaaaccaaaggaaacccgaaacatgccttcccaagcaaggaaatctcgagacccgacaaaacagactcgggctagaactttgccggtcagaccggccacacaccgtcggtctgaccggccaacacacggcggtctgaccggccttctcagaggaaaacgggcaaaacttccgaactttggcaatttccctatttcaatcctaggtaccaaatttaggtgtaaacaagaattagttggagttgcatgctatagtccttatttgtatggtattatttgttcaagttatgatatggacatacctctttctttttttaggaaaaagcaagagatgtgcatacaaagaaatgaagtaatagcattttcatatccatttgaatttatgcttcttggagttctaagctactatgtattttaaatagtactgctaaatcataactaaatacatgttttttgtatgatggattcactatatttaaagtccttaatttcatgatgatgctatgtcatcttggcatatggttaattaattgaaatatgatttacttggtgggttgtgggtacatgcatgatttcatttggtggtcgtgcccatgacaattaaggaccagttctcgagaatctctggaagatatactcatactaaccacaagccagatgggctctaggctgaatcttaagtataatcttttctagctgacacaccgttggcaaggtgttaacaatgaaatttggtaagcccctaagagaattatcacattaccaatagtcaaattcttgctatattcggttaaggaaattaatcgaataaaaggatgcatatccagaaatgaccgagttcaaggaggatgcggcatggcaagttatctattaattagaaatagtttgttagtttccttttatctttaggaaagtgtgtttagtgtcctataaggactttatgttttccttttatctttaggaaagtttctttcttgtcctacaaggactagtatctccccatgggtataaatatgtacacccggggtcatggtaattatctctcgatcaatactactctcggcgcatcgccatcctctctcctgaggtttttacttatcaaccggcggaatttggcacctgacgcggggctgcatcgggtcagttcgatctccagcgaaggggtaagtcctacgttccgccgccctagtgaatctattggctaaattggtgttgttcaaggctgcattgctttcg

SEQ ID NO: 49929 - DNA, 1005 bp, Oryza sativa
cacagcaactattgattccaaatatgtgctttacaagagatagagcatctggccttttccttttgcttaatatgtctaacagcagtaaggattaaggaacactcagacaacatactgtaatcataggcaatgctagatttcaacacatcatgggatctgatatgtgactataacatgccatgtaaagatcgctccatacataggagatgttaatccaacagtggtaatggaccaattgcataatcctctattttttttcccattgaactttgttcaaaaactgaattgatagaactacttgtaataaaatcaaatgtcctagcctacataaaaatagtaaaattttagaacagtacaatgacacggaatgttaaagaaaagaaaagaactctttgcattaattaaagctaattgaatgggactacaaaattatctaaagatgatggccaaatgtgtcctttgctaccaaaattacaggaaatcagtattgcaatctacatctagcaacaagctactgagtaacacaacagaagattccatattcgaattgcaatgtaggagatctagtactatttaaatccctattaaaaagcgcattagctagtgtaacagaaacaagcaagaaaacattatagatttggtttcctccctttcctagacaaaaactgtttctggtttcctccctttcctagacaaaaactgtttctggtttcctccagaactccatacacctcatcacctcatcgtacaatcctccctttcctagacaaactgcttctggtttcctccagaactccaaacacctcatcacctattcaccttaggccccaacaggaaagacaaaataagcactcatgcacaggtttcactcaatttttccccatcattatgacaagtaacacttctttgcattcgcaaatcttgttacagattttgagggtacatgaagcagcaaaaggatacgtttgcaatggaagacactataggttgtccttctgttataga

SEQ ID NO: 49930 - DNA, 1228 bp, Oryza sativa
cagaagtatcataggtggggttccgtaccgagcaaaccggcgatctaaccgatcatgggattacacggttcgctactttgatctaaacaaaacccaaattgatctatggggtcgtcctctaaccctaagacctgcccctaacggactcaacttgatacacaacccattgggcccaaataagttgacgcaacaccgttggcagaaaaaggtctagtaaaacggcgattgcagcctctccagaacagatttgacatgaggccggatccatttgaaatagacttgataagttttcgatgaagtacttgcacgccaaatcggagttcgtatgaagtcgtggcgatcgtcagaagttggtgctgtcctgcagtccgaatccagcctgcgcgaatcctctcccctctggatcctctccattgttcctgagtaaaacaagagtgcacgtgtctctggggtataaagatgatgaacatggactcaagaatgaactcacctgatagttgacttgacgtgcacgagcacgggtaataggactatgaagttggacttgtggagatgtggatgtaccgagggtgttgatgtcctcatcaaaaacaaagtgactttatctgcttgatctggttgccttcacttcagaatgaggaaagtcaaaccaggcagtttttgtgaaactgacgaacaaagtgatgtcagaaggattatattacattagctgaccgacttgattgacccacataattgttcctagaatgggtgcctcagcaatcccctgcctcaattttcaaattctctctttccacgtgcccatattcctttaaatgtaactgtgtccccttaactactagcagctggaacctactctcataagaccatcagtgttatgtaaccacaatgcatgtctttcattgctatatcagaagcaagtgctaggtagtgaacatcccaacacatgtattggttcttttctttctttgttttttgtacaacaattgaataaagtaagttcctaattttttatattaatccttttgctatttctctccacaatatgagaaaagatatgccaaagtaataaaatattaatatgtaacaaactgctggttcaaacctatgaacggtggtgaactgtgatttgataacctgactgttttaacttttgagtactggagatattttttatagattttgcaagcttcattaattttggctgttgatttgtatctgattctag

SEQ ID NO: 49931 - DNA, 653 bp, Oryza sativa
atatatatatatatatatatatatatatatatatatatatatatatatatatatatatatatatatatatatatatatatatgtcttcttcctcctccagctgcccgagcaagcttcaaaatttcttcaaaaaagatgggaggtcataccaaaatttctagtgaatttattttggtgattatatacaaatcggaggtggctaaaaggttagcaacttcatcctccaatgttttttttgtcatattacatttggagctatgttttgcacaattttttgtctctaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaaacaagctaaaatgaaaattaaaagaagtacaacacattaatattagtttaaactttagaaatagtaaataagaattatttggtgtaatattttataatttttgtatgaataatgatatgtcattattgtatgactgttgaaagagtttgttattattttataattattgtatgactgtcattattgtacgaataattatttgtgtacgattttttccatctcatgtaga

SEQ ID NO: 49932 - DNA, 956 bp, Oryza sativa
cttcttctgacagaagctctctgctttggtttgcaaaggagtgaggctttttctgaacctgctgctgcaatacaggtagtagtgttcatcaggttagtgtgtgtgcagatttgcagctccagaattcagaaattagattgaaggcctgttcactttgatgccattttcaaccttacttttagtaaggttgctaaaaaagtggctacatttaatttgctgccaaattttaataactatataaaaaatcctgccaaaattttgacaactatactaaaattttagcaatgccaaaatttgataaggtttttttggcatcaaagtgaacaggcccgaaaaaaaaagatatactactattaatttccataagatctagataagcatttttcagccacatatctgatatctcaaagtgttgaaattgttgcatagaaactgagtgctaggagtgtggtacactgattaatatttaatttggacatgtactaccaagatgatgtctactcctaactgaaacatttatgttttgccttgcccccacagtactgcaatttggtttaagattcccaattctgcaggacggttagaagggagagaaaatactgaacttacataatctgtaccaacatcatcatcatctattatgttcatctgtaatcaactattgcacatttagaaggaatgaaaatcaatcagaagtgcccaactggggtattctactggttagtttactttatcccactttgtttttctctaaggagagaatgctactgattaatttaatttaattttatgctaggaggtcatactactgttgatgggtttgggccggatagcagacagaacaggatcacaactaacaactgataacataataaattccttgagatccaagtgcacagaaacacaagtgtaaaataaataaagtaatgggttgagttcttgggttgctctacagg

SEQ ID NO: 49933 - DNA, 192 bp, Oryza sativa
ttgcaaccgggactattgtggaattcggccgaccgatgaaagatggtttctccaccagtgggacctcaaagaatctcgctgttaagttgagggacctccggtgaacttattcctaaattaaacgaaatgccatctaattaatgggccagtctgaatctacagtgtgtgtcaccgtttgcctggtccttcagg

SEQ ID NO: 49934 - DNA, 985 bp, Oryza sativa
  unsure (1)..(985): unsure at all n locations
tattggctacttcatgagctatgttcagcgataaccactcatgcaattgctcatcactactaatctcaacccatgcatcatcacaaacacgccagaaagtaatgtattgtttagaaccccacacaattttagagccgatgaaatcaactaactgcagcaatttgaagctagctatgtccacatctgttgtaaaatgcctacttgtgaaataggtctttggccccccatctggcaaactgaaatgtgaccttactctaacatcaagaatcaaattacatggaacaggcctacaaataggagcaacacaagataaagaacaactttcagtaaaatttttaggtgcttgtaggaatggagacaacatacaacatataaaccctaggttagattagcaatggagacaccaagttcaattagagtaagacacaacatctaaaccctaaattagcactggacacaacatctataccctaaatttgcatggtattgcatatgttcctataacctagcagggtcacaaccacaagcatgcacggggtcacaggatcacaaccacagggtcactggaagagaatagagagaaaatacctttgtatggtaggaatcccttgcatggttgagggagcgtcgatgtcggctacctccgagctggtaggaatcccttccatggttgagggagcgtcgatgtcgcctacctccgagtgctggccctcccaccgtcaccgcgtgtagcacccgccgccgccccgcgtcccacagctcgctgtcgccgcccccacagcaaagccgtcgccgccccacagcaaagccgtcgccgcgccccacagcttgccgtagatcggcgccggcccgctccacatcaaactgccgccgccgccgcccccacagcgcgccgtcaccgtcccctcagatcggcgccgcnccgcgccccatcaaaccgcagccgccgccgcctcctcagttngccgccgcctcaccgcacaga

SEQ ID NO: 49935 - DNA, 1501 bp, Oryza sativa
  unsure (1)..(1501): unsure at all n locations
tgtgaaataggtctttggccccccatctggcaaactgaaatgtgaccttactctaacatcaagaatcaaattacatggaacaggcctacaaataggagcaacacaagataaagaacaactttcagtaaaatttttaggtgcttgtaggaatggagacaacatacaacatataaaccctaggttagattagcaatggagacaccaagttcaattagagtaagacacaacatctaaaccctaaattagcactggacacaacatctataccctaaatttgcatggtattgcatatgttcctataacctagcagggtcacaaccacaagcatgcacggggtcacaggatcacaaccacagggtcactggaagagaatagagagaaaatacctttgtatggtaggaatcccttgcatggttgagggagcgtcgatgtcggctacctccgagctggtaggaatcccttccatggttgagggagcgtcgatgtcgcctacctccgagtgctggccctcccaccgtcaccgcgtgtagcacccgccgccgccccgcgtcccacagctcgctgtcgccgcccccacagcaaagccgtcgccgccccacagcaaagccgtcgccgcgccccacagcttgccgtagatcggcgccggcccgctccacatcaaactgccgccgccgccgcccccacagcgcgccgtcaccgtcccctcagatcggcgccgcnccgcgccccatcaaaccgcagccgccgccgcctcctcagttngccgccgcctcaccgcacagatcggcgccgccgcccccctcagatcggcgccgacccggaccggacgcgccgccgccctccaccacaacgagcgggcgccgccgccgccgcccctttcagccgccgtcgccgcatgcgtactcgctgccgccaccgcacacacgagtgagagagaggtgagaccgtgaggaatgcacgagtgagagagagaaagagagagtagaatagggtttgggatttggagggtattttcgccattaggaactctggaaagattttcttttttttttaaattgaaccctaacggagtcagtgaaagagggttagacggaagttttgtactcaaaaaggagggtcaaataagcaaagttcaaaatgtagggccaaatcggcaattacaatttaaaatggggtcaaataaacaattgcccaaaaaaaacgccatactacaacaaacatgtgttcacatattcaaaacaatggaatcatctccactgttgttttcaactggttttactgtttccaattgtgagttggacagttcgttctggatctgcatagtcagaaaatctcgttagtgaaacggcaacgcgcaatcaataactatcctgcttaggtatgagcttccaagtcccgaatccttttgtctcaagtctgccttggtaatgtgaccaagatccaaattcgaattggttcctggtcctgtttggacatagaatcgagtccttgtgaatgggca

SEQ ID NO: 49936 - DNA, 1501 bp, Oryza sativa
gggcagaaacacaaattaacagagacagctgacagagagcgctggtatgcttctgccacatcgcgatctccaatctgaaaccttcgccatcgtcgcatcaccaccatccaccgatcgatcgagtgctccaaccggagcggagcgggcgtttatcacgccggaatcgcaaggcggcgccgatgaatcggctgaaaatgcatggcacgtgcagccacgtaggtgttgatgaagccgtcgtcgtactgtgggtagctgtgtaatgttgacctcgccatcgatcgtatcgatggatcgagtggatatgatgattatggctgtcggtccaagatgacaagaatttgtggcgtgattgattattggcgcgtgtaattaatgtagtgccggtcgagccaccgcatcgcagggagaggggccggatcgagctgagagcgacgctgcttttctgtttgtcaaagatctgggcactagcgattgtctgttattttaagtactccctccgtttcaaaatatttgtcaccgttgactttttagcacatgtttgaccattcgtcttattcaaaaaatattgtgaaatatgtaaaactatatgtgacatgaaagtatatttaacaatgaatcaaatgatatgaaaagaataaataattaattaaattttttgaataagacgaatggtcaaacacgtactaaaaagtcaacggtgtcaaacattttgaaacggagggagtactagcagggcggatccagaaaaaaaaagttgaggggactcaacataccgagtacaccgatataaacacataatctcagtattaaactatgctaaaatactattataagacctttagcacttcttatcttatcaactatgatgaaaaaattgaaggggggcttaggggggtatccatgggttttgtgggtgttggatccgcccatgtactagctagtttactccttactagcagttgctaagctagtcttggccatggaaatatgtgcaattcatgttgcatttgcatctgttcctcctggtgaaatgttcaccacctatacagatttgagttcagatcatatgattaaaccggtttttctggagcagaaaatctcttcttgttggagacaatataataaccccttgatgagtgttatgatattccatgcaacgtttgttaggtttagctggtgtgttgatctcgtttttataactgtgtagcaatccagtacttaatttgttaattagcgctttaatccatgagtcatgcataccgatcgtagctagtaacaactagttaaaccgtactttggcatgtgcaagtcaaaccttttaacaattggtggctatatatcatggcaaagttaaagttaatttcttctagagtgtgacgagagaaatagtaatccaggaaatcacatcacttttcgtactgacccgagagacggatctcgcaacaacattcgttgtacttccggatgaacgtactcacaactaactttaacttcagcacct

SEQ ID NO: 49937 - DNA, 1501 bp, Oryza sativa
attctgtgacacaatgctgacatgtttcttatgtggttcaaccttcacggaaattggggaagccctagatttcctgtttggtccctctaagcatgtaccctcaattcttcgcgtccttttccgcttgacaggtgaaactccaacttttgctgcacctgcataattacattttgaaaagaaacacggaaaatccatagttgaaactacaacggagctggaatgctactggcttactttgttgaggcgcattgctcggtccttcggtaccatcagttaagtacagcgctgccgttttgtactccttcaggcagccgttctgtaggaacacctcaaccgtgaacaccatgttaccttcataccggaacagcaggatgttgccttcggagagatcatgagcagccagaaatggcgcccagccgtctcgcagtagcacgtccggttgctcccgttgtagttcgactcgccagaacttgccaagagggcaaacaataatggcattctggtggttgtttgtgtaggtttcagtcaggtgttgctgcacaaacttctcagggattttctgaaagaatgttgacagcaaaagaaagagcatgctgtgagcacataatacatataactgcatcaccttcagagctaatagcctatcaattccacaaatacatagtactactagcactagcttattagctgaaggcggccctgttcttttcatctcattcatcgaactattgaaacggggttatttgctccactcttcgaaaaatacgttaccacttgttttaagttatttgtttaagtttatttcttaaagcatttaacttatccccataatccaatcgatcgataatccgcttaacaatctaaatcaaacaaggccagagtgcattatcataagaagaagagaagcaggtaatcaaccagaagagcagaacttgggcggaagttgcaagggttatgacgggtgaagcggagctgtggcggctagctagagctgcaatccctgttttggtagctcatgttagtggagaagggtcgcaaaatttagttggagattaagcttttgtttcttggttctcctcctgtaccctgtccccttcgctttgtcttttcggcccactttgtacatacatttattccttcttaatacaaagatacgctccttgcgtattccaaaaaaaaaaaaaaggtaaagatgatggcttggtgaatgctcaccatcttttccaggtcttcctgttggagcagcttgatgaagcgaggcctgtccttggttctcatacctgtaaatgcaaccataatccgaatgtttaaaaaaaaaagctacaaatctttacaaagtaaaaccaaattagtcatatttcaagcaaaaataatttaactcaactttggctcatgaatcattatagaaaaacatatagaaatggataaacagttacacatacgccattgctgagatttggtgtacctgcgtgaggagtgcagaagcgcgcgaggcagaagc

SEQ ID NO: 49938 - DNA, 232 bp, Oryza sativa
acgagctagaaaccaagctcggctcggctcgtcagcaagctcgagctagctcgtttagctcgtgagctttggggacgagagaaagcgaacaaggggagaagccgaggaggggcaccgggaggagccgagaggggcgccgagaggagcggcgcgggcggcggcgtccacgaccggccgcgtcagcgccgggaggagcggcacaggcgacggcatccacggcggcgtcagcgcc

SEQ ID NO: 49939 - DNA, 1501 bp, Oryza sativa
tttaacatatcaatattttagaacagtggattttttagagtgctaatcagaactaattattatattttattttttgatattatagagctaatctaattatgcatgattgtgaagtgatatatgatgatatgatctacattatctatgttctacacaatatttttttattgttggatggcatgtgaaaggttcggatatgatttgaaataatggaggaacttttttttaatgttactcatgctttaagtgtttttattttttgtcatatctattatatttaatttatttatgaaagttttataaagtgatacattgttgttttttcttcttttttttgacagcttcaatagcatcctaaggttaggatataataaaaaataaatatttcttatgagttaaagaatgtagtacattttattggtatttatttggttaattaagcaccatgaatacgataatgaagaatgataaaatagacttatgtgcaaggttatgattattcctctatacggaaatgatttaaaaatattttttttaattgtaacaaatttaaaagaaagaaagagatgagaagattgcataggagggggagagatacgtacgtacgtacataccatagggaggagggtgggttggtggggaaaggggaggaaggtggattatggtttttttttctaaaaataaatctcgtaaatgaaaatagtgggtattctaaaaataaatctaatagatgaaaatagtgggcctagcgatttattagagagccacgtagtagcttaggagcgtttgtaggagtcccacgtgggggcttgagagtgtttgtacgaagtttaatggacttttactatataataatagatatgaatgtgagaaatgctagaatgacttacattatgaaacggaggaagtacaatatgcacaatgcatgatggtgaagctgaatttttcttcgcagcttgcagcttctgttgtatcccaatcggaaactctgtaagaaatgcagtaacgcagtgttatgcgcagggtttcagtgtgaatttgggataaaacaccgccagatcgaaagatagtttagttgggatgagaagagattatagattgagaagaacttgaagggaaactaattttgattattcattgcttaatctcaatgcccataacacgcagagagattgatcctattctcgagatcataaattgggccctcaccatctcagcccaccatggaaaagaaaaaaaaaaacaagaagaataatagcataacagagtgtgagttttcagagagagaacttggaagtatacctgggctgggctcgcaccaatttgggcacgaaccgtttcagcccacaaacccattatttcggttacttgcacattatttctgcaggattctttgagaaataaatttattcagcacttggctgagcatttttctcccccatgataataggccacaaccgattgggtagcttagctttgctgtctacaaaaatatcataca

SEQ ID NO: 49940 - DNA, 1501 bp, Oryza sativa
gtgagcgtcgtgtgccgctagcctttggctattcactccgccgtctcacagataagattttttttaaaataataattatttgtatcgaagtttataaaattggaaataaatatattaaccgtagataaagaaatagataattgtattgtgatttgctaaaatgaggatattttgatttttggttttatattgatatgagtaaaaggtaaatttattttaaattgggacagatgaagtgtacttcagaatcagatatggggatcaaattcgatcgctagctgctgcacacatgcgattttccaagtgctcgatcgcgtccgtccaacgatcgcatgggctactagcggctgtttgttgttcgaagtgtctctttgctactactccattctcgttcggatcgagtagcttctggagtgatcgtatatatcatcgtacacaaattgcgtagaagtagcactgtactgcatcctcacgtctgcgcgcagaggtctctgatcaaccgatgcatcgcctcgtgtgcacgaaaacggccgggaaaaaggcaaacttcgctactcagtagcacagtacggcgtacctacgcacagtacactgatctactctgctcttctttgaataacacaagacagaacacgatagagagaaaggaaggagaataaaatcacaagcgaaacgagaggccatccgtcaattttgcgcgacctgcgtgcgtgcgtacgtggaccggccggccggccgcgcgccggcgcgttcgcgacattccttgcacacccgaagacaacgagtcgacgacgacgctgacgaagacgatcgacgacgtacgacgaaggcggcgtcagagacaatggtggagcggttagttttgacatcacgcgggccgggtcgccgcgtgcgtatcatcatcatcgacaacagcaacatccggatcagcagctggctcgcgtcgcggcattggtttaacttttacttttgaggcagattttcctctcttctttctgggataaaggaagattcgagcgcactactacttcgttagtggcggtaattaattaagggtacccattaattaattcagtagtgcgctaatggcgtaattaatgggccagggcgaaaggcggtttgttgggggggggggggggggaatttggtaaagtttagtactgcttgaccaggctttaggtaaaaagctattcttaaaccaggtgctgaagttaaagttagttgtgagtacgttcatccggaagtacaacgaatgttgttgcgagatccgtctctcgggtcagtacgaaaagtgatgtgatttcctggattactatttctctcgtcacactctagaagaaattaactttaactttgccatgatatatagccaccaattgttaaaaggtttgacttgcacatgccaaagtacggtttaactagttgttactagctacgatcggtatgcatgactcatggattaaagcgctaattaacaaattaagtactggattgctacaca

SEQ ID NO: 49941 - DNA, 1501 bp, Oryza sativa
acccatctctcttttcacatccatgtctccccccctctctctcttccctttgccttccccatcgcagcggtggcccaggcggtgatgcgccgggcgagaaacggaccggcggcgcgccgagtcgggaacggatcgacggttgggtggcacatctccagacgatgacgccattgagctcccttttcatctccctctctctatcctctctcctcatgttccaaggggcaagaaggcatgtacgccggcgcctccctccccctacgaccctccgcagcgacgaactctcggcggggtcttcctcgcggaggtcaccacgcgaccttgtcttcctcgcgaaaccgggtggagcaacagcccgagcggcgacattgggctgagtggtcagatgtgtcctaggctcactggatcaaggtgacagcgagctcgggcgtggcctcgacctcgagctcctttccttctccgtgctttcctcatcgagcccgcgagcttctccgacaaggacggtggcggtggcggcggcgcagagctcccaagcagtgtggcgacgaactccccggtgacaccgaggtcggtgatgcggagcagagcgcagggacgaggacgagatcgacgacgcagagcgggagagacgctgtggagggcacgaggggatggtgagtcggaggcacaccctccacagcgcgggcttcaggcgttccctccaccgcgcgtggtctcacgcgagcaaggaatcgcgttgccttgtgtgggagcgagcagctcaagaaggacgcggtccggcgcgacacgtctgcgatattcctagctggtgcaaggaggtaacgctccacgtaggagcatgtgagaggcctgaaaggcgtaggtgattcttcataggttagcgatacgaagtaactcgccacgtccactcgatgaaaaggttcatctttcgctttttcgtgttcagctggagatgtcagagcctcatagtttggcctaaacagccaaagaataagtcaaaatttgaatttttgaacttaattttgaagttgattttgagatgcttttaacgtaagttttgttaatgttagcttttaagtcgctatgaacaaatctataaaagttttacttataaattaatttgtaaaatgggcaaccgatgggagccttagatggaagacagtacttcatctgtaaaaaaaaaaaaccaatctagaaggagatgtgatccttattagcacaataaatatggacaaatatttatctagatttgctatagtacaacgaaatccatctcatgataggttggttttttccggaccagacatacactccatctgaccgttgtctgaccggcaatgaattctgagagggagagaagccggcctgaccaaccgacctccgccgtctcgtcccatccaacaccatctccgaggagccaccactccactccaaccaccacgcccaggcaggcagccttctcgccgcgttcacactcactcacacggctagctcagctacc

SEQ ID NO: 49942 - DNA, 1501 bp, Oryza sativa
cgcaccttcctcgacgaccgtcgcagctcgtacgccgccgccgccgccggctggtcgtcggcgatgtccccgtaacctgaaccagccgccgccgacccgaagcaagacaggtttcctcccattgtgtactcagtacagctgcttgcttaattagctacttaaatacacttgtcaagtagctggtagtgatcacttggaacacacttgtcaggtagaggaagctagctctgcttaattttggagggtaaatggcttggccctctccaatttataggggagggatggcaaccccccaaggagatcacggacggccgggattcgctcgaaccgcggccgcgccgtgatctgacggtggagattgctgcagagaacgtgcgtaccgcgtgttgtgcacgttgcgcgccgcgcgcaggggtggtggtggtggtggtggtgatgctggggttcaggtagattcttcggaagacaacggcgcgtgtgaaactcgatcagcaaagttcctagcttcttcagacttctgggtggaaggaatttcagaggaaattaatttgaaacgatttcattaatccttaggaaaattttcttatatattaactcctttggaacgaaggaatatactccatccattctaaaatgcttgacgccgttgatttttttaaaaatgtttgaccattcatcttattcaaaaaatttaagtaattattaattcttttcctatcatttgatttattgttaaatatacttttatgtatacatatagttttagacatttcacaagaatttttgaataagacgaacggtcaaacatatttaaaaaagtcaatggcgtcaaacatttaaggaatgagggagtatatgattaagaaaaataacttgcttcctacgtatgtcccaattctaaatgaaaacaaacatgaggtcttatctcatgttttgagaagtcgcatgcactctctcttcccctttctctctctagtatctctcgtccattaaattattttcaccaaccttctgtcgtttaatttgtttcgtacaaaccatccaaatgcccaaagtccaaagttcctatacagcatattttttttattgccatattgtaaagtgtgcttagcgatatatattttttcctttcaaaatccctcctccctgatatagtgatatgctaaaaaaatatttttagtaattgtctaaagggagtgcctagatccactaaaaaaactaatttgtttggaagtgtcttatattggttaatttggcattatcgcaatgatatactattcaatgataaaaaattttctaaccattacaggttatcttcatgtcttccttccagttgactccatttttgttctggatgctttcacagaaggagcatgatactgtgtgcagtgtagctacacactcttgaagtcgatagctagatgtctgttgttccactttggatgttgtagtttttatagaatatcgttatagattttatatgttctattttcggtttttc

SEQ ID NO: 49943 - DNA, 1501 bp, Oryza sativa
cccggcccggcggagtctggcctcctcccgagcggcctcctcagcctggcgaacccggacggcctcctaggcagcctcctcggcttcccggaggcggtctgcggcttctcgccggtcagcttcccgcctccgggcctccgcggtcgccgtctcctcggcctcaaaccggccggacttggaatggcgggggggcgcgacgggatctcgctgaggcagaagaaaaaccagaagacaaaaagaaacgggcgagtgaaaactcgccttgggagatgggagaatgaacacggcgcggtgggcgcggggacgaacctgcggggaggtcggctaaacgaccacctcggaggcgagatgaggttcccccggcatggctcggtcccccccatcttgcggagccgtttcttctttcgctccccctcgggctgcggcgtcggcacggcaccctccgggcgcctgctgctggcacgcaccgccccgccccctcggggaggagatgggggggcgtgccctcctgcttcctcttcccccgggcgtcggcagggcggctgccccccgggcccccgtcgcggggcccagaagcatgaccccctcccggggtagattgtttcctcctgcggctcccgcccgcgccatcgtggcctcggggggcccgctcccccgacgccccgaccgcctgcatgatgatcaggatgttggcgcgatctggatcgctgcagagggggaggacaccttgggggataagggatgcctccacggagctgagattcagcacccgttggaccaccatcctgaagtcctcagggacccagtcccatttgcgcccctggtgggtcctcatgtagtcctcgggcccggtgtactcccaggcgccccgggcgcgccgctggagcggcgcgatccggcgacgaaggtagtcgccgaacaccatggctcccgtaagcccctgggatcgcagacccgccaggcggtcaagaacggcgtcgtagccgtctcccagatctaccgtctcccgccagctggaggcctgcgccgggggctggctcggaagtcggaggcgcgcttcgtcggcgaggggggtgtagaaccaatcgctcttccagtcgtcccacttcttgcggaggacgcagggaatgtagcggtgcagcacctgcccccgcggctggaagtagcagccaccgactaccgtcggcggcgacaccggctgtacggtgaagaaccaccggaacagccggagagatgggcgcaccccgataaacatctcgcacaggtgcgcgaagatggccaacgtcattattgcgttgggggtgagatgcgccatctggagatcataaaactccagaacatccatgaagaaattagagaatggcgggaccagcccggccattgcgaaagagaggaagaagacggaccgccccgggtagtctggcgccaggcgtccctcgcccagcgcgaccacctcccggccggtggcagattccggcatgaatcggcgcggcagcccggc

SEQ ID NO: 49944 - DNA, 870 bp, Oryza sativa
acgcgtgggacccacggcgccggcaggtgcgagcccgggtgcgcccggtccaccgtggcccgtggggctgccgcgtgggccccaccccagtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttcttagtgtaaaagccttttcttttccgttggtcgtgtagacgctgcagcttcggaagatccgctcttcgtggaagttgaagccggcgtttgggaaagtgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattgttatggttattattaccttgttcaccctaggataaacaaaaccccaactagtgggtactctattcatggtcccactagtatgaatttaggtagatgcttcgctgattaattaggcaacattaggtggttttataactctagactttgggatattcatatcacctggacactttggaattgttggagtattgtggaattggattcacaccgccccctctattcaaaatccccaaaaatggttttaggctgggctcggggtgcatggttttgatagtagcacctcggccatataaggaccggt

SEQ ID NO: 49945 - DNA, 1501 bp, Oryza sativa
atttatcttcagaagttcgattgtttttggaacggatggtgcaactgttatacctcgctatttttatgtgagcgtgagcttttagaccttaccattctatgagatatttaactatttgtcaatcttataagcgataattaaggatctataaatgaaaccatatatacacatgtaagggtcacgtgttgttatagaccgtggtaaattttttattgtcacgtttgcaaatagttaaatgctcccccgtttttacatttgtcacggcgggcgcggttaggcgccgccatcgatcgaagcagcaagcgaggaaaaacagccaagagagaggaacatcaagacggcaagaaagcagcaacaggaccagagcaagcaagaccccatcaatcaatcatcggataccacctctcgctgccctgcgccccccacaagattccgacgacagcaaagacagcgacgggaggggagggatcgcgcgttctcgattcggaaatattttttttgttccctctcttgccgttgatgtcgacggaaatcacagtgtggaggtgggggcaaggagaagtactgtagcttgtgaaagcgagtggttttggatccaagctggttgattgattgctcttcgtctcccctggctataaaacgagcggggccgcagccgggctgcggcgaggccgccctccacagatttcttggcgatttgtctggttctgcctgctcttgctggtttcagatccgggaggggactgagcctccgaagttatcaggtatccccttttcttttgcttcagttttgagttcttggtgaggattcttgcttggattgggaagatcgttgcttttcttggggggctttgtgtcggtggtgggattcctgatcaattctaggagaagactggttctgagtagctggttcgtgggtcgcagtgattttggggataaattttggatatgtatgctgattaggatggacttgaagtatcattcgtacaaccgtgtcgtagcctcgtaggcttatgcccgtggttgtgaattgtggtggaaaggttggattttttgggctgagctttagttggtctaacatgatcttgcagcttgtttctttgtgcgttttgtctcatattctggatataattttatttactttatgttttgacttagagagttgcgtttctaaattcttaaagtcttttggtagaagagagaatgaacttcttgcttcaagggagtacctagtatcagaaatttcttctctccataagtccatacttgcattaattaaaaatgtgatacattcattttggggaatattaaagctgaacagcataagaaatggaaaccaagttaaaactgtctgattcaaagaaagttagatgcatgataataagcatacttggttttccagataaaaatctgactgaatccttgctatccaggagagtgaaagacataatggggatcagcagcgaatcgccgaatgggagccagcagattgtacaaaagg

SEQ ID NO: 49946 - DNA, 1501 bp, Oryza sativa
gatggtgctgcgttcgccggggcgaggagagctcgggtttttttttttaatggcggattcttcgcggaagctgcggcgatcggagaagaaaagggagacggcgagaacggcagcagaggggtggcatagtataattagtcattaaaaggttaatgatgttgattaaaagagggattaagcttcaaaagaaaaaattactgtaactctttcctatcataaataagtggcattctcagataagtgtagttaggattagaatataagggttactgtgccactgacatatggatcatatcgaagtggaatatatatatacagagagagaggatataaccataagttgcacgacgttagaggattcactttcatgtattgtagttaatatgcttctaactttgaccatcagaaattctctctgaatattttgattcaacttttcaaaataatatggttagatttatcagcttcaaaatattgtgacattgatatattcttcatactaggttttactacttagtaattattaaataaattattggtgataatgttggtttccaaaatatcacttatttatgactggtgggagaatgagcaaacatgaggattagcgaaggcctacaaagcgtgttacaaaaaatgtatagaattctcatgtaaaattaatacgaaccactccctcaaacgttcacaaaaatcctttaaaattcacacgttcagagcaaaacctcaggctatttgtttgctatagaaagttggtcattctagttggatgattctctattgtgcaatcaacatacaccttttgaactttgaaggaaaaaaatgcccatacataagacttgggaattatttccaacaccgacaaaaaaaggaaaacaaatttgaactttgaaggcgagttgtaaaacaagagcaagttgggggcgccaatcttggcgacagccatgataaagatgcggaaagccagcatgtgaagcaactaagcttagcttagcttaagcctaatcttaggcttaggctgcggccggtgggggcgttacgccattgctttctgaaaaggacactgtcccctttggctaactgcaagctactactgcagcttaacatctctcactatcaggtggggcccacctttgacagatggctctgctgttcagtatagtagggtcccaatttggaagggttaaagagcttttgttgtttttttttaattattgaagcagattatttgcttcacatttaaagaaaaattcaagaaaactttatttggttgtattgtacggttataccctttatgttttgagctacttgtatttgttaagattatttttaaaatattaaatttatccatataattaagtaaaaaatttgtaacaacaacccacttaattatctattttaaactcagccttaaagctaaaccaagtaattgttcttcccttgtaaactctcagacagggtgtcattttcagctaagatatataaagaattcagttaagaa

SEQ ID NO: 49947 - DNA, 499 bp, Oryza sativa
gttgcttaccatgcactttgcattgcagagctctatttcacccacttcacgtctttgatgcttgttaggctgtaaaactggtttagcttacatatcaacggcatttaatagtactagatagaaggatcatgtcttaacagtactggttaatagtactggtttagctttgtaatcctaaataaatgttctgatattcaaaatttcaaaagttaacttcagatttgcatcaagatactattgtttacgttgtttaggatcaacatcagaaggagagtagaaaagtcgttttgaaggcacaggcagatttggtattcaagcagaagaattacgccgctgcagcaaaaatatatgatctggtaatttcttgcaccttatttctgattgttaacgctaatcaattattgttgttataaagtttttgtatgttattcttaagcttgggaatgatttgtttatctgatgcttgagcataggcaatagctcatggaccgactgcagt

SEQ ID NO: 49948 - DNA, 512 bp, Oryza sativa
atatttttatatatatatatatatatatatatatatatatatatatatatatatatatatatatatatatatatatatatatatatatgtctcatcataccagatgtgatatatacatgattcgaagggaatcttttagctcataaaaaactgcatacatagcaccaattttgtttttggaaacaagaaaaatactcaaaagaggtagtgtgtataaacaattgatagtgggtaattgtcctataacccaacgataaactctctcaaacaaagcatttcgggctcaaacaattctctcaaaagaagtgcttggcaaacaaacggttcctctggacaagagctgataacatcatgagcgaaaaatgtaaagtcaactgaacaagaacttgtataccaatagcttatagagggctggggtgcttaacctgaaaaagttctcgagagcgctaagggtaagatggctatagcgcaccagtggaaggcaacgaaaaagacataagtagggctggata

SEQ ID NO: 49949 - DNA, 380 bp, Oryza sativa
tttttccacgtttaatactatatgtatgtgtctaaacatttgatgtgatagatgaaaaagtttttgttttgggaactaaacagggcccaagtcgtgtgcagtgcaccggtccgcttccgtgcgtgtgtgagatgggcgttccagatcagctccaagtttgcttgaaagcgtcgcttctcgttgcgttgccacttgccaagcagcagcacgtgaattcgttgctgttatcttatctatcctggaaagcgacatcgccccctgtggcttggagttgcacgtattccattccatctctctctcacacacacggatcgacgatccacgatccactgtaccaaccgcggcatatgcttaccttaccggctcctacccccaccagc

SEQ ID NO: 49950 - DNA, 170 bp, Oryza sativa
ttcctgcagcccttagcaaggatggcatcacagaaactactaatatttgctggaaaatactagcgaactactaatgctgattgtcgaataatttcagtgatagttctactgagagagattcttgactactaaagatgacaatcaacaaagcattaggatgggcatgcaat

SEQ ID NO: 49951 - DNA, 267 bp, Oryza sativa
atgatcaagttcttcgatcttagatgctgcacatatcttggagaagaaaaaggaataaaaaaacattgaattctcgaaactttcagagataaaaaatgaacactgaaatttctgaaaatttcagagtgattgtgatgtatagtacagaagaagccatggttgaagaaaccagattaaatttcttgttacaacaacgtttagatgcattagctgctatactatgagttacagaaatggagatattaggatgaaatcatcccatctcca

SEQ ID NO: 49952 - DNA, 1501 bp, Oryza sativa
gatggtttgctatttgctaagacttgatactactacttgtaatatactccctccatccctaaatatttgacgccgttgacttttttaaatatgtttgaccgttcatcttattcaaaaacttttgtgacatgtgtaaaattatatgtatacataaaagcatatttaacaataaattaaatgataggaaaagaattaataattacttaattttttttaataagacgaacagtcaaacatttttaaaaaaagtcaatggcgtcaaacattttgggatggagggagtaatacacagtagaacctatacttcaataaaaagattatctttagtaccctctactttaattcacacattttagatcctctctcattttacatcgctgtcgctgctgcctgtgattcctgcgaggaaagggtgggggacagggggagtgactagcgtggttgctacagcgctacacgttcgcgttttgcacgcggaaccgcccccacctttctccctttccccttcctccatcagcagcagcagcacgggcctgaccgtgaccgtcccccacgtcgtcctccccacacacgcgacgccagtacgccactgccagcgcgaaacaagcaacacacgcattcctcctcccgattcgctcgcggccgcaccgcaccgcagctctcctcctcctcctcccccacccaaacccacggcggcagattcgatctcgaattctcgaactctctcgatcgaaccctgtgccctctgctccccgcaaaatcctccgcatttgatgagtagtcctatcactcttcttcctccccgcgcaaatcctcgccgccacttggatgccagggagctccacctcgccgccgaccaccaccaccacccttctctcctccgctccccgccgcggcgcctaggccgctgccgccgccgatgggctaggagaggagagggatcgccgcctccctgcgatcgccaccgggggagccggaccctctccgcgagatctggttaattgatttgcctactaccagtattccgctagattctggaccgattcctctctgttgatgcaaccactgtacagttgttgctttccttgatgatcagaaggagctggcgatttcggaggtgaatgcgttgtttcatatgggtttgcagcttatgctacaacagctatctccgatttagtttattacctttggggagcgtagagattggattccgctttgcgttttcctctttcctgcgagattctagcttatccttcgattaaacctattcgcgcggctattagcgcaagtggttaggacggacgcagactaaaaaaggttaggttattagggatttggttttccatttggattgccgattgcgggagcatatcctattgggagattccggcactgtaaagatatccttggcaactgagttgatttaatgttaatgttagtggtggtggggagggcagataatacgcattctgatctgcctgtcaagttgggggagaagaga

SEQ ID NO: 49953 - DNA, 352 bp, Oryza sativa
ttgttgtagacgcttatatttatcataaatactgcaaatctcgtatttgtttgtggcactaatcttgcagagcaatgtccctaaggtcgagcttgtgacaataaacaaagcactgctaggagataccccggattatcatggtaagctttctgtcacaccccaatccggcaccgccgtacaacagcacctgactggagcgtgtcgtaggaaaaacggcgcgaaccgcttcctacgaaaccgcgatctcagtaccagtcccaggacatagcgctggtacccacggtgacaaatatgaatcattgcaatccttaaaataaatagaggacttatttaccttaacataggttgcagc

SEQ ID NO: 49954 - DNA, 221 bp, Oryza sativa
tataactcattcatcaattacctagatagcatggggtccctattggatatatcaccacaagtaacaagtaatgagcaaagaataataggcatgcatgtcattttcagggagaccatagactctaattgtaccatccctagcttgggttcaattatcttcgatattttagaattgatagtcaaattaaactcaagatagaatggatgtccaaagtaaaaatt

SEQ ID NO: 49955 - DNA, 943 bp, Oryza sativa
ttcctgcagccccgggccgaaaagagacttgagtctcgattcgactttaagagatgcttttcaacaactcaaatggtaatgtaccgacctcccgggttagatcattacttatcggctcccagagccatttcacttgattaggtggctcccagagcctttttcatttttgcggactcccagagtccagctgccaagcagcaagcaatccgcttccactcgggaagcctagtctatgatgcccacagacatcccgaatcacacagattcgtttctgaccactcaggtcatccatctgccacataggttgattctggttacgattcccattccacaacaacttttcgcaaagcacaggcaatcaaatctacgcaacgggaaccacctcacatccgcccatgaccgtgggcacggctgttcgaacagttagttaacctctgcagaggggtacactttacccacaagacacgaacttactctagacactggccggtgtgagaggtttgtgacaaagcctttctcaagccgacttagggtcacctcatgccacatagaagaatcaaatcctcacataaatataggccattttagttttcacaaatcaaactccaaccacctcgatcggtaattctgcaagcttctctttcttgcttaccaggaacccagtttggctccaaccgaccctgccccggtgttcccaactattggcatgcgaggtttccctgaaccgactagttacttagccagggtgtcccattccaccttgtggttgcactgtgattatgctcgatgagtttcccataggaatcggtccttatatgcgaatacgggacagcgccacgtagacacggctcccacatcgtgagttttcacaattcattttattttcaaacacaccgacaccacatgtcgggttttcaaggcttcacaaacccatttcccaagt

SEQ ID NO: 49956 - DNA, 244 bp, Oryza sativa
cattttgcatctacttttctgatagtatgagctagtattttttatatttatttcttaccttggagactctaaaaccattaattcatctcagggctccaataggagaggaagtggagggaggaagaaaatttgtcattcgcccgtaagcagagacaaaaacagttatccattattgcatacataacatatgttagtacgactgttcgattagatttttattggaatctaacatgttttctgcagg

SEQ ID NO: 49957 - DNA, 1501 bp, Oryza sativa
gtactcagcaagccaggggaaataagtgtttaatgcaggcttcaaggaaaggctgttgttttcgtaattgattttgtttgaactcttttctaaaaagtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacttttcaaacggccacccgggcctagctgatcccgtcagctgctgatttttcaaacatcgaacccagtttcacaacagcaatttcacaagcagtagtcaaacaaaactacgctaggaatcacctcacatccgcccatgaccgtgggcacggctgttcgagcagtttgttaacctctgtagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgttactcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaacctgccttgcagacgggacaacagattaagtgtgatcctatcaatgcataatatttcgcaagcaatataattaaatttcaaatataggctcaagatgttcaaaggtggcttgccttgctcgagatccggagcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggttgggaagatattgaatttctaagattattggatttttggtctaaaggaaaaaggatttatttaaatcctttttggaaaagaaaaagaaaagaagggagggagggaatatagacttttctcggacggctagggcgcggcccaagagaaa

SEQ ID NO: 49958 - DNA, 1501 bp, Oryza sativa
tatatttaaattctctatttatttcaactgtgcatttattttcgaatgtcactgggtggtgtgaacttattcctttgttattgcctgtttgcatcgattactctattccttgataccttggctattataatttgactagttgagctttatatattggttcagctagatgttagacataattgcttagccatgcttagaaacattagcacacaattgggataactaatgtttcactattacttaatgatggatatttaatgaaagctcacgatggtctatcgtgattggttaattaattaatgtgcctactaaaacttgataatggtgggttgtgagcatatggttttgatggtcgtgctcatgacaattaaggaccagttcacgagtttcggttgtgaaacattaatcgtgccaaccacaagccagaatgagcaacggctggacactttgtatagcaaggctcattgtggagcaccagactgagaagtggcggagataagcccacgggggtcgctagggagtccatgcctctggttttgagggggtgactacgatccaggaacggtgcactgctttgggttgagttatgcaaggggtcttgtcacaactacacaaatggtgacatgttcagcatgggcacatgatgatatggtgacatattgtggagttgtgtcttgtgggtacagtggtacatctctgaccagataaaactattcgaatagccgtgcccgcggttatgggcgggtctaacaatgtctttcatgattagtctcacacttctcaccataataaatgatgctataactggaaataatttgattagctcctggtttggaatggtacattcctggtttggagatagatctgtacagccgggtatggttgttcaggatggttgagcttgtgcagcatggatgtgctgttcagtgattgattaatattgatgattaattactctactgttttactacttttaaatgtttgctatgtgctgcttttgcaaatgagccctatattatgccatcctttggtatccttgtgcacttgcatatttgctgtgtggcttgctgagtatgtcatatgctcaccttgcaataatcaatcaaacctcagttgaagacaagttgcgaaggagaagacgtttggcttataccccagttgagctgcctgtgggagtggagccggagcttcgctagaccgtaattccgctgaagttttcttttcttttgaatgtatgtaacgttattatattgatgaatctgtatattaaattgtcagtttgtgtacctcggctgattcctggacgaggatttaatgcacaaattagttcggaaattattagtgaatttctgggcgtgacaagttggtatcagagccatctcgactgtaggataagccaaatggtcaaacacgggcagtggggaatgctatggggaacgtggacgacaagacggatgtgggcgacggcggccgccgtggaggacgaggatggcggctgcag

SEQ ID NO: 49959 - DNA, 319 bp, Oryza sativa
tttgcatatttgtgccgtggttcgccggcaaccgccgctcccatgccgttcaccggcgtaggtttttccctagggccttaatttaatctaatcttgtttggccctagcgtcgtcgtcatctccgtgtgttgtcgctggcgtcgccgttgcctcttcctcttcggtcttccccggtgaggcctcctttccgttccttaggtttaatctttgtgtagctgcaatcgtgtcttcgtgtagtcgctgttgtgcagccttagcccgtgcgtagccgtgtgtgcctagccaccgcagtcgacccatgcgccatcgctgccctagt

SEQ ID NO: 49960 - DNA, 222 bp, Oryza sativa
ggttgatattaaatcgagtagtgcagttgtgcaatcctaggatccaacaaaattccgtaacaccagaccccgcatagacccatgactccgcacgtatattttgtgaccgttggatctttcgatctaacgtcccatccctgacctccccactcggctctgcctatcacgcttctccctccctgattcctctcggaaaccgcatctcctccccgagtctccagg

SEQ ID NO: 49961 - DNA, 558 bp, Oryza sativa
ctagcaaaagagccagataggataaatcaaaaagggaaaatacatgcatgaagtatactaactccaatcttttagtacttattatttagggtattgatacaaggggttaactggatacataccattacaacttttataattttgtgatatgtcattactattcacctgtatcaagtcataccattacaatttcaccattatttgacatatgcaatacttacccgttgaacttattttctaaattttttttaccaaattaccccttctcctcttcatcccttctctttccactccccttcctcctatctctgtggatctggttctaaatgcatgggcagtggacaaggtgcgtggaggcggaggcgtaaacaagccacggcgtacacggagctggtggtggagacgacacacagactcaaggcaaagtttgtttgcagtgttgggcctcgagctcctagtggttacgcgtgcctgggccgcacgatgttgggaggctcggtgactatgtgtcagggctcaaaaccgggagcagtgctactgcgacgactcaggaggtta

SEQ ID NO: 49962 - DNA, 186 bp, Oryza sativa
tggttgggtaagatggatgataagtttataatcctaaccatcttagcgatcccaatgcgtaaaaggaaatttatcctcacagaaaatatttattttctccttgtttgctaggttagactagctttgggctataaactataaggcaacctccctatcttacctctcctcacctccaccacctgtagg

SEQ ID NO: 49963 - DNA, 869 bp, Oryza sativa
cctaaaactccaacaaaacaaacctagctacctccatcttcttcaactccggtcgtcggcccccgaggaaacccacctccgtcgacttcttcttcaactccggttgccggccctcttcttcttcaactccggccgccaccccccgacacctacatcttcttcttcagctccggctgccatcccctgacatctccatcttcttcttcaacttcggtaagccgtgcctccgcctctccgatggacggcgccatggtgcgacctcaccgctgtcgtcctctgcctcgtccacgaacgcctcccatgcctcgtcgattggcgccgcatggcccgcgtatgccacacctggcgcactgccgtcaagggggagcagagcagaaactgccggagcgctggctcccatggattctcatatcgtcttgccctccgtcgctgccgttgtgtggccaacactggtgaaatagcaagagagaagaaattaaagagagagaaaagaaggaatgtgtggtggagatgtagctgtgtgtgtggataaggacgacgttcgtccgtccggaagcatttttcagataaatatctttacaccaccatgaattgtatgggacaatcgggcgataaattaagatggtgaaaggaaaatactctgtttgcttacagaccaaaccctaatgaccccacaatcgtcccacaccaagctcacaagtcccaaccgtcgcttggcgatcggacggcgtggatccaatccaacgagaccctcccccaacccttgtccgccgcgtctctcgccgtcggtcgcatcgcacccccgcgaatccccccccacaggccaacagcaaagcagaggcgaagggaagaagaagaagaagaagcgg

SEQ ID NO: 49964 - DNA, 251 bp, Oryza sativa
ttgagaaggactaaaatataaaaaacaatcttacgttggagtaaaatcaaaaagtgcaaagccacctgatatttccggaagggtcacgactcttggtcttctataatcttgattcactcttcatcttctataatcgttcctcttttctcttgtcattgtttcacattcattctccatcttgtctgatccaccgggagaaagaggtagcgacctccggccggtacctctgcggcaagcatgtcctgcacaga

SEQ ID NO: 49965 - DNA, 293 bp, Oryza sativa
caaaaggtgagccatatgaaccaacatcatctattcccatgaatttcaaagaaagtatgaatttttaattaacattggaaaatgtaatgaaatattttttttatttttttgcaacgcgtgagcatttagctaatagtagtagtatagatacagagtattcaaaactaatctcaaaagaaaatcaagttcaatgtggcatttcgttcattgttctgcgagctttacagccaggccatggaactgcctgccatttccgtggaatctggccatctgggcctatctatgtgggctga

SEQ ID NO: 49966 - DNA, 251 bp, Oryza sativa
atcaaaattgaaagtttggttgaaattggaacgatgtgacggaaaagttgtaaatttatgtgtgtaagaaagttttgatgtgatggaaaagttgaaagtttgaataaaaagtttggaactaatcaagggcctaatgtcgctgtcagatgagactcgaagtcagtcaatgccatagcgcgtttttcttctaatgtcactctcggatgagactcgaggtcagtcaacgccatagcgtttttctcctaacgtca

SEQ ID NO: 49967 - DNA, 1501 bp, Oryza sativa
gcaaaggaaagaaagaactggagagctctcttgcactgttcaagcaaggagagagaaagaaaggatctttcatccttgtgttgacgtgtagaatcaaatgtccttgcttgctgtttattttctagcatatacaccataggtcatagccaacgccacgaagtgcacgctgcgccaactgatgcttgattgtagtggttagcctagcaacgctggaaggcgaagagttcgaccactcctggaacgctgcttccctcaagcgtttctatgtctaaacgggtggcacccaaatcgccaacttataaaaatgtacatatttgctatgtaagcctttcggcactatgtaagcccttcgagaagaagatgggagaaagaaagaagaagacggaaaaggaaggagatgaatgttaaacatgacggcaatggcacgattctaattttgtaaaattacaatgacacggctacgaatagatgaattgtaatggtaattttgtaaataggcaaatttgcaattacatttctcaaaatcaaagcgcttttgtccgcaaaagggcaattcacgacaacttcctttatgtgcaaaacatggtaaagctgctccacaggacaaaaaaacaaagcctgttcatcaagatagacattgcgaaggctttgacaccgtgaattggtcctacctcctagagattcttcgacaatttggttttggaaaccgatggttaaattggatcactaatcttttctccacctcctcatcccaggtgctcttaaatgggtccccggggcaaaaaatcaaccatgctaggggcctacgacaaggtgatccactatccccaatgcttttcatcctggctatgaagccttttcatcgaatcctaaaagaagcagaaaatgtcaatgtccttgctccccttggggtaagaaatgggagattcaggtgctcgctatatgctgacgatgttgcggtttttgcaaacccgaaacaagaagagttgacagctctttctcatatactggcatgctttgcacaagcttctgggctacacacaaatatcaacaaaactgaaatctaccccatcagatgcgaaggcatcgatctgcaaaatcttcttgctggatggccgggccaaacaaaatatttcccctgcaaatatcttggactacctcttcatttcagaaaactaaggaaaattgacttccttcctttaatagacaagattgggtctaggctaccaggttggaaagggcgttttttcacttctgcgggacgtcaagccctagtatcatctgttctaagtgctatgccaactcatcatcttactgtcctacaagctccaaagtgggttttcaaaagaatcgatcgtttcagaagatctttcctatggaagggtgaagatcccgaccattcaaacccgggagatagtctgatcaactggtaaaccgtctgtaaaccaaaggccttgggaggtgctggtgtcctggaactagagcgtttttccagggcatt

SEQ ID NO: 49968 - DNA, 707 bp, Oryza sativa
ggaaggggaagggtttccagtagttgagaccagctgcaaatatatccattatttatatcagtatctcccaaattttaacttgcaatgatgcagtagagtttttttttttttcgaacgcacaaaagctttgcatgtcgcaatcagagttattgttatctacgcgtggtttcatacaatctacctctttcgccaatactaataaattgtgtgcgtgttaaaaagttcattgtacagtggtggtggaatttgggaagaaaccatcagaaaaatcactacaacataaacagagcaggatatttgtgtacacggtacactacaccaatcagattacttgagcaatcagcttgcaataacccggggctataagaaaggaaattgacaatgagaaactgccatcgttggcatttggcagtaagctaaccggatgcccggatgtcaataaattgacagttatttgttgacagttgggaaaaaaaagtgcattggcgctattgttcatctacgcatccggtaagcacatcaatcacaacgagaggatcgatcgcgacgagagagagaggatggacggcggcggaattggggaggagagggtgggcgtacctggctccgttgtccccgaggccgtggagccagacgatggtggccttgtgcgcgcccttgggcctcacgacatgcgtccgcccgtactcgagcctcttcccacctgc

SEQ ID NO: 49969 - DNA, 284 bp, Oryza sativa
tcttgagcattgctttcagcccaccaacagctccaccacaaacccgactacagcttgacaggtcttgttgctacagcaccgatacacctcgttccacggttgctaacttgtgggttgctgtccccctcctgtgggcaaggtaagaactggtaagagcttgtgagacaagctgcgagtgaagtgagagtgagcgtcttgcaaaagctacatcccaatagttgtgtagggcttacattacatcctccattgttttgttgtccttcatttctaaaccatggcaggtc

SEQ ID NO: 49970 - DNA, 535 bp, Oryza sativa
tgcatttttaagtcgcgcacaaaccgaaagttgcccttccttttgtaataataataataataataataataataataataataataataataataataataaaatcaaaaacatactaggaacaaacaaaacaaaacctgaatttatctaactaatctcgcatctacgtctcggtcttctccgaacgacgtgcataaacacaatcagaacccccagatttacatttactaaaccttcgatcgagaacccaccccacgtcgtctcccgcactaattatatatttttttaattttatctccacggtaaaatcaagagatatatttaactagttacaattaaaaatttatcaccggacgcacacgtcataggccgtgtttagttccttttcaattttcaatttttttaagatatacggatacacatttgaagtattaaacgtagattaataacaaaacaaatcacagattccgcctgtaaactgcaagacgaatctattaagtctaattaatctatcattagcaaatatttactgtag

SEQ ID NO: 49971 - DNA, 1501 bp, Oryza sativa
tagataggtggcgacatcacaggttagtcaaaaaaaaaaaaaaaactgcatctgacaacgttatttaggctgtgttcgtttgtgtgagatagggtgagaaaacacgttttccgcgcacactccccaaactactaaacgatgcgtttttttaaaaattttctatagtaaaatatatgcgctaatggcttatctcattttgcgtatcttcccaatcttctcaatcccctatctctcaaactcacccttagttcctgctattaaggagtcaagatctgccgcggagagaggcacggctaactcactatttttgtattccatttcatgcatgcagagcgagagagagagagagagagagccacagccaatttcataggatagctctctgttcttgcattggttttgcttccctctgcgccttgggtgataacaaggatctctttctattgccctgtgattctttctttcatcgtcgtttgatattccccacaccactcttttctctctgttcttttctgtttgggtttgatcgcttgctcgttgagaacctctgcacgattcccgtgtcacaagcaggtaatttgtaatccctcctgtcttctcttgttaattcgaacctatataatctgaataaatcaagttacgttcaatttcgaagatgatacttcatggttactttgatatgcggtgtcatttcaattgattggtggtgttgagtgtatggtattttcttaattggtatggggattgaccattgatgatagtgacaatgatttacatgctgtcatgttacagtaatagcaataatggtttaaattagccatgcataatcacattgagtttagttttagtcccacccctctccagattctctattcatctccctgtatattctgtttgtacaatgtcctctcttccatacttttgggaagtgattttttaaattcaattcttgcgtttctctatgaaattctcctgttgcatccattttcgttgccaattagttgcagcgccatgatggagatctttccaaaatttcctggggcaatgttaaggtgccaagctccttactgccaaatgccaaggaagggaggatgcacgaaattagtgctgatccgtatctatttctgtaatgtggactgtacatattatgtactcatatttaggatttcatatgacaagaatatcaccatctgtaggacgacctccatactagtttagtgactgtatagtgatcttcatgcttgtttagttcaaagtaatgctgaactcaacatgatctgtctgcgtgatgagcatgacaatgttaaccttaaaaaaaaaagcatgacaatgttgttaaaagaaggaagtaacaaataggctcttctgctggcctgaccgttgctttattttgtctgaacatgctacacattataattgatagtacttatcatatgacctttaatttccaacctctactgaactttattacctatgttgctttcattttacagttgaatca

SEQ ID NO: 49972 - DNA, 1501 bp, Oryza sativa
acactggcacttgctcttggtctttgcaatgcacatttgatcgtggagcaatgatagtattgtccataacttgtttacttcacaataatatcttgttcccactgcccagtatagttcaaatgtagtgttgatttatggttgtttcacatgccaagatgtagcaaaattcagtcaagtgacatctttgactaattgaatggcttctatcccctctctccccctctttttgctggaattctatctacttgtttgaatactgaatattttgttgttaatgtgggaggatatttcggacctatatttatttgctttgttaggcagaatcacataagttcaaatctgtattcagatatctttcattgtaagcatccacggaatgtgcattggttcagcgtcatcataatctcttatctagcttatgttgcaggcattctcagagggacttctctacttccgagcagctgatttacactgggcggacaatttttttttgtagcggtatccacggaaaggaaacccatgacaggaagccagcaaacttgtatcatagcgctgactggcattctctgatcccctttttgcatctattgtagcttgaacacggtgatacactattagctgctgttttccttctcttggttgaaataagtgctgcaccatgtgagtaccacagcctggaaattttgtaagaaaaaaaagaaatattattttggtagtacaactcagcctaatctgaattttacatcatatctgtgctagcatttcctaatatgttgaaattttgcagcaaaagatgcatatttctttttgagttattttctgtctgtatgatgatatgcccgtttgctggaagttactggcgattaggggtgcgagtccaccagcttgtgccgtcccctctctactcgatggtgcgattaggggtgcgattatgcctgttttctttttgattgataagaatcggatggaggttgtggacgcgcaaggtgaacacgaagcaaaatcaaatgactcaagcatacggtggcggatgatgcaaacatgtttcattttttaactaaataaagtagagatagagatgcagatttagggggcttttaactatttgccactcttacgagtggtgcttaacgatttgccactagacctacatgtcatagacacatgagggcccacatgtcataaacacggtgtggcaaatcgttaattgccatgtcacaagagtggcaaatagttaaatttcctcagatttagagcaagtacaatagctgattataacttagctataaacatatatcgagaagataaaagaatagagagaagagcaacgggctacatatttatagccatctgcagcacgaactgcaagacgcaatgtgtgtatgacaggtgagaccagatatcaatagtgtagtatatgtttatacgtaactattggctattaaattgactataaatgatttggagctagtatttggctacactattaaacttgctctta

SEQ ID NO: 49973 - DNA, 1501 bp, Oryza sativa
tcgatggcagcgaaggctcgtgcaaggtcgccggactttgcacggcaattctggcctgtgctgtgccatgccttcagcgaatgcagcctgatcataatgctctttgtgaccgccgtggtgtcattcacggccacaaggtttgcacgcatctggagcctacgaccaccgtgcatcctgtgctcaaggttggatcgcctcctgcatggaaacacctggttctctgaagatctgatctgtgctgcacacaagttggaaatctcgcaattggagtattgccagagtcacaacaagctcgcacactctgatgatctgtgtgaaaggtgcctactttcatgtgctggtttggatggtaagcccaataaactgaagagcatgagaaataaggacaaggtgaattctcaaccgaggtccaggcatacacatttatgctcttgttgttcagagacgtttaagaagacacggcatacacacaagctacctgagcttgcaaatggcatagttccagatgatgtgagcacagtgaaggagagaagcatagacatgactagtgtagggcattcttcagatgaaggttctgaggacttgtcttatggaggctacagtaagctgaatgtccgccatgattcagagtctgagaaccgcatctcggatgatgatgaagatgaagatggtaattcaatgattcacaaagctacgcagagaagcagagacttcttatttcatgattcgcaactacaacctatgatcagtgacaccaacagcttgtccatgcatccttctgagaatgttgttcttgcagagccgatgaataccgctcctgtgccagtgagtactgcagcaaaaactgacaatgtggccactggcaccaaccttgttagtgcagcgaaatcttcagagcatattgcgcaaggttcaagggaaattagcttgagcaatgtcaatgtaagtggaaacaatcatgacgtgcaaccgaagattgtgcctgaacaagtttgcgcagagcttccgaaagagaaaagtatgtatctttatccaaaatgctgcaatccttatataatttgaatttatctgagtatgtcaaatttgttctgtagcttttctggttggtattgaggaagttgacgattcagcgggtatttcaggaagccctgacgaggaagttgctaagggttttgttgcttctgcaaatgcaggaatgagttcagttttagatgcctgtatcaaccgcaaaaacagtatgaagagtgcttctcgtcgtagaagcaaccttcaatctcctcgatggtctgaaataatctctgctaaggataacagttcaagaactaaccaagaagtcaagacattcctgtcccagatgtcttctgcgcgaggctttgatggtccttggagtgaggtggccgctagtcctagaatcacacagattgatgataaacaatatgatgccactgggagcagacaatttcttgagactaactactcaaatatggaaccatttgatgtc

SEQ ID NO: 49974 - DNA, 1501 bp, Oryza sativa
tggcacatatgatagtctacagaacatgtcagtattgcatccggaacactggagcggtgagccggtttcttctcaacaaattgatgaaaatcaaagtgttgattccggctcatgttctcacctagatgatggcagaatcagttctatgacgagcgttaaacatgagatttcacttctaaatactagattcacggcacttgaaacagatcaaaagtttctcaaacagatattaagctctctaaaatgtagtgatgatggcgtacaatgtgttcaagagataactgcacatttgagagagttgcgaagaatcatgactgagcaaagagagagggcagttttatgatctcataattaatctctgaaggtaacaatagaccatagtagtagttaatatgaacattgcttccatgatgtacatgcaataggttactcttatactccctccgtcccacaaaaagctaacctattattgaataggtttttcctggtacaaactcctgtctagattcgttaggaaacatttcattgaatactaggttggttttttatgggatggagggagtatattgcaaatatctgctttgaactgtgccatcagagtttttattgacgatcctctactttcgtcaaaattccttagaatgcatggttaactaaaaggacactaaagtgtcttttgaatctgcattttcagcgctagctactctatcaacttcattgacttagtattatttaatcttcatatttccccttcttttagagaaatacttttccttgtatgcatagaatcacgctagttatgaaatgttaggccttgttctttgttcacttatatcaccttttgtaatcaagagatcctgattcggtctcttttgcagatctgaagttgctgccactgattgttacagcaccatgatgccttcatggtggcatctcgctcggagatttgacagggtcatttgtgacctgatctccctgaacataacatgggagaacacagattatatacacaccgatcttgttggatgagatctttcttgtacaaattgaaacggttgttattaggatttaggagtaaagctcttcgctgtaattatagtttccggcttctgccgagatgaggaaggaattcacttagtaagccagctactgttcatgtcagataagttcataccgtcttgaatttatccaaccacttctggagacaatctataggctatagcctagatgaacttgaaaatttttaaagtctagcggttgcaggagtgctggtcacaggttacctctgatgctcggagactcggacgtgtacagacacttgccattgatcagcacaattttgcagtaacgagcaagggttcaaaactacacacgaaagtaaaccttgcaaagtgttgtcttggctacagtcaacatcggcaaaattttccgttatcataataaactcgttgatacttcagaacaaaaacaagtttggttcaagaaccagaacagatggctc

SEQ ID NO: 49975 - DNA, 1501 bp, Oryza sativa
tcttcgtaaccatgattgatccctttgagcccatttttatgacaacccactttgtgcgaatccccctcttcagcaactcttgccctgcctggattgggtttctgatgttcgtcagggactcagcctgtcaaaccaataaacagatttatgagtgaaatgaagcaagaatacaacactaaatacaccacattgggttcactgttctctaaacaggccagattcagcaaacaggttttttttacaaaagcatattagtgttaggctgtaccctttaatcttattttggcataaatggtttatggttgaattgttaagtttggagaaaaggcaaagctgcagatgtgaagtcaagatcagccagctcaaatatcattataaaaaaacatgccatttatggttcgcttggcttttactaattacaattgaagctcacaaagcaaaaataaaactgtaaggcatctaacctcgtctgatgttaaaagcagaacatcactgagcctcagagaatgctcaagtgccctctgttcatcaagggtaccatgtaagagagattttcctcgaggaccaggatcaaaaaatactgctgttcccgcatcaattgcgcaatcaatagcggacgagatcacatcagggaaaagttcatcaaaagcatagccattacagaacaatattttggagtgatgaatagctgtcttggtttcagctgggagtttacgtatccaactgaaagctggctcatcactaaagtctgctcggctggcgtagatgaaaattgcaatgcaaagcacaacaagaatattagctcatgagaatttgaagctgaagttgacaatattcatgatgaaaataataagagcagtaaggcatgcatgagaacatgaagttctaacctgcaaaatccatgtctctgaaatgggtctacaagaacccagcaaagaagggtctcataggcatttcggcatgcaccagaatcagagttatcaagcatcccaacaacactaatgccctcctcctcaagcacatcaagaagaaacttcccataaatttcctctcctacatgccccagtgtggaacagcgaagcccaagcctagctgcagcaaaggccaagttgcagtttccaccagcctcccaaaatttctgttccaagtgacgaaagataaaatgttcagaatagctaataaccactgattgattgatcataatgttgttcaatttataactgggtttcttttctgggttctccatcttcccaagcagataaagtgcagcagaataagtaatactaaataactaaattgtcataaaaacattctcattttcaacacaaacagaacaaatgcaaacattcatgagatgtgtacatctaaaaccttccgttactcatcgaaagcctccacatttcttccaatccccaaatttatcagtagatacaattacgatacgctcgcttgaatccttcctatcacaacacaagcattttgaaccaaaccaaagtgacta

SEQ ID NO: 49976 - DNA, 1501 bp, Oryza sativa
ctaaggttgtgaatctttcctcctaatacgtgaaacggagaggcacatgattaattaagtattagtcttaaaaattgaaatgaattaatataatttttcaaaataactttttatagattttttttaaaaaagacacaccgtttaacaatttaggaagcgtacgagtagaaaatgagtgaatgaaacttgggaaagtgttaaaaaaacacagccttaagaaaaaaaaatgttactgtgcaaaactggagctcaaaaaagaataagaaaacatcgagggccccttacgctgaaaatggaaagatcgaggttttcagcggtgagctaaacatattattgcacaagtgtgccttgccagtttcagagggaactactagtaaattggtcaagtcccagccgtttgcgaatcgaggaattcatcggccgatcgatcgaaacgaatgtgtcaattcaagatttcaaggctagctagctgcacggtcgactgtcggagtcaagatcgagttgcacatacatggactaatcagatagtcatacgcacgcagtcagtaaagcttggtcattattattgttgacacatatgagtatgaacatatatacgaggtttaatttctacatggcacatgtatatatgcggctttcatatatacatccatctgtacaatgaggatatgcatggaccgcgctgaaaatcgcatactaattagctattagtcatgagctcttttctcatctttaataaggtactatgaggtgtaatgaggtaccaggtactataaggtaacaatcaaatctagccattgattttgcaggggtacgatcggaaagaaattggtaagagactaattgggccttccggtcggcgccgcccaagcagccaatagcgaggcaatctgacaagggcgactcatccgcaaaattcgatttctctccgccagttccgccgccgtcgcccatgcgtggtgggaagtaattcctgcgccctcccccgccggcagagcagcggtggaggccgccgctggtagagctacggtggaggccgccgccgaccacacccgcccaatagccgccggcagagcagcgcaggaggccgcctgcttccatagccgcccaccgccgcaggcagagcagcgcaggaggccgccgccgagcaccggcgaccaccgcagacgaccgccgcccaccgccccaggcagagaagcgcaatcccctaccgctgcccaccgccgtccaccaccgcctttcttcgatccgtcgccacgccctcgcctgtgtcgccgtaagtccctgacccgactcgcattatagcatttagcccgcaccagtcgtatatcgatgagaagatttttttagttttgttttagcaattaggccgatacagtatgaacgtgcataattatttttattcttgatatgtgtttgacaggttgttcttgatataaaaaatgattggtgatggttcaagatttgaggatcaggatgagtattgtaagtttatggctat

SEQ ID NO: 49977 - DNA, 1501 bp, Oryza sativa; identical to SEQ ID NO: 49825

SEQ ID NO: 49978 - DNA, 1501 bp, Oryza sativa
gtgtacgaaggtagtacgtagctgaacagagccgaccaaatcgcgttcgatcgatcgatgggcgataccgagccgtgcgtatgtacacaactcgtatatcattcttttcttgaaacccacgcaatcgtatcatgaaaacgtctacacaactcgtcgtatactcgtatgtgtgtaagtaacggtccggtctttcggcgaggcgtatagtacgtgcgtgtgcgtgtgtatgtacgagcttactagtagtagctactgatcgatcgagttaagttgcttgtttcagagggaactaattaattaactggtcgaacccggccgttacgatcgaggaagattcactggtcggtcggtccaaacgaatgtgtcaattcaagggcatggacgctcgatcgatcggggtcaaggtcgagttacacacggattaatcagaacgtccgtacggtcctacataggcacatgactagtacttcgtatgttttaactttgatcaaaattaaactgctttaactctgatcaagtttgtagagaaaagtagtagtaacatttttaacttaagacaaatttattatgaaatatattcaattattgattcgatgcaactaatttagtattataaatattactatatttatctagaaactcagttaaacttaaaataatttgactttgaccaaagtcaaaatatcttataacttgaaacggaaggagtatcatacacacactacctctatctcaaaataaatgcaaccgtggagattcatgtccaacggttgactatctgtcttatttaaaaaatttagtcacacataaagtaatattcatattttatcacctaataaaaataaaagtactaatcataaactttttttttcagataagacgaacagtcaaacgttgaatataaataatgtaaaactacattaattttgggacggaggggctactaggtctttgtaggagtgtaactgtatatacatgactgattaactttgccttaggagctgtttggttcgttgccatattttgtcacgccacactttagtcataccatagttttttaggcatgtgtttggttcgctgccgcaattatgttatgccacactttgggacccacgtgtcatgctctcaaatttagagctaagcatgccacacttgtggccaactatttctaagccatatttgtgccactatgccacaactagcctaaacttagttatggcaaagttaggcatcaaccaaacatccccttagcttccatagtaatactcacgcgtagcagcactacaactgctgctgcacgtcttcttgaacctaactagctattcgtgttcaaccttggacatggactgcgctgaaaaccgcgtacagtggcatgttatgttgttaattaattagtagtactactggtaaactcgtacgattagacccgttcatctgttaagatttttactagtacatgcagttcaacgtgtggtcaagtcacgaacatatatgaactgta

SEQ ID NO: 49979 - DNA, 1501 bp, Oryza sativa
catgatttgctacagtgattctatagtaatcagccgttaattatggattagttaatagcccggagccgctaattatggattagttaatagccggagtatccaaacaggcctatatttactccctccctctccctcgtagaaaccgttcacccactttcccctccatctccactttttacggatcggcagcgacgatgaaggcctgcgggtgcgacaggcggttgagcggcgattgcaggtcggcggcgggcggtcgccggcttgggcctcctcggtgtgccgggcggcaggcggcggggtccctccagcttcctccaacgacgggcgacggcgacggcctgcgccagcagcgagcgacgacgatggcctgcgccaacggcgggcgacgggctcggcggggctgtccctcgcccgatccggcgacggcggtcgtcctccgcctggatccagcggcgggggtttgaggtagagctggcttcgacgccgccgagatgaccctccccgtccacatcggcgtcccccttgtgccgccacctcccccgtccacgcagcgccgccaccatcgccccctactcccgtcgctgtccaccccttttttttaggatcggcgaatggcgggcgagatccgggctggttgtcggcgttggaggtgtggcggcgcgtcgtccagttgtgagttggcaataggacggtggccgccatccaaccatcaggcgccacccttgcccccttcctgtcctcatcgccggatgtgacgaggacctcggcagtgccgacgcggaggtctgcctcaacagatcgagcggcggcatcgacctcgacggcaacgtggattgggctacatcctcggcggcggatcgagcgcacatcaatgcagctcctctctaagcgatagcggcaacaactggatcaggaggcctctccatcgtccgcccggccgtccaccttcggcatcagcttcgtcgaacaggaggcggcagcctaggcggcggcgcggcaggggggcgaccacctcatcgcgtgcctgtgatcccccgccgccggatccaggcgtcgccgccggcatggtcgaggcagcgaggcgttcttggtatcgatggtggtggactagatcttaatcatgtggtcagcttgcacctccttccttcctcagatctgaactaatggccgcctgggaggttctcgttttattgatgcagcgccatgtcggttcttggtggatgccgaatccttcaagatactccttccccgttccatgttcaccgaggacaaggtcaccttgctcaagccctttttcctcattttgataacgcttgttggtgctgtgtagttgcttgtgtgcaggttctagacaaacaacaccatgagcgattccattcgcccagcatcacctccagcttcgatatgttctgctccctttctcctgttcttctttcttttctacacttctttcacgcccatggttttcgcagtgatcaaaaccatggttgcatgatcaggt

SEQ ID NO: 49980 - DNA, 1501 bp, Oryza sativa
gtaaatacccgtgtaaaaaaaaggagagataccattcttaagaaatagtatatacttctacaagataaagaagcatataccattccctagcaaaggacgtgatattcaaaaagtaagtacatactagtactagtactactttctgaagaagaaaaataagtatatggtataatcattttgaaccagagaagcgtgcgctccaccgcctccacgtgtttagatcgatcagttacgtgcatttaaaatttgaaacacatgcactccgtcagatgtgtactaaaacaaaactaaaacaaaaaacaaggaaaatacattctttaaaaaaatctgactcaccgtggccctatcagatgctaatggataatcggggggagtatatacacctctatatactctctctctctctctcttctctctctatatatatatacatacacatacatactaaactcacatagacttaggttgtgtaatagctaaaatgctccccctcacacccacccccatacaccccaccccccctcccgtgcacccatccccccgcatcccctcctcccacgcttaacggagtaaattttttactatcaactctatctgctaactatggccatgtttggtttcggagggctattaaatagcgctccggaatcttgctatttaagagtattaaacataattactgataaaacctattccataacttctaggctattttatgagacgaatctaacgaggtatattaatccatgatttgctacagtgattctatagtaatcagccgttaattatggattagttaatagcccggagccgctaattatggattagttaatagccggagtatccaaacaggcctatatttactccctccctctccctcgtagaaaccgttcacccactttcccctccatctccactttttacggatcggcagcgacgatgaaggcctgcgggtgcgacaggcggttgagcggcgattgcaggtcggcggcgggcggtcgccggcttgggcctcctcggtgtgccgggcggcaggcggcggggtccctccagcttcctccaacgacgggcgacggcgacggcctgcgccagcagcgagcgacgacgatggcctgcgccaacggcgggcgacgggctcggcggggctgtccctcgcccgatccggcgacggcggtcgtcctccgcctggatccagcggcgggggtttgaggtagagctggcttcgacgccgccgagatgaccctccccgtccacatcggcgtcccccttgtgccgccacctcccccgtccacgcagcgccgccaccatcgccccctactcccgtcgctgtccaccccttttttttaggatcggcgaatggcgggcgagatccgggctggttgtcggcgttggaggtgtggcggcgcgtcgtccagttgtgagttggcaataggacggtggccgccatccaaccatcaggcgccacccttgcccccttcctgtcctcatcgccggatgtgac

SEQ ID NO: 49981 - DNA, 171 bp, Oryza sativa
aataatatgaaggaaagtggattacctctcacggcggtggattgacatagatccacccatgatagcatcaaagacaaggaaggtggcgacgaccggtagagatagatggcggcggataatcaactaaaggattaggttagatctgtgttcctctccgtttcaattggtagc

SEQ ID NO: 49982 - DNA, 332 bp, Oryza sativa
cggtaatgtggcaccgacgcatgagttatacttgatactgcagtgtcaaagggtgtatgatttcagcctcgaggtcacatgttcaatcactagcaaactcttaattttcccttaaaaatatatttggagggatgtctctcactccaaatctcggtttttttatgtggcaccgacgcaccgtgcgggctattgattttgggctagaatgagtttgtgggatagtgtgggccatattgtttgggccgaaaagggaatgaagctcacgtgtggcccattctattttttttccgtgcggcccaccaaagaacgggccgttcctgcaaccggggatt

SEQ ID NO: 49983 - DNA, 537 bp, Oryza sativa
cacattattattccaaactcagtaggtgcagttggctagttgttaattaatttctgcatcaagattatatatatttcagctcccagtcagtttagcagattatatatattccagctcccagtcagtttagcacaactaacaattgatgttcatataataccacaacattgcaattaccgctaccatgactcgtggatacattctttaatttggagatatgaattgaaatcggtcgaaatgatatataacgtgtaatcgtctatactcctttaaaagataccagtggtaataacagtgaatatgttactaccacagtgccaccccaccactccttaagcagtttttataaatcatctcttggtattttctgatattatggaatagtccatttgattcaaatgagtgaataccatatattttaataaaaaaacaagtaaaaaaatatattttgtgtaaaacatatcataatatattttcttttacacctagcaaaacacgagcatttttactagtacgcataaaaatatgaatgtgtgg

SEQ ID NO: 49984 - DNA, 414 bp, Oryza sativa
tgctgatattttcaccaaacaattggattcttctcgctttgcttttcttgagagttcggaatattcctccttttagcatgatttgagggggagttttgtactcttgattttatcgagcaacatttgacaattaaaaaaattgagaaaagagagctttgtttaatacatatggtatattcttgtgcatgctagcaatactatgaaagtttctttatctctaacatagcttgtatgtattctagtccttttatgaggcttaatattgcttttaatggagatgatacatgacacttcaaattatgtacttgaattaagcaaatgcagtattgatgctagcgcatggtttgattgataaatgcttatgtatatgatttattgaattgttattcctcaaatagctttttaattgctcat

SEQ ID NO: 49985 - DNA, 1501 bp, Oryza sativa
aaacccgacgaaacagggtcgaactcggacctgccggtcagaccggccacataccgtcggtctgaccggcctacaatcggcggtctgaccgcccaacacatggcggtcagaccggcccactcggaggaaaccggtagatttccaaattttggtaatctttcctattttaatcctaggtgccaaatttgggtgtaaacacatgcccccctacctttttggtgaacaacgtgaatctaaaagcatagagcatgtttttggccttaggacgataatccaattaccggccatagtacctcctaagcatcttgccaaacactcgggaagtatttcttcaagtatttcccgttgattgctcgctgaaaacgctccccttaaagtgtctccaaaaagtatgcgttcccccgaacaatgccgcatattcgataaggaccttcccaactaggagatcacttaccgaactccttggatcgagtacccaaaggcaaaattgtcttccaaaccaagtctccaacttgaaacaattttgctttcaccctcttgttgtatgccttggccaccctcttcttctctttctctatctcttccaatgccttcaagcgcttgtcgacgacttcatcaaggttgtctcccatcaacgtcttgtaatcttcacttgacaaatcatcttgcttgatataacgaagagaaccaagatttacctctaccggtaaaatggcttcttgaccataaaccaactcaaaaggagtgactttagtggcaccatgtttagatatcctatgcgcccacaatgcttcggaaagcacctcatgccacctctttgggtgctcctcaatcttctttttcactagttttagcaatgtcttattactcgactcggcttgaccattagcctgagcgtagtaaggagaagaactcaacaatttaataccataagattcggtaaaactattcacttctttagacataaaagaagcaccttggtccgtagtcaatgtttgccgaacaccgaatctatgaataatatgcttcaaaataaaatcaattacctccgtatgagtcatattcctcgaaggcacggcttcggcccacttggtgaagtagtccgtagcaactagcacgaacctatgcccctttgatgacgaaggataaatttgaccaatgaaatccaaagcccatccccggaacggccatggtttgattatagggttcaacacggcggcgggtgccaattgaacattgccgaaccattgacaagcctcacatcccctataatatttgaagcaatcatcaatcatcctcggctaatagaatcccgctcttctaagcaaccaattcatcttatgggccgattgatgagttccacaaattccttcatgcacttctccaatagccactttagattgatcttcatccaagcacttcaacaagacaccgtctacgtttcggcgatataaatcttcatcaagcaatgtatatttgaatgcttgccgccgaatttttc

SEQ ID NO: 49986 - DNA, 221 bp, Oryza sativa
aaatgtaaatatgaatattacagggactcaaacgcaaagtgcaaaactaaaattggatcatctcaaaaatggattgctcatatcatgtaggttccgtttttataaaaatatctcaaatccgctgcataacaattctatagagagaataatacggatagtcacgaatagatctgatctggagtctctcttcacgcgcacagtactcctctcatgcgcacagt

SEQ ID NO: 49987 - DNA, 1501 bp, Oryza sativa
ggcctacatccgtttgacagaggaggataccacgtcgtcttcaagaattttcataaaaatactgttccatgagttatcagatcaccttggaattcgccaactcaataagagactgagcgatcctaaaatgaaagattattttgattcaatctttctaatggatcatccgaagaacacaagattctggatcaatttcttcacctccatcggtcttggtggtatcactgagacgctgagagagtaccaatgcctgcaatgcaacaacagaagtcagaatcaagttctgatgagagtggcagaaacccaagtaagagaaggaagatgtaaagagacggatggaagaagagctccatgaaaattcaactgtgcttatgggggatgcaactgtcgtcacaatcggcatcgtcagatttgttcagtgcgattgttttgttggatcaatcttcctctatctgtatccatgtgtaatatcagatgatgtttgttgcttatcgaattcaggaaaccagccatagcagatgttttctgcagtgcaagttttgtgccttcataaacggtttattattgtttataggtttgacaacagtgatgaagaaataattttaaggataaaatgctataacaggcagcagctaagcaggattaaaaatgatgtaccttttttatgtgaaatatgatttacctttttgtagatgaaatattatgatatacattggaaacacacgtaggtttcacttaaggtataaacttttgcaccctcttgttatatttctcgtctacatagataagtggtggaaatgaatggtaagaaaattaaatccagcaggaaaataacatcaaacatgtgtacaaaataacagacaagatttcacagaattcaactttggttgatctagaatcccctttcaggccactcagttgctgctccctgtcagacatggcatcatatgtggcaagtcatggtaaaagcgtggaaacccatctacagccgttgtgcttggcgtctgaccaggaacagccacagaaaatatgccccaatttgcaagcacaaatcacaccgtcttcagtagggcagactatcagtagctcctgctgactttcacactggaaatgagcagcagatcacccacatctgagttcttacaataccaggcgtgaggtcgaaatgcaagcaaaaacttgttgcttttgttgactagtaagatttcattgccgtatgaccgggtgcaggggaattccatgaagaggacgcaaatatcacattcaaatcaactggaccagacacttcatcatgactcgaatgacagagataacataatactactgccaaaaagaaaaaaggaaaagaggatcagtattttcttctaacagtagtcactatataacatgatccgaagtgtcattcatgagcaaatatatatttttgcatattacatttgcatccattcattcacacagaaaaagaagaaaaacagaatggctgagcccaggtttcctcctc

SEQ ID NO: 49988 - DNA, 1501 bp, Oryza sativa
tatatatatatatatatatatatatatatatagtaaagcttctttaaaaactattaatctattttcaagttttttaatataataattatttaattaattatgtgctaatatatcactctattttagatgcacaagaagtttccaaaaattctacaagagcatacggtatggggaatccaggtccaacaattgttttctcctctcgcctccctctagctcttgtgtacgttgtgtgttgtcattgtgtgtctgtcttacggacagtggtactcaagagagcatctagtactctcgtgtcgttgtgttggtatgtggtcttcctcctcgtgtctgtcgctctgctctcccctcttcctattctatgatatggcatggctctattattgattgctctacggatggcatggatggaggttggtctcttcttcttcttcttcttcttcctctttcctctcccgcgtgcccgacccgaacaagggaagaagagaagaggagagtagtggcaaactaggctagtactcctgctgctcgccttgttgtttgcgttattgtttgtttgcgtgcggcggcaaggcaacgcgaaaaaagatttgtttttttctattaatattattttggagggccaggggcggttctcgtctcttgtttgcttgcagtgcgggggaagaaggagatgaagcccctggccagggttccccgcctctctctctcttctccaactagttaagctaagctaatgtccatttccatctccatgtccttgcttcttttctttggaatcgctgccttacgctcaccgagaagcaacttgcattttcagcaagcaaccatttctttcatataagcaaaccccaatccaatccaatcccaaccccaaccacctctgctctgcttcctttccctccctgttactactgcattttgccattaatcttctctctccctttccacctcctgcaacctcttcatttctttgctgctgctgcttcaggtgagctgagtcgtcctttcctcccctcatgccaaaatttctagaggcttcagcttaatcgtcacatctttttcttacacaagttttattatgagatcaccaccacctcttcttgcctcaccacctgctggtttctcttttttttttcgaataagagggcaggagggctgcctctttttcattaataaagaaggagctggtttctcatttttaccctgcctttttttttccttctcttttggctcgattcagtttatcctctgctggtttaagagaaatatattttctccttgttggaatgggccatctttttgtacatgtgtagttgctctcctctaatccctaacccttgaggggcacacatcttctctctttcttttgggtgtcctgttgctaatctctcctgtccttgtgcaggaagttgatgaaaggggccaaaagtttgagagattgaggcggtgaagaaaccacaaaaacaggaatcccaaagtgacccaaggcaggaaaaaa

SEQ ID NO: 49989 - DNA, 190 bp, Oryza sativa
aaaaactttgatctggaaggaagggagagagaaaccgaaacgagtcaaacagaagaaacaaacagacacgtaaggaggagaaatttcccctcccttccctgctcttttcgtactacttgcaaggaggagaaagaagaacacgaggaggaaatccaagccaatcgccgcctccgcctccgattccttccga

SEQ ID NO: 49990 - DNA, 433 bp, Oryza sativa
ctttgattgatcatgaggtgggctggggctgagatgggccttaatttgcagtggatcagataggcacacggaccagaataatccaaatcggaggactcgtttctgaaagcattatccctcccacacaaggaggaaatatatatatacatccccgcaaaaaaaaaagaaatatatatatatatatatatatatatatatatatatatatatatatatatatatatatatacagaaagagaaaaaaaaaacttttatctggaaggaagggagagagaaaccgaaacgagtcaaacagaagaaacaaacagacacgtaaggaggagaaatttcccctcccttccctgctcttttcgtactacttgcaaggaggagaaagaagaacacgaggaggaaatccaagccaatcgccgcctccgcctccgattccttccga

SEQ ID NO: 49991 - DNA, 270 bp, Oryza sativa
tgagtacggtggttgtacttagtcttgctttatttttcctaatcccccagaagcaaaagttggttcagatagtgagttctatgaagattaggcttgtgccagccgacaagagtttgcctgtggagttgtggaggaagcttcgctttgctgagaagataaagtctagttctttagtttttccgttgcgtttgagttttattttgttatttttataagtcgtggaactgtatcaaattgtcatctatgtactctggttgatgcctggacaga

SEQ ID NO: 49992 - DNA, 1501 bp, Oryza sativa
aagtggtgtgccaatttcatatgtttcttttaataactattggtgaagtcaatagggaacaagttcagaactttgcatcattgagcaaaggagccttgctgaacgactcatctatcattgcaaatcataattgttcaaaaaagaataatatgtgcatattattcagaaggggcaaactaagcagcagaaatagagaatgtaattgaaagttacccaatctcacttcatgtttgacctgtaacttcggacatggaattactgattttgaaatccaattatttagtctttcatccgcatttatgctaagaaggaattagagctcatgtttacattgtaacagcatttggtctatattgtaatggaaatggatgataaataacaaagaaaaacttctctgttttggagtttcccatttcttgcaaacactatccttttgtatgactaattcatgactgcacctcaccttgatgttttatttgtgtatttatcagttgtgaattgtctatagaaatcagatgtaaaaggagaatcaccaatctgtatatgcattttctccgcttgcaattggctctatacatttgtgtcaaagttctgagatctcaacctctgacaacaaaaatttaaatgcagagttcacaagatgtcaacaacagtcatgcacacccaacaaacaaagaagcatccaaagacaaacaaatatgttgctttccactcagaaggctgggttagattatatggtctcttttatttttctccggcgattttagggcttagtaaataatagcttattcgtttgattcttatcttcgctgtgttgcctttgtagtacttccaatctgtattaatgttgttagttatgtttgcccttccaatctgtattagaggatgcctttctctacgcatctaattctcgagttaggcttgctgattgtaattgggactatcattttctagcttggaaaataaagcagaggtgttgttgagcagtgatttttttttatctcaatagtacgagcacatgtaacatgttcaaacaaccctttttggggatggtaaacatgtaatccgagtatcctatgatgttcattttctaaatttctaatgtgcagaacccataacgtcgtatgttgtctgtttcgttttttaattcctcatcagcagcctacctgcactgcccgcccggctgatcattattaattcctttctcttttgccggctttttttaaacctcttatttaattcataagtcactggagaagctagcgtacgttctaattgcaggtttttaattactagtaataatcctgtgatcaattagcttcacggctacgctggagtgtccctctcaacacctgcaggagcagcactatataaaccacataccatccaatccatttggacaaaccaaacacagtacaaaacacatagtagtagctgtaattaagcagcaagcaactcacaaatcctgatctggttgatctcaccatgggcgccatctcca

SEQ ID NO: 49993 - DNA, 343 bp, Oryza sativa
gttgccctagtttcccgttttgtttagtcgttgcttggtagatttttgtgttcaagtttgtttgcttgtggggtttagctcacggtcgataccatgtgccgatggtatgacggtctatttaaggatctttaagtgtgtttttaagtgtgttttaagcaagagcagaacaattacagttgattaataaaagcaagagtaaagaggttccttagtaactgtttttctccttccctatttctcctcccgtcttctacttcaaatggtgacaacgaggactacccgttctggaagcaatgtcaattaggaacaaccgtcaggaaatggttcaggagatttgccagag

SEQ ID NO: 49994 - DNA, 1501 bp, Oryza sativa
tgaatcttcccttaaagcttaaataacatcactaaaatcaatccaagggaaagaatatctccaacttatgagacgttctaacctccccctagaaatgtgacatcaattacaatgtcacaatttcaatgacgtctcatcttttgtcattacaggcaattattataatagtcacatgatcatccaaaagaacaaatatgactgtcgtgcacaaggacaagaccaatcactttattatcacacttaatatatcatgttctatttggaaaaaaataacggacatgacccgtttctcacatgactttaaataattaaactagtagagtttctcttaatagagtgaacaaatgagacattattgcaactgctggagaaactaagtgtgaggtctccaacaacccttcactttcatcttcactccatcagttactctgagtgttcactcccctctttgctaccgtttggatggtgcgagtttcctgtaatgagttagaaacatgcacaatggcattgagttaaactcactaagtattaagggaaaattcatcataagggatttatttaatttcatttatacctttcttgactaaccacgctgtgaagcgtgtgcaatttctctgccaatgtccatctgacgcacagaagtggcagtagggacttgtacttaaaaggaacagctgaagtggaggccttgatcccttcttgattctgctcaccctctggctcgctattcttattagaggattccccttgatagacctttttgcctttatcaaaggcattagtgaggttgagccggtctttaatcttctgcttttcagctttctggcgctcttcctcttccacggagtgtaagatcaattcttgtatggtccactcctctttctgagtgttatatatttttttaatggatcatagttaggaccaagagatctcatgatgatgtgcactaaaaatccatcagatattttcatatccatggatctgagttgatttgccatatgagtcatttcaaggatgtgcttccttataccactttcgccatcgtaatgactagtgatcatctcatttacaagcgtattggcatgagcctcaggtgcaaattcaaaactttcttcaatgtttgccagatacgtcttaatgtcattagagtcaatgattcctccaataacttctggagagatggcatccttgacataaattaagcacattctgttggacttctcccagttggctaacttcttattgtaggcccacatgagattatcatattcttccccaattatattgagttcttcggctggttgaggttcctcgggaggatcctctcttatggctaagtcataatccaacatggctaagttaataagcacattatttctccattcaacgtaatttgatccatcaagaagctgaatagccttaagctgtcctaatgctgaaaaattaattattaattaaacattagtaatgcatgcaattaatttccattggcttaattaat

SEQ ID NO: 49995 - DNA, 1501 bp, Oryza sativa
tttgcagaatgcaggcgtgaccgtcttttcgccgatgaggtaggccctttgctaccagaggaaggagagctgaatttggccggtttctgaagcagagatggaagccgtcttctctttacagactcggcacttccctgattaacaatggaactctcctgaaaagaacacaacattacagtacagggtggtatgtaaaatgcccaaacatttgattccgctgcacattacgaacaaaatccccacataatttgatgaacagaaatgtcaccttcaatggttgcttgtcgtctgcatcagcaggcacggaattgtcagcacaaggatcgggagtagcagcctcctgcttctccatcgcttgcaacacctctctcgattcaccagcatggacaccatcctgcttgtgatgcgcggctccatccgcatccactccgcaagaggagccaaccccaccatcggcgatgacatccagctcctccatctcttccaccggcccagcagcgacaacgcccgaaccaacgacgcagctcgtcgtctcctccgcggcgggctcgtccgtcatacacgaagaggaggaggagcgcgccgaggagacagcggcggcggcgtcctcgtcagggtcgacgtcactgccggtggcgtcggcgtcggcgtcggtcttgcgcttccgggcgtagtgcgcctcgaagaaggccttcttctgggcgacggagcccgggcgcgactggtgcgccgcctcctcgaggtagcggttgtgggcgaacgccgaccacttcccccactccagcggctcggcgaggaaccgcccgaacgacaccgactcccccagcgccgacatcatctccgccttccagctctaaccccaccattagaaacccaattaatctcaccaaatcgatcgattcgatctctccgacaattcgacgaacaggaggaaggcggggggcggcggcggcgctcacctggtggtcgggggcgaggatctccggctccggcgacagcgcgggctccggcggcggcggcggcggcgagaagtccaggtcggctcccatggcggcgaggctggattggatctgggcttctggggtggtgaaaaaagcttcgctggattggattgccttttcgaaatgtggaaggaggaggggagtatgattgctttggggaagggggggtggtggtcacagcctcacaggcgcagagcgtggtggtgggatttgaattggggggaggaggagaggggtcaggtgtacgttgggaggagctggggttgggtctcgggggcctacgggtgaccgttacacagtgtttgaccctgagacacactgactgcgtagggtcagagggagaaatgtttgtagcggctatagtagattacctttttatttttctttttcggcacatatcataagaccaagtttaactccatcctgtttttttaaaaagataatttgctgtgacaattttttttggcaaaagatttggcattcaagttctgctagctggc

SEQ ID NO: 49996 - DNA, 1501 bp, Oryza sativa
ttcttctgggcgacggagcccgggcgcgactggtgcgccgcctcctcgaggtagcggttgtgggcgaacgccgaccacttcccccactccagcggctcggcgaggaaccgcccgaacgacaccgactcccccagcgccgacatcatctccgccttccagctctaaccccaccattagaaacccaattaatctcaccaaatcgatcgattcgatctctccgacaattcgacgaacaggaggaaggcggggggcggcggcggcgctcacctggtggtcgggggcgaggatctccggctccggcgacagcgcgggctccggcggcggcggcggcggcgagaagtccaggtcggctcccatggcggcgaggctggattggatctgggcttctggggtggtgaaaaaagcttcgctggattggattgccttttcgaaatgtggaaggaggaggggagtatgattgctttggggaagggggggtggtggtcacagcctcacaggcgcagagcgtggtggtgggatttgaattggggggaggaggagaggggtcaggtgtacgttgggaggagctggggttgggtctcgggggcctacgggtgaccgttacacagtgtttgaccctgagacacactgactgcgtagggtcagagggagaaatgtttgtagcggctatagtagattacctttttatttttctttttcggcacatatcataagaccaagtttaactccatcctgtttttttaaaaagataatttgctgtgacaattttttttggcaaaagatttggcattcaagttctgctagctggcgtttaggtggtgtttggatccagggacttaactttagtccctgtctttagacactaatttagagtattaaatatagactacttacaaaactaattacataaatgaaagctaattcgcgagacaaattttttaagcctaattaatccataattagagaatgtttactgtagcatcacataggctaatcatgtattaattaggctcaatagattcgtctcgcgaattagtccaagattatgtatgggttttattaatagtctacgtttaatatttataattagtatccaaacatccgatgtgatagggaaaattttagtcccatctaaacagagccttagatgtagggtaaagttttgccactttactagtaaagaaagagagaacgactcccaacgttttttttttcaaaatttgctaccctaaactcccaaatgacaaatgacaaattgcgctactagtgcttatccatgtagcaaaaagtgcttcaaaacatcaaaacttttgtcattttagaggaactaaacagggctatactccctctgtttttaggttataagacgttttgactttggtccaagttaaattgcttcaagttttaccaagtttgtagaaaaaaataataataatttcaactcaacacaaatttattatgaaaatatattcaattattgatttaatgaaactaatttggt

SEQ ID NO: 49997 - DNA, 343 bp, Oryza sativa
ataaaagagattgccaaagatgttctctagcatgaaagaagtagccggaaaaggtgattgataacaagaaacatgctctgcatcgctcaaggaagacccctgatagtaattgcctcccccacaacagtcaccctgtcattaagtaagcaagatgacctaggtaaaagggtttctatgaaggcaaggagtgaaatcttcaactcggtatcagatgctacacggagtgaaaagtgcaagcccaggttaccaggcgacgccatgtcttgggagatgatccaatgggaaagaacacatcaaggctgaaggtgcacaggaatacgttgaatgctaaatgatgacaaca

SEQ ID NO: 49998 - DNA, 605 bp, Oryza sativa
aaggagattaacttgacacttttaacttagcaacattgcctccagtgatctgatatttactctttaagtcctgttagtgattttctagagcaaagagaattcgtaaaaaaattctccctgacaattccgattattaaatacattgttaactggggttttctcctggttaaccaaagtaaattcttgaagtcatttattaatgatttgaaacctaagggaagggaaaactccaagtgtgacaggagatgatcttcagtcttacaaaaaatttctatacaaaattaagttgctttagaaaaatcttattgatccgttttatgtgtttggggagagagtttcccaactcccactcacgattcgttttatgcgactcacgaacacagcagcctaaaaccataaatagacgtcgcctgggagcatcttgatgtagatcgactcaaatagtttcgggctctcacctcccttgaacagttgttggaagtgtaagactgacatggccaacgatccaaagctagcatttatggataatcattattagtagcagtaataacatgaatttcttaatttggtgcagatcctctgaatcgttgatccaagctcgaaga

SEQ ID NO: 49999 - DNA, 348 bp, Oryza sativa
tgaatgatgaagatagctagctggcctgcagtcttggttctgccagtgtgtatacgttggaagtgcatgcagatcagggcatggaaataaacgttaaagaataaagatgctccaggaacgtctaaattaacaaagataaatactccctccgtttcgaaatgtttgacgccgttgacattttagcacatgtttaaccgttcgtcttattcaaaaaatttaagtaattattaattctttttctatcatttgatttattgttaaatatatttttatataggcatataattttacatatttcacaaaagtttttaaataaaacgaacggtcaaacatgtgctaaaaagtcaa

SEQ ID NO: 50000 - DNA, 202 bp, Oryza sativa
tgtttcggcccggcctaccacgcaacaccgggaaggtagaaacacgcgcacgtacgcatgatatcagataagatcatgtctagcgtaattagattttgataatcacgatctgaatcattcttttttctttttcacataaaggttatttccttttcaactacaaatttgaaaaatctatacataaaatttaaaactctctaga

SEQ ID NO: 50001 - DNA, 1456 bp, Oryza sativa
caatcctacattgtttttttacttgaatttgaatatgtttttattcagattaattgtattaggtttaatcacattcaatcctacattgtttttttactacggatgaattactagtctatatcatatcctcctcacaaaagttgggacagggaagtaaaaaagctgtcagtggaatcagagaaattaattcattaaattaatatgcacatctatatatttagagaaaatccaaagaaatgtcattggaagcgttcaatttcaagaaatgccatcaacaagtacatacatgttccatgaaatgttattgtacaagcgattttgtcctagaaatgtcaccgccgttaggttcccatgcatcccgcactattcatcctatatcatttaacggagggttgctaatagaaccctaacagcgatggcattttatggaactcacactggttgatggtatttttttggaattgggagcttgtcagtggtatttcttggattttcacatccatttaaattcaatttcaagaagagcacgtagtacgtttcgctaattattgaattcaaatttttggaattgataacttaagtattttaggttattaattaattataagacgacactccaatacatttaattacaactagggtgctatcctatatatctataaagttcatccccactaaatatagtagtgctaattttctcttctctcataaagccacatcacataaattgtttttagcctttggataattcatcaagggtgtaaattgcatctcttccctaaaaggcacaccatacaactcaaccgtttataacctatggataattgataaaaattaaaaaaaataaacatatgaaaaataattgtatattaagtaagaaagaaaaatttggaactcatatctactatgttctcacacaattctcctacagcaacgagcgaggtacccatctagttcattctaattttttgaattgttaaatatattgcgcaaaatataattaagactccaaattgacgcagtcttatatatattatttatttattaaaataataagaaaaatagtccagtttacacatatatatatatatagtaaatttgtttggtgctccatggtgcccggacaccattgttgaaattgagtatatacccaattcaaatgagtataaaactttttcaattacttaggtattaacattaactactttactaactagtttaaagcaagtttgaattgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaatatttgaaaaatttgagtgattttgtgcattagataccatggtgcca

SEQ ID NO: 50002 - DNA, 906 bp, Oryza sativa
  unsure (1)..(906): unsure at all n locations
tgtatcattttattagttcagattatttactgccagggatttcctgtttagactagatactgcactggtgggctaaaagtgatcaagtatccaattttggtaggtaaagatatccctgaaacagttcagcagggaatgagtaggaactttacttgtgggagaatgcttacggaattttgtcccaagacagtttggtaggaactagttggacagttaatttagcacagttcgatattaaatgatcaatttatcatatgatacatgtattgaaggttgtaatatggtgataggttaaatagttcttcaggaactgactgtgatcattaatggcagggagcaagtcagtttttgcttctccacttgaaaagatccaacccaatggagcaaatcatgcaggagatccggaaactccaggaggtcaagccttcaagggcctggacatccttagcctcagcaatttgatgcggcaagaaaatgcttcaggttcaccgtcactttcttggggtgagatcctcccaaacccaatatcgaggcttggcttgtctacaagagaacaagcttttgttgaaccaactactgctgatcaacatgtgcctggttatgggaagggcttttcatccactccctctctgaagtattcagtggcaaatgtgagttccctttgccttctttttttcccctacaagccatgttgatagtagaattttatcatcttagttgcactacaaccaaaagtactgtttttgaaagaaaccacaatattgttcattgaagattaatcttttctaagagttcatgatgttctgcagcgagagaaatagtaagtggtgtttttttttttttggggtttccccaaaaattttgccttaaancttggggngacancatacctccatctacgacagt

SEQ ID NO: 50003 - DNA, 488 bp, Oryza sativa
ctatcaaattgttgcactgccttcttccttgtggacaacaacaacacatgaatgaaaaattaaagaactcgccattgatgacattataaaccgttgcatcttgtaccaagtcccggttacgccaattttacaattcatcgcttacaagtcatttgagataaaaagaggcataattttgactctgtaaattgtttgtgtcctttcataagcacagagtcttttcctttctaagtgtacttcatcttctttttttggttaagtaccgatgtggttcttcatatatattttgaaagattttcctaagggtagcagttatgttataagaaaaaaagagacttctattttattacttagttaaggaacccaatcatcatttaccattcactctgtatatcttgttgagctcttttgcttctccttcgaattacttactctattacggtactgtgctcatctgtatactgtcttatatatgctttcctgacagg

SEQ ID NO: 50004 - DNA, 758 bp, Oryza sativa
ctgaatattggctccagctgatgaatcattgtgaatgctatccctactatagtaccaaccctagcagaaaaggattaaacaacattgaattctcagcccaaaaggtgcagcagagcatgcatggcaacatagcactgtagtcctatctacagcggccgtcatacatgtacagatgtactgtacataacatagcttgcagaaaggaagttgcataggagtatgtagttaacctggtcaaggctcaaaactcaaaagacaagcatccgatctgagaattctgaaaggtgctgggtcagcagcagctatgggaaagcaaaatttttttttgatgaatctttccaagtccaatgttcactggctacaagcccagatatggcccttgcttctcctaccattttcatttttcatgtgtccaaataggagtacaagcagcaggtcaggtcagatcaggttgcctaataaaagattccacttttctgtgcatgcacacacacatttgcttttgcatttgcaagctttgaatggatcccagagcagagataaagagagatggtacagtgtacaagagaggactggaggcaggaggccaagtcatatcgatcaggctggcagcatcaagtacacatttgcaaggcatgcatattgcacacacacacatgcacatttctggagtattaaacacatgaaaagggagtagagtatctacagatgcaacacacagaagagggggaggaacagcacagcagcagatgaatgaa

SEQ ID NO: 50005 - DNA, 1501 bp, Oryza sativa
aaaccacatgtttaacccctattgaaatagcttaactagcagcagtcaacagaaactatacaggttaatagaaactacaggccaatagacaattcatatatccaaaatatcaatctccagaagagatcctacaattttcaaagttcacaagaactaaacactacagtatcaatctcacattatccaaaatcaagaatttttttcttcgacacagtatactcttgattaataaaagtagaaaatttcagttccaagactgaaactctgaagcatgacagtcacctaaaaagtgtctaattgcgggaataacatcaactgcatgatttctctatttatacacttctaaagatttggtgttggtctacgaattaatcaaaaaatgcacattgaaaggaaaaatggcacaatctacagtttcagagaactgaaactcccaaacctgcacatgatctgagactgaattttctagctaaatttcagcaacctgaaccataatttcagaatttcacaattcagaattgagctcaatttcagcaggtccccaacatatacactgcagtaatgcagtcagtgggcaagaaacacaagcacatttagagtgtgtagatggaattgatgttcctactcttgttgtttttaaaaccaaaagaattgcatattcctgggaagctgttaagaggaagatgtgatatttctctgatccatttccacagtgaaggacgcgtttcacaaggggcatcctaaattcctaaaaatgatggcatcctttagagaattacggggtcatgggaatcaacaatcatcttcagatttcgtggaacacgtgttgtattaacagatccaatggccaaagcagttgatagtcactcaaactaccagaattaaagggaaaaaaacaaaacagaaacaaaatcagaacaatatcagattctatgctaactgactggaatatacttgctgtcaatttcagctaatgactctgaacaaacacatgccattctctattacaaatgcatatgcgccattctctagaactaatgcacagcaaatctgagcacccaatgacagtagtaaaacttagtactatataaatctgagcactgtttaacagaacattatcgaaacacaagaacagttaatttaggcaagacataaacaatagaaactttaggcagaacatacctcacaaaagcacccaatctcatgtatatcaaccctgtcaatacaagaaaaccaggtaagacaacatgctctgaaaattcgtgtgagctacttactacactgcagggcttgcgttgaaagctgaagatagcaatgttagccaaaactagcctaattaatagtgtgaaattagaagggtaggttagtttagtgttttgccgggtataaaggcttcaggttgggttaaattaggatgcttgttgggtggattaacacttaacagccgcaactttagaccttagacacgccacaaatttatcttgaagctaattgtctgtaa

SEQ ID NO: 50006 - DNA, 1501 bp, Oryza sativa
caagcccagatgaggagctccttgaagatgaaggcttcggtgtctagctcgtgcctgccgtcaagcgcctgtggtcttcgccctagtcttccgctgtttttcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttatcatcaaaatctgatctttcaaatgttgcttttctttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgttctcctcgccatcggcacccttcaccagcgctacccggacgagttgcagcactcgccctaccgctaccaccctcgtcgcggaggagcccgcgactacgccacctttcgagacgccagctcggagcatgacgctaccgtcgtgcatctggcacgcatggtggaggcatacgacgcagctcgtattgacttccatcagatggtgcgccgtggcatggtggagaacaacatgaagatcctggagctgcgccaagagaatttgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttcctcaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagtcgtgtggggcatggttacgccggtgtgtggtgtaactatgtcggggcctgtctttatttgtttgcctaagcaacttgaacattaatgaaccaatttaatagcagtgataaattcaagatttatagtagtcgtgggtggttagttttaatcgtcagctctccttctctgtttgctggttctgtgtggggttttc

SEQ ID NO: 50007 - DNA, 549 bp, Oryza sativa
tttctagacgatattttcgttggttccattcaactataaataattaatatactaaggaaatgaccatcataatgatgttgacatgaaatcataaatactttctagttaaatttccattcaactaaaaataaattaagtggcttaaggaaataatattcttaataaatattgacatgaaattatattaacgttggtcaaatattatatcataccattaatttctttctagctaaacatcccgttggttccatttaactagaaataattttctaagtgatcaaataattgaccataattttccagcaatttaaatggctaagaaaactcataaataaatttctggaaataaataagacataaatggcgggcttaaaataataatgcggcccatcacttcctaagccggcccataaaaacaggctaaatacattttgagaaaattaaattcacgggcttaataataaattaaaataaaaggcccactcttattgaaaaggccagcccaaaatggaccggcctatttatgtgcacgatcggcccactctcagg

SEQ ID NO: 50008 - DNA, 1501 bp, Oryza sativa
aatatgtcctctagcatgtggatgataggctgatttgaataccaattgagcacctttatagacatggataccaaatcttgccttgtcgatcggcatttattcattttattataagtccattacccgacattatttagccggttgcgcacgctgacagttgacaggaactacatactcatgcaatttttaaagaaaattaaatgattaacttgcaacgatttgcctagcccctgtgagaaatgatgtaggcaagctgcatgccatcgggcatggtggcagtatggaacttgagatcagtcaccggaggcgccacattgcccccggttcccatgatgaggtccaccagcacgccggcgacggcgacgaacaggaggccggcgacggcgccggcgacgagcccggccatcgacacgacaaagacgccgagctcgaggtccgcgaccgcctccgtcaccgcgccctccaccaccacctgcaccgcgaaggcgcccacctccgccagcgcgttcaggctgttgcggagcaccgcctcgacggtgtgctccgccgtgaagatgtcccacaccatgaggcccgccgtcgccaggagcaccgccacccccgccgccgtcgagaccatctccgtcaccggcatcttggccctgccggactcctcgatgatgctgttgtacacctctagcttctgcgcgtccgtcagatgctcgaactcgccctcgaatcccaacttgttcttgtgtcttcacatcgatccgatcacatccgataatcaaagattacaactaattcaagaagaagaggagatcgaactgctatatatatgtatggtaattaattagcaataacttcttaccgtttgacaaggtcggggaacttgatgccctcctgcttgagcatcatggagaacgcctttgacatggcgcgggcggagccgctccggagcctgttgcagtgctcgaacatgcactccttgaacatggccgtgtccttggccagccgccggaggttggcgacgtcgtcggcgtggaggccggcgaggtcggcgacgagggagtcgtagtgcgccctgatctttccgatgcagtccacgcgcaggcagcagttgcggacgttctgcatgctcatgttcaggccgtacttgacgtactccaggacgtcctccgcgatgctggccttggcctcgccgccgccgcccgccgcggcggcggcgtacttgtccctggtggccgagccgtcgtcgaggaggtcgacggcgtggttgtacgcgtggttgacgctgtggaggtacttgacgcgctcgttctgggacttgaccgcctgcgtgatctgggcctcctcgttgttcctcagcaggagggccagcttcttcagctgggatacctccatcagcatcaccaggtcgcctccgtcccccattggtgccgccatcttcgagcttggatcaacgattcagaggacctgcaccaaattaagaaattcatgttattactgctactaataatga

SEQ ID NO: 50009 - DNA, 507 bp, Oryza sativa
ccttgtgtttgtgatctgtgtgacttgccttgcaatattgggtctccaattaatcttcttgaacacttggggcgcacttgcgaaccttcgaaacgacggaaacgacaagctaaaacgcaaaacgaggaaaaagactaagaaactacaaataaacattacatataaagtaaacaaacatgtagatcataattttagatgaattatgagacttgaacagtctcattctgacttcatatgaattaattacgaattttacaagatttaatataattaaagcctatttaaaaaggactaaataaatttaattcaatttatggataattttaatatgtagatctttattttatacaacttttgcaacttgaaccacattaaaccgagttacaatgaattagttatgaatttttaaagattaaaccggattaaaacatttatatagattttaattgaattatgacgcaataatgaattatttttgaaaaggaaaagggaattattgcgtcagcg

SEQ ID NO: 50010 - DNA, 217 bp, Oryza sativa
taagtgcttatctgactcttaccccgccctcttctgggagtttagatggctagccgtccccgccgtgcagctcgtgcaccagcccgctttggtgttgaggatggtagagttgagccagaagaaaatcatgaatcagctaatgagcagtctcaccacagcaaccgttcgcatcgtactgtttcccgcaacgcagaggttgagcaaccccgccgcagca

SEQ ID NO: 50011 - DNA, 427 bp, Oryza sativa
gcggaggtggtgcgccgccgacaggagctggatccggagccggagctggtgcgccaggaggtgccgtgaacgacaataacaacggaggcaattctgcctcaccatccagcggagggctattctcggggtataatcttctcctcctgttcctattgttagcgctattcctattcccattgttagcgctatcgctatactatgtgcgctatgttctttgttcctgttcttcatgatgcctctagcatgttattgcgttactgttatgttcctgttcctgacattcatgatgcgcatagtatgatactggttatgttaagatcactctacactgcttatgccatgattattgctttaacattttggattaaaatatgccgattaatgactatatttccaacaatccaaaaacctgataggtcattttcgg

SEQ ID NO: 50012 - DNA, 1501 bp, Oryza sativa
cggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctacagaggttaacaaactgctcgaacagccgtgcccacggtcatgggcggatgtgaggtgattcctagcgtagttttgtttgactactgcttgtgaaattgctgttgtgaaactgggttcgatgtttgaaaaatcagcagctgacgggatcagctaggcccgggtggccgtttgaaaagttgttggcccgggtggccgtttgaaaagctgttggccgggtgccaaccctgtttcaagatctaaagactgatacattgcacatactccgaccggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctctatataaataatcccccctagttgctgaagaagatgaagtggatcctgctgacgaggagttcttccaggagcaagtcggctacgatgagttttagggtttcggcctagttcccaagtcgcgcctgtgatgattggtccaagtactggcttccgctttccttttgtaatgcagttgtgagctcgggatctgtccgcagcccaacatgactgtacttctactctataataaagagacctctgttgctgtgatactctgtctccttgtgataccagcactatttcctgggactggtatcgattaacaggttaatttggagcgtcacgggctagatccggtcgggactagttcggggcgtgacaagaggtggtatcagagcacaggcttggccctagggcgaaacccgacgcttaggacgaccctaaggatactaagttcaaaactacttgcgaaaagctaaggtttcttttgttttctttattttcaatagtttggttctaaaacgggtactgatctttctccctctttcaaaattgtagatggcagtgaacgccagcttcagttcccacggttttggtgagggtcaccacgtcgctcagcttcgtgacctctcccgtttccttggcttctcgtgtcccgagtacacggggtactccgtggaccgtgttcccctcactg

SEQ ID NO: 50013 - DNA, 1151 bp, Oryza sativa
catttagctcggccagaccgctccatttctcttggcccgcgccctagccgtccgagaaaagtctatattccctccctcccttcttttctttttcttttccaaaaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatattatgcattgataggatcacacttaatctgttgtcccgtctgtaaggcaggttggcagacctacctaatttgttgcatttgatccttcctttgttaattgttataccatggccccttgtaaccacccagttgcacctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctacagaggttaacaaactgctcgaacagccgtgcccacggtca

SEQ ID NO: 50014 - DNA, 1501 bp, Oryza sativa
ttgctcgtttaaatgagattgttgatagggcaatagaccaccgttacataatcaatctgatcaaaacataacgagggcagaaaaaggatggaaaagttatacaactcagtcccctcggtaaatcaacgctcaaccacaaaagatacaaattttatctctgaacaaggcaacattgtccgattacgccctaaatccaaacgattaaaatggtcttataggtgatcaaacctcaccagttaaaatcaggtgagcacttgcacacagttatggcccccagtgtgatacaaaaagggaatctttaacccaaaaaataaccccccaaaaaatggttcttttaccccggaattgtgggggaaatcggcagtggtacccaaaaccacgaacaggttgatcgatcttgccatcgattattagaaagaaagaaagaaagaaagaaagggcatgaaatagaagaatggagggcaggaaataatgcgataaagaagagggaatcgaaatgcaggaaggaaggaggagttcaccgtgcgcgtgcggcgaatctgatgacgaggatgaggaggaggaggagaaggaggtatcgctttgttggaccttggctcctgcacgtaccctctcccctgaatgctcgtgggaagggtaaaaaaagcttcttccgcttcctcccttcccttcccttgcaatctctctctctctctctctctctctctcttctctcttctctctctctaaggagtactaggtagtataggtataggagtagtagggcttttgcaactgcactgatgacattacatcgaatctgggccatccaatgcacaaaacaacggctcagatattgcatttaatgccaccaatcatccccccaactctcggtgcactggtacaggcctacagcttgtgccctgcgccgttggatcttgtataccgacggctcagatcaagcttgtgaggtgagtctgatttttcttttttatttttcggttcaactctcgtatccttatcctgttctaggtttcatttcaatctctggtcttgtttagatttcaacttttttcttcaaacttttaacttttccgtcacatcgttccaatttcttcaaactttcaattttagcgtggaactaaacacagctcctgtaacagtctagttttttttaattagaatttgctcttgtgtgaaaaagaagttactttttatataaacacattacaaatttagacgcttgcgcacatacattctctgaaaaactaaatgggcatatattggtattgacgaagtcatcatgagaaccttaatgttgacgggtttgttgtgtaccacgtaaagaataattagccataccgtgttaagtaagacttgagtgagctagttaacctacgcctttttgtggcatgtgtaaaatatagtattttacaatctaacagtcataggcaatttttaacaattataagcgattttaaacttataagtttgcttagctgaggtcgcaacatgttttcca

SEQ ID NO: 50015 - DNA, 1501 bp, Oryza sativa
acagtatggtggtcttttgcatcataaaatagtcttagacgtctgtagatgcttgatcttctatgtcaagctttgctctatgatacgaatctatgataggccaggctatctgatttcttttgagtttgtgtagcctgagttcccctgtttggtactctggtattatcttgcttacagtttgcatctttacatattataatcctcatgtgcatacactcccaaatccatttttgtgttcttattagctatttatggcttttgtaaatgcatttgctgttgctcattgcttgcatctgatgccttctgtatgaatatttggatatgttacaatttctgatgtatccatgaactgctttacttcaggtctttgcctttgcactttcatttatatgtatattttctctgtaaatgactaacggtacctagtgcaacagtgtagatttatgacccatgacaacctttgaattgatttaccactgctggtgaccttgtcattttgccagattcctcacttggtttccatgtgtttggctttgctaattcattactgattatgttttgttcagcttgattgtccctttcttgcgtttcggagaagttatcacaggcagtggacacttccctttgacttcagatgcattcaagaaggttatcactggccaggcctcaaaggatgtgatgctcagcattgtgcatgcggttagtaaacaaacttcatctattatccatctagctgatgatatggccattgctttgcctttgaggaaacactgacatgagttctactgccaatgcggatcacagatgctcgggtggctgatcgctgcaccgttcgcacttgctgcgctgtacatggttttcaccccttgtttcaagcttatggtcgacaggtttggcggcgttccgtcgagtccaaggacgccgatcaaattagtgtagccgtgatgtggagagtgatctgtccaatacaacgcttctgaagctgtatatatcaattataatttgtcatgtcctcagattgagattggtccctgccaacattttgctgggccatcctggacgcctgtatgaacaaaatctatcttcagaggcatatatgatgattcagcgtattgcattcaggcgtctgcctgggttatatttccttctaaatttgagtcaaaactgaagccttctcgtcgacctggtttagtgtttcgctcttcacagccatggtacctcattgagatgagcattcatttgctaatttgcgtttaattgtggatttgtggttcatggcaagcaattcaaaatgcttcctaggaaatctgcaacaaacctttctttactgtctctagattatgtttttgctcctcaattgatgatcacagaaagcctatgggctatggtacaatctcatggtagtatctctgtggatggaaacttgtagctgtgtcatcaacaccaacgaacaacgtggtgatcagagtacattagttaacattaacgctcatgtcaacag

SEQ ID NO: 50016 - DNA, 1501 bp, Oryza sativa
ccacaaaattttctaaaggacatactgtcacacttggcattaatctaatttaacttttttttctttatcaggttataaattttctaaaagacatttgtgccacttgcatgaatctaatttaacattctttctttatcaggttataaattgaaaccattgaacgtactttgtcttcccgtccctaaaacattgtgatatatctataatattttaatgtttttaattttaaaaataatttagactaataatatagatatttaaattaggtaattaataaattcaaataaactatagtttagaataaaaatgcaaaatgatatgtgccaagtacaatctaataacaataaaatgttagaaacaatattaattcaatatttttataaattttaagtacgattcatacttaaaattaaagaaaaatataaatttatatgtaagtgagaacataataaaatgtaagttaaaatcattaaaggaaaaatattattaataaacaatgatgttgatgtatttctaaatattttcacgtattatttattaaatgtcaatgagtgaaatgtatgatttaccatgcgacagattaattattaaaattgtattgttttcatccgttgcaatgcacgggcattttgctagtccacctaaattaaaccaaacaaatggagtagtatatactaagggaatggtaattatgcatatgtaacaccaatttacttgaaattttaatatccaaaaactagatagataggggttaatatgtaaaagtgcctttctccattaaattaattccactttcccacctcacctccaaaaactatcaactagatagataggggttaatatgtaaaagtgcctttccccattaaattaattctacttccccacctcacctcctcttcgattgatttgaggagataggggttaatatgtaaaagtgcctttccccattaaattaattctacttccccacctcacctcctcttcgattgatttgaggaagagattcagtcaccttttttgtcagatcttgccaggtgttgcccacacgctcgatttcgtcaactcttccgctcccatctttccaagcaaaaaaaaatctttttcgcgcaagcaatccaaatccaaacccaaaggtggagcctttcttccgatttaagccacccaccctgttcacaagcaatccaaatccaaacccaaaggtggagcctttcttccaatttaagacacccaccctgttcacccccgcttccaatccaatccctccttcgtctccttcccctacaagttgggttggatagttgcacttcacccctacaagttgggttggatagttgcacttcaccgtttcttggattgtttcatgctgcaaggccagacatttatttgttccgcgcgatttgatcataaaaagttgcaggttctggtttcttggtgcccgcaacagataggctattgcgttttgctggactcttctttttcttgaaaagtttgccaagaaaat

SEQ ID NO: 50017 - DNA, 777 bp, Oryza sativa
ttgtattcgtttgagagttgtattttagcgaagccacatttttcgaagatggtataatatcaattttctcgtctcgacctaccactcctgtatctctgtatacgcatcacacgcccacagtccgctccacgttctgcattgctcgtgatcttcctctcctccctttcaaccaccgccgccgaatttcctcacaaccatcatcatcgcgattgccaacgatcccccacctcgggtttgtcgtcgcggtgaccgagcccccgccaaccgtcgtgccgcgccaccctgtctcgctctagcgccattgctgattcgtcagatcgaggtctagccgccggctttgtgccgcccaagagcaggaagaacgcggggttggtgtgagggatcctcggctcgatcgaggcgcaacccgttcatgacgtgagcgctcccggccgttgggagccacgtcagccggcggcctccgccgtcgagcttttcctcgccgaccgacaccttctccctacccattggcgaatgccctggaggtttaggttgagatgggagtagaggggagtgaggtgaaagaagattgctggttggcttgtgggggccctacactgactcggccgccacgtgaacaacaacaacaattaaaagtgatcctgttaaaactcaacgacaagataagggaccttagatgaacttttttgggatatgaaaaaactccagcctcatgggcctgtgcatatgacccataccgcggcagcagagcgctgcacgacctccgcctccgcaatc

SEQ ID NO: 50018 - DNA, 1501 bp, Oryza sativa
actttagcatatttacactatttttttggaataagacgagtcaatggcgtcatctattaaaaaatggaggtagtagatcaaaggcagggaggcaaagcagcaattatattcctttaattaattaggagtagctgctggatttttagccacacttcagagtttcacttgatttgaaacatgcccctttattcatcactattttttgaccaaaggctagaattgctctgcttctcattagaatcaatgtatatttacagtgagtgatgcaagttgtgaaaaatctttcctttgttagtagctgtaatcaatatattatagtaaataaaaccatcatccaggttcaatgtggtaattcaattgtgtttcaatgttaatatgcaatttatggataacatgcactgcattgaaacgtaaagctttgttcatcaggtgaccccttttttctttttgttttgttttgaaacaactcccttctcaggattatcaagaacaaccttcaaagtccaattttgctactgaccttggatcacatgcatattctaaggaagccaggacacttggaagagtatatcatgggcagcagccttacttttccccttcaagctgttcttgggaaaaatcttctgcattaaaagtagtgccaaatagtccagatgcatcagggcatatagtcggggaaatgagaaccaaaaccaacatcctcagtgcaaggtcaaattacctttcatatcctactgatgttcctcatataaggtatcgagatgaagttaaagttgatcttagccaagatgataattccaaacagtacagaagacctgatcaatttactgccttctcaaacttcaatggtcaatcttctgaacaccttgaggtacatctgttgattgtgttaatcataatagagttgttacttctatatacatctctctatctggcatcagtagaaaataattaagatcatttgaattcgggagtatttgaccgtgacaatttttttgttgaaacagacagccaaaggggcaaactacatggatgagatcactccaatttcacgtcaatggtgctttgataatagaggcccatcactaccaagagggctggtctatggtgatgagataccatcgctatcttctaagaagtgtaatggcaatgttgcatcatcatattcaagaatatgggattatagtgctgaaaccacatcagtcagacaatgctatggcgataaaatcccatcattgtctcaccattggcactaccgagataagatccccttgcattctggtcagtggtgccatgatgctgaggcacgcccattgtcgaactaccagcaaggtgcttcttatgggaatggtcgtttaagagataatatttccaggggtggtaggaatgagcaagtcaacattatctcaagcagacgtactatgacaaaacctagggtggctaacaaggttgtaagcagcaccgatcactacaagattaataaggataacctatggagaaa

SEQ ID NO: 50019 - DNA, 1501 bp, Oryza sativa
ataatagggtttcatttgcaaaagcagcatttaacaaacatttgagaatttaataaaacagttaagtattaattaggcagtattaatccaacactatacaacataccctgttgtataggcccatccattctgaacaaccatctcggctgcacagttctatctccaaaccaggaatgtaccattccaaaccaggagctaatcaaattattaccaatttaagcatcttttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcgtaatcgcccccttataaacaaggcatggactccccagcgacccccgtgggcttatctccgccacttctcagtctggtgccccgcaatgaaccatgctatataaaagataaagccgttgcccatgctggcttgtggttggcacgataaatgtttcacaaccgaaactcgtgaaccggtccttaattgtcgtgagcacgaccatcaaaaccatgtgctcacaacccaccattatcaggttttagttggcacattaattaattaactaatcacgatcgaccatcgtgaactatcattaagccatcatgaaataatagtgaatcattagttatctcataagtgagctaatgtttctaagcagggctaagcaattatatctaatatctagttgaaccaatataaataaagctcaactagtcaaattataataacccaaggtatcaaggaataaggtaatcaagaacaaaagggctataacaaagaataggttaattccacccaatgacattcgaaaataaatgcaatagttgaaaagaaacaatagctttaattaggatcaacatgctcaaagggttgtttgggatctgtgtgacttgccttgctggccttggaactcttcaaacttttctccggcgaaaacggactctccggaaacgacggaatctaagcagaaaagaaccaaatcaccaaaacagcacgtaaacaagcatgaacagtacatgtggatatttttaatgtgtagatctcaattttagaaaaatttagagacttgaaccaactaaatcggagctaagatgaattagttatgaatttttgaagattaaatcggattaaaacacttatatcggtttaaattgaattatgacgcaataatgaattatttttgaaaaggaaaagggatttattgcgtcagcgggctagggtttcggtggaccgggcgcacgggcggcggttcacacgaacggacggccgagatcgatccaatccaaaacggacggccgagatcgaacggtccacgaccggctcacggcggacgaccccga

SEQ ID NO: 50020 - DNA, 1501 bp, Oryza sativa
tgttgcggcttaagatttcttaaaaaagatatgatggttaaaaataatggtatattcatttaggtggaaaccaataattatattttatttcttttctttgaatttctaagttctttctaaatttaaaacgtcacacatggtgacttaaaagcgctttggagaatttaatcgacttttattatataaaatgattcaaaggtgacataatagatattatttttttaatgttttgttcctatttaagttgtcgtgcaaacgacaacagtctaaagttaagtctaaaattaggagggtatgttttcttgatttaataggtttgctgtttgaattatctatacgtttatttctaatggttaaggtccactaatttaagagaaaacagatggtaagatgttttttatttttctttataatatttttttctatatttaaattatttgctaccctcgaaataaatattagcaaggtgtgagatcggattaaaggagggaggcatacgttcgtaccaggtacgtaagtacgtgcgtgcaatgttgggttgtgggccggtgagaggagatggtgggctgggttgtggggtctctattttaaaagataatcaaataatttagaatagtgggtcccccgatttattaaagtgccatgtggctatttaggagcgtttgtagtagcgtaccatgccacgtttagaggcgtttgtagaaagtttaatggtcttttagtatataatagatagatagatagatagatagatagatgttaaggctgaaaaatagaaaataatcagaataacacatattaatattaatattctaagttgaaaattggtcgtaactttataagccaacgagctgctaaaagcacacaaaattttggatttatcagtggatcctgctaggaagtacactactgcactagctagctgaaaattacgaaattaggtagaatttcgtgctggatatgtggaaatggatcaaaagtttaaaccgtctgaaaacttggtttgaaaattctatgatttcggtccgctcttcttttcttttaacatttcaaaaggtattccactaatattctctgtccgtgatattaatgagagtgcaaaagtttctctaaattaagccatgtcaccaattaaaacacagccacctgattaaaccacggactctcgataatttagttggcatattgcccaaattgttgtatgtgtgatagctgcatcttaattgcctaatgtcagcaacgaatctcagccatgtgctggtcccgtccagtcgaagggccaagaaagctagacgacttgcatgcgatcggagttgaagccttgaaggggccaaattaatcaagtggttaatataattatttgattaattagtaaaatatttcattgaggtggccgggcctacagggatcctactgcacgctcacgcgccagctcaataagtagcaagttttcaaatctaaatgaaaaaatttccaatctattagtaaataaaatcttcaa

SEQ ID NO: 50021 - DNA, 1501 bp, Oryza sativa
aaccaataattttatatatatactaaaagtacaaaaactttaagcgacacacatgatttctattctaactgttgctctatttataattaaactaacaatttaagatccatatgtctatattttgctatttaaaaaatacgggcacactcaacccgtgtgctttgcatatcgtatagcaacataatatcataaagaatcgtcaatatatttgttttcatcaacatcatctgcaaacatgcatgattaaatttaatcaataatattgaataagtataaaaattcatatttcaatcaaatttattatcgataggacactcctaccattttacatgtcaccctaattgcgattaaaaactatgaaacaattcaacaacgcatgtcgcacaatcacatattgttttgcaaacctatataaaaataacttgggggcacaaacacaccactgcctttttacctgttatccaaatttctataaaaaaatatcaactaattcaacaaacacatgttgcatcatcatacatcgttgcaaatagacagctaaattagatacatactgtacaagaaaaaaaacaatcgaacgtgaagagtttaggctattgtataaagaaaactggtgcgtttagttagagaaaaaaaatctgattatttcataaatgttttttttctaaattatatgctcaataatccaaacaagccaaacaatattttacgtaagtgctttgaatatatgttatgtaccatctaatcgacttcagacgatggtaccttttatataaagccaccacatgttactcttgcaaatgctcctaggccaccacatgacactctaataaattatagaaaaccctaaattttttgcaaaagtaaaacatctcgctatgcttatcatttaagctaatggactaattatttttaaccattagatctaaacaatgacagcctctatcggtaattcaattaaaaaaataaaaacgacttacttttattctagaacattatttggtagatgtgctctaaacaaaataagtctaccttgataaagaagattataaatagttatttattacgattagttaagtagcaatgctgatggaaaaaatgtggagaaatcatacatttgaagtgtggcaaatgttatccggtttatattccgttttgaagcacaacacgatgcatgcccgcgcgaatgcgcgggctaccttcctagttcatttaaaccgctaagagtggaagtacatatgttatactttttttttcatcggttatgcgtcacggattaattataagtgtcagccgaaagaaagaagatctcagccaagcagatttttcaagccaccttgcttgacactttggtcagctttgtcaaaaatgtatcggtcttcacattgttgcacggcatatgaaagaaacttggcggacttttaagcgcccgttacccaagttctacaatataagtccacatatatacagttaatcactcgaccgatcatgaccagcgcca

SEQ ID NO: 50022 - DNA, 227 bp, Oryza sativa
acaaccatcggctaccgagccgattgcaagacgaccagcagtgattcctcagcctcacactcagcagccttcagggcagccgattggttctcatacaatcaggccacaatactgcatccaggagccaagaacattttcattttagcaagctccagggttcaaccaatttcaaactccaccaccacatcggcagtttgcttcaccattcattcaaaatccacttcagc

SEQ ID NO: 50023 - DNA, 1501 bp, Oryza sativa
gactcctgggcatttctcaaaacattaatttatagatccacgtgattaaagatgaaaaggtaagaaacaccatcaaaatcctgttgcagatttttttatctaactcatgaaacatcaagtcaaaatagtcgaaacataaaaaattcacaaaaagtattgatttatatatggattcttacttcattccgagcagtggccaacgcctgccatgactaaggtggaaaataaggagaaggaattgacaagcactcatgaaatagggaggaaattaattaaaaaacgatgtgaaaaggatagagtgccgtgtcgatgtgagataaatggatttacgttgggaatgggtggcatggcgttagatttttattccaaaaccatgtaccggttagaaacattccccatgattatcccatatattttaaactttttaacgtagatgggttttatttctattttataattataatcatataggatatttgaacgagcaacacatacgaatttatcaaacacagagcaaagaaaaatgtgcagtaagtattttagctaaacaaacagttatatggtgcattcatgccacacatatatgtagcatactttttttttccaattagaaaaaaaaccgagaaaagtgtatttccccatgttatttagtaatatatctttcagcttcaatggagcaagtcttcgagaagatccaatatacctcgcactcatcagaataagtggtgcttaacgtggttagagagctgaggaaaaaaacaataaatcaacatagcaacaagttagcattcatgttcaaaaaggaagaaaaaaccaccaagttggcacctttgaagatttcacctaacccacaaaggccacagccatgagtttcttccaccttcccttttattttggagaactttacagccaaaagcaattgagaataatttgatagggaccaaagaagactactcatgatctactaatagaagtattgaatttaaaaatataaagtttttcaaaaaaaaccctaatagtaatacctttgagaaaataaaaaagaggaaaagaaataatgagaacaacctcatcttttcgcttatacttatacttataagccaaaatttgaatttttaactttaaatttagagttgttttaggctttttgattacaatttattttccaatctttacttttaaatcactataagaacacgtatataaaaattttaatcctaaattattttttatttgtaaatatattgtttagctttttttttcttaaatataagccaaacgatgatcctataaaagtgtaacagaatcgggagtatatactctactcctactcgtacgagaaaagagaagagaagagaaattacggtagtacccctgtctccttcgtcactggccacggcggtatataactccctccgacctccccgccaatttttccgcctgttttagttttcctcctttccacatctcatccatcgattcatccgatccgactccgacc

SEQ ID NO: 50024 - DNA, 1501 bp, Oryza sativa
cactcgagctagtcagtgctagaatatcaatcctggacagaacccatctgctacaagtgcagctggcaatggcaagttcgagagcataacattagcttacttagcagtggggaggggattgaaccataccagaacatagcctagattgatttggacatggaaaaggaaaagacttacctcacagcagtaaattttgagagattaataattttagaccaaagaaagattagagatttaaactaggtttgatggttggagtttggctagactagtaatttcgggtgtttactgtttagggagagtatttgatctccctaaaataaaaaataagctatcatattcagagtgaagggccttagtattagagcgtagaaactcatcatcacctgtttcagctactgatgatgttagtacactaaaatcataaatatctcagagctccttttatactggatttatagtggtacccaaaaaccaaaggcagtaattgtgtagaaagcaaagattttcatattatcggcacagacaggtctctgtattgtttttttttgttcagattcagagttggtttgtaaaaagactccctcgctctaatatactcctaggcagagtaggaaattgactaggaaaggatgtaagcaaacatcagatccatcgcaataaactttggcctacaccatgcatgagaatgagatgaagaaatccccaaaagatagataaggatgagcaagtctccagatgagagatccggctaagttttttttttacctttggcgaggagggagggagggctgttgggggttggtgaggatgcggcggcggaggaggagagagtggggtggaggaaggcggcgccaggcgagcgagagagagaggtcttcgtcttcgaggatgaggaggtcggtttcctgttcctcccactcccagtgggccaatgggccttgctgggctgggctaaactgcaagccggcccgatgagatgaacttcaccgcaggagcgcgccaaggccaaggagaagggggtgttgccgttgccgtggtggtcatggtcgtcgtcgtccatcttttttccagtggcggcggaatggccgcagcagtcgcagcctcctcaacagctcttcatcctcggcggcggataaccgaccggcttcctgcaaaagatagcaggcttcatcaataaataaagagaagaagtgatcgttaatacgactcatcaacgcatgcaacgacctcaagtactttgttgacccttgtctcaaatctcaccgactttgccaactatactacttcagatcaggtttgttcatactccatccatatgcatcccatcccgacaggcagaggggcggacaaacataacaaacttaatttgtgacgagtttgttgaacattaattttctcctcttgtttgaatattagtaatggagagcagtaataatcacacaatatatagttcattgacaaatagaacaaaaagtaacactttatataggaatatatc

SEQ ID NO: 50025 - DNA, 220 bp, Oryza sativa
ttgccaatactaggacagtgagtgagtcatttgcatctgcataccctaccttacctgctcctactactgctcgcctcgcttacttactaccctcctgctcctaacaacaacaacaacaactacaacaacaacaaggaagctctatcgggaaagaaataggaggaagaaggattaatgatcgaaagcaaagcaagcattaattaaaggaaattaggaagga

SEQ ID NO: 50026 - DNA, 1501 bp, Oryza sativa
gttagattgaagcagagctacaggcaggaggggcttctcctcgcgcgccgccatggtgcttggcaacgtcgccatcctcgtcggctccggtgagtcactttccgccgtctgctccctcctgaggtccacccgcagccctagctagcttctcgtcgcccagcccagccggttgactttcgacttggagattgatagatagataggagtagatgccacttgcaaccatggcgcagtcatagatagattaccaaaccaatccctcccacttctagggaataccactaccaaatcccaacttatttgctcatcttgtacggagtattttgctttaccagattccaatacatagattgatctagccttttagggccggggccggggtttgtttagttcaactaagctttcgcttcaaaccagaggggaacttattacctgggtatcccactgctacatgaaacaccactgtcaaatcccccccaacttagtggcttccccagtacataggctgatcctgcctttctttttatcttaagtataattacgccttcactaaataactatactagttttactcggtaccaatgtttatgttgtttgcttgcctgcaggaattcttggatcagttcttgtaggtggtgatgccaaactccctagtgccggggaggtactttctggtgctgccaaggtattgtattattgcccctccatgccctaactatcaacccagaatactactgctatattgattatatatcttataactcaccgtcacatgattcctttcccccctagtttgtcaagaagcatggaaacgaagggaaagatacatcgtctaacaccgatacacacaccgctcagctattatctcaggtcaaccatctcagacaggagatacaatctctaggatcaaggcctgttacagttgtcaccaatgctgctagatcaggtaagttcctgctgactagttactatgttttagttacagacttatgcatgggtcacagatcatacaaacataaatttcacatgacactagactttgtgtatgccccgatgtcgacatctcttgctaagaattaatgcgattttagagtgttagatatttctattacctttcgatttttttttcagacttggtctgttgtttttatatctacatgttcgacagagctacaattgcgttgtctgttcatatacagagtataccattttgcgattcagttcacatgttcttttctttttctttccttattattatttgtcatggtcttggctatgcactactgattatcattatattattcgctgcattataaaggttcttggacacgtgatagtttttataattgctaataaactttcatcatgctcttttgcctttaaacatacacaattacatatgtttgcccctctaggttacacacattctttctcaaatgtccttgaacgacattcatgtaaatccttcttctgtaggacctggtacatttactataacagc

SEQ ID NO: 50027 - DNA, 1501 bp, Oryza sativa
ggattgagcattttttttcttactggtaaccgagcaaggcgagcatgcattagtaactgtttagtactgcattgttggcttctccaacaagatgtcttggtgtaaagataagatgtcgaagaactttatggtgtagtagtttcagaagtagatatctgatatcataatgcactattacagtcagtcttaagcattcatggatgtttaagatgttagtctttcagaaatcagaatcacctggatggagtaccttaatttgcctggcttacaatctagaatagtgtttttgcttgtgaaatggtaggtaattatggagacctaagagatggattccatctgtgtaggagttggaacttggatttcttttttgctataatactgtctatgttgctgctaaaaataatccactgcgtgtaatagctacggagtacaaaagcaagcccaatatttttttcagcttgatcaactaggtacaagatggaaagctagtgcatgtgctgtttgcagctaatgtttaagtaatgtatactccattttacacttgtgaaggtctttttaagtgaaatatctgcggctgtcgtgatgcccgtatatacggtcaaatgtattgaatatcagaaagcgaagggtataaagaaatggaggaaaaaagaaggcaagaaagagatgttgcataaacgctctccattaaataattcagctttcatccgtgacgtttcagatgaaagggcagggaaccaaaaggcaggcaaaggtgtgagtgaggctgactagcatttcgcttgctcttatcatcttaagatgatggccggtaaacgttcctgaccagacaaggccccgtgcgaaaattcgatcaatcaatctatgagtggtaacaggaatctatctgatagtatggtatctgtcaagagattagttacttgttgtgcttgtcagcttcatcctctaggtaaagcctgtggtgcattgcatatgtacaaaacctcagcttgaagcttcagttgggaaaacagaatggtataaaacttcagttcagctgggagtacaaacaggtagcgtataaagtagagtagtacacatatacacacacgcagatggagtggttggatggatggatggatcatgagcagtgatgagagacgtactacgcattagcacttgcagtgtcaacgtaaagttgatggcactggcgccttgcaatttccctgtcctgatggactctctgattctacgcttcaacgactttatgcttgatgtggttatccattattataactaaatgttgttgcaacgcctgtgttaatttgtttgcctgtcatacatacatacatacatacatacatacatacatacatacatacatacatacatacatacatgcatatatttttacacttacaccaccgaatactgatcgcgttgatccatttcatggatgattctgagcacacgcctttaaactgtacaactagctaattgaatcagatcgagaacaggccat

SEQ ID NO: 50028 - DNA, 1501 bp, Oryza sativa
cgagggtcaggaaataatgttgtggttcatgaaagatcaaatgtctgtcttttcgtgcatacgcagactaaagttactcctttcccaataccttttgttgctgcatactctctctgtcctaaaaaaaacaaaccctggtttccgtgctcaaagtttgaccgtccgtcttatttgaaaaaattatgaaaaaaattaaaaagacaagtcacgcataaaatattaatcatgttttatcatctaacaacaatgaaaatacaaattataaaaaaaaatcatataagacggacagtcaaagttggacacggaaactcagggtttgccttttttttttttgggacggagggagtatttactaaggccctgtttacatctcaccctaaaattcatcctatcacatcaaacgtttgaacacaaacatgaagtattaaatatatgttaaaaaatagctaattgcacagattgcgactaattgctctatgatttgacaatgtggtgctatagtaaacatttgctaatgatggattaaataagcttaataattcgtctcgtggtttattgatggattctgtaattagtttttttattagtgtccaaacaccccatgcgacatcctatataattcctgatgtgacacgtaaaactttacccctcagttgctctttgtacatcctctggttttggccttatactgggcactgcactaggtagaaagaactagctgatgctacctaagtactacattgcaggcttgcagctgatgaggaaataaccgatgaatttggtggtgtttgaatctcctaaagattaaagattaagtgtttcacgtaaaatgagaggataataacgtgtgattaattaagttttaattattataaacttaaaaatggattaatctgatattttagaacaattttcatataaaaagttttcgcacgaatcacaccgtttagcagtttgaaaagcatgccactttaatccaaaatttaatccaccgttttcaggacattcgaacggggctgttgctagtgttgctgtgacttgacttgcaacaacacagcttaatctgggttaataatactacaatttttaatcaggaaactgggctataataattactagtaaaaaaaataggggagtttatatccaatctttttcttatatgcaattcaagtgatgggactataggcagcaagtactagtgtagtatagtaaacattatggtgggtagatatatatatctccaccgcacattcctcatcgagtggaccttgtggtcagctgcatatccatacttgtatgtagagaagaatgtaatactgctccagtaggcagcatcctctcctctcctatatcatcatcatatccaatccttggttggttggttcgttcacaaggaggaaagcctcgagcatcatcatcagtaggaagaagaagaagaagaagaagaagaagagcaacaggaagaagcaagcaagaagaggaagaagaagaaagcaaggag

SEQ ID NO: 50029 - DNA, 1501 bp, Oryza sativa
aaaacagcaaaaaaaaaattcttgcagtatataatggataaataattttttttaaaaaaatataaaaatgtaaaatcttaaaactagtgcataaactagcattttttttcttctgaaacttatggtaggataaatcaaatattaaccttatatggtgtattttaggtatttttgaaaatagtatagtccgatggtatattgtataataattgataacttaccgatatattatagaaagagacactgtaaataaataaattttaaatagttggattgggacaaatagagttgatttaacagatgcttttggtcccaaaaataaaatatagtacttcccccaatgaagaaggtgtgtgtgattattgtatttcctgtgcacacatatgcaaaaatgccatccattcatcccagtgcaatgccctatctacctatccaatcccaatccacctgagcgagagagagagaaagggtctcctcctcaacatcaacaatggcggtcgcaacctccttcgccacactcgtaagctcactcatccatggcctctgctctcctcttcttccccaccgagctctcaatcttattatcgtcgctctttcttctcttgtgtttgcactgcaggccatcgcgcggccggcggcggagcgggccctcctcgcctccaaaaccccctcgccgctcctctccatccgcaccggcaccggcaccgcacgcctcccctcatcggccgtctttggaggtttcactcctgcgctttccgctgctcacagccgcgcgcgcttcgtctcctccgccaccgctgaccccaaggtactgtgtccccggatcttcttcttttatctgccctacatatatctttctattgccgcaccgcatccattcttgtaatcctgtctagtagtatatcagtcaaatttactactccaccttactggactattattatgcaatcagcctccgcaataccggcccctgtttgttgcctctttggaggaagagatattgggttagcacagatgacctcgaccttccaacaccattaaattaaaactaatactagtaatgcctttgtatgtcaaattttgttatcagatttttaaatcaccaggtgaaatttatgctaccaaaattgcagtttcaggcttatcatcaccaatgctttattatgtattcacctgctctgattaataattttagttgcctcgaccatagggttctgctacttacaggtcttaccttgtatgtgcaccgaatgtaaacacgttattcatcatcagtgactgcctgcaacattgtgaggaaacacgtgtgcccttctgtactactgaaagctgggttttcctttcccatgtgcactatgcgctttcatgttttcctccactagatgttaacttacgatatactacctccttcctttaatatatgacgttggttagttcaattaacatcatacataaaagaacagcgcaagtatcgattattcttaccctatgtgggagaact

SEQ ID NO: 50030 - DNA, 285 bp, Oryza sativa
aagatatgggccgtgtttatatgggcccaagccctaagaggagagtttaggcgacgggacggaaggcttcctcctcctcctcctactcgagactcgacgccgccacctccacctcccgtctcgtctccagaagcttctggaacacccttccggcttcaattcccccctgctcgggtcgggtagctcccttccatcatccatggccgacgccaccgccgccctctcaggtacagtaccatcttccaactcaactgttgacctagtactagtactgaggtctgaggt

SEQ ID NO: 50031 - DNA, 190 bp, Oryza sativa
tatctcatggatgcttgataatatacgttttcctttttttttggtctgagtccaaatacggtattgatttcatcgtgttattatattatggcagatcgatgattccacaaaatgcagctttggaccatataagcacaccttcagaaagtggtgaaatacctttggttataaatgttgaaagtcagcacat

SEQ ID NO: 50032 - DNA, 550 bp, Oryza sativa
aaaaaggggttgggtagcaagggacgtaaaataaactttttcagaaaagacctagctagatggttagggtgagagggacctaggctagactttttaggacaaaggccttttcacaaacaaggaaaacctcttttaaagacttggtaattttctccaaaggagtaaaggaggcgaaaaaaagacaattatgtttataaattaggatttggcaccggcgaaaagggaattcgaaacaaaaaatccagcatgagggaaattcgaaaaatatttttgattattccattttttttgttttcgtattttaaattcaaaatttttagggtgttacaaggttgccgagcgggaggagtgcaacaaggcaatcaggcacaatgggagcacttccaacacgaggtggagaccaccaggacaatgcggggtgaacttgttgatgccctgaagctgacgctccaactgttattcctaggttttcgcgaggaggggggcatgtgggcgtaggtgggacgacttcttccagaggggccgactgttgtgcgatgtttgtcgaagg

SEQ ID NO: 50033 - DNA, 195 bp, Oryza sativa
ggcgcgaggacgaaccgcgagcccgagcgccttcgaccggtacctctacgcccgtggctttgtcgtgacttcactcggtgtgccggtccccggctactgcacggtgagcatccatcctttcccttcccctcccttctccctcttggccgcattcctgccgtgccgccgccgccgtggcgctgtgccgcccgaagg

SEQ ID NO: 50034 - DNA, 1501 bp, Oryza sativa; identical to SEQ ID NO: 50027

SEQ ID NO: 50035 - DNA, 1501 bp, Oryza sativa
cctttaattaatgcttgctttgctttccttccttaatccttcttcctcctatttctttcccgatagagcttccttgttgttgttgttgttgttgttgttgttgttaggagcaggagggtagtaagtaagcgaggcgagcagtagtaggagcaggtaaggtagggtatgcagatgcaaatgactcactcactgtactagtattggcaacgtacgtacagtacagagagaatgaaagagaaagaaggtgaggtgcggttcgtgggagtggatggatggaaagcacagcagagaagagaagagaagcgcaggttattaggctcgaattcgaccggtgcctgctctacactgcaactgcaactgcacttgttgatcatgctttcattgccattccatatttctttctgtaccggttgtatgcggttggtgcggcttcgctttctgttgcacatgctgcttgcgactcattgctaccgtttcctctttctccacataatactcgcagcaaccatctactgctgttacttactatactacttctctattcacatcccatctattaatctatagtattattactatatgtgtatgtattatctgcttatatatctcgttgattgatttcatcctgcacttgcagcgattactttggtcgtcaaagtcatcattttgctgattacccggaattaaggacggactcctgtctatatagcatatatactcctgtcacaataggcagcagtaccatcgctcgtctttatttatttatttttacatttattgataacggacacacaatgaatgaatatatataatttcatgctgagctcaactagcaaactaaactagtaaaaaattaaatgcttcttgcatgcctgagcctgactcagctagtgctcacctaatgacactcgatcttcttttcctttctgaacaagctcaaacgcatttgaagagagcactactgctaattgcgtagtaattgcgtgtgctaattagttgctagtaatagagaggagcacagactgttcgatggtgctatctagctagctgcagcagcaggagctcctccctttttgatgcttggacggattagatagagggaactattacaaccaatctcaagcttgtggctctagtaagtgcttgtgtttcatgtctcgctttcagccttttctttctatggccggaccaaaattgcagcgcaacaggatatacagatcaaacaaatttttttttcttttctttacttttgtgcgttgaaaaagaaaaagaagccgatcaaggtcggatacgaaaccaaaagccacaagtatgtctggaacatatggattgagctatcaagttaagttgtagctggtccaggaggaggagatgaccaaatacaatcgatggagtgacctggatatgctgctgccattcaaaagcagtacctcaatcaataatgcatggacattttcataccagtgcaaaacatagtattcatcatccatatatttttgtc

SEQ ID NO: 50036 - DNA, 1501 bp, Oryza sativa
aaagcacagcagagaagagaagagaagcgcaggttattaggctcgaattcgaccggtgcctgctctacactgcaactgcaactgcacttgttgatcatgctttcattgccattccatatttctttctgtaccggttgtatgcggttggtgcggcttcgctttctgttgcacatgctgcttgcgactcattgctaccgtttcctctttctccacataatactcgcagcaaccatctactgctgttacttactatactacttctctattcacatcccatctattaatctatagtattattactatatgtgtatgtattatctgcttatatatctcgttgattgatttcatcctgcacttgcagcgattactttggtcgtcaaagtcatcattttgctgattacccggaattaaggacggactcctgtctatatagcatatatactcctgtcacaataggcagcagtaccatcgctcgtctttatttatttatttttacatttattgataacggacacacaatgaatgaatatatataatttcatgctgagctcaactagcaaactaaactagtaaaaaattaaatgcttcttgcatgcctgagcctgactcagctagtgctcacctaatgacactcgatcttcttttcctttctgaacaagctcaaacgcatttgaagagagcactactgctaattgcgtagtaattgcgtgtgctaattagttgctagtaatagagaggagcacagactgttcgatggtgctatctagctagctgcagcagcaggagctcctccctttttgatgcttggacggattagatagagggaactattacaaccaatctcaagcttgtggctctagtaagtgcttgtgtttcatgtctcgctttcagccttttctttctatggccggaccaaaattgcagcgcaacaggatatacagatcaaacaaatttttttttcttttctttacttttgtgcgttgaaaaagaaaaagaagccgatcaaggtcggatacgaaaccaaaagccacaagtatgtctggaacatatggattgagctatcaagttaagttgtagctggtccaggaggaggagatgaccaaatacaatcgatggagtgacctggatatgctgctgccattcaaaagcagtacctcaatcaataatgcatggacattttcataccagtgcaaaacatagtattcatcatccatatatttttgtcctttatatatatatatatatatatatatatatatatatatatatatatatatatatatatggtgtgttccatttcattaatcccccccttttatgacgcattcgtggtgatcgacgggtctgtgttgcttcatctgaatgaaatcataactacttaacctttgctctggaaattaagatgaaaattattaagccagttcttaaaccaaatcatcagatagatgaattgatgagagtaaagcaaggaatctttttttggtgcctaggctgcttgcac

SEQ ID NO: 50037 - DNA, 1501 bp, Oryza sativa
ttacaggaccgcctatgatgttagcttgaacgacgactcttggccacaggaggcttttcaacttatctctggaaccacatcaaagattgtggaaaaacttgatccgttagtaacaacacttactagttacttatgctttctcacaccaatatttgccctttgacaatcctttttacctcttgtgctttcagtggtgctactgcttcccacaacttcatcttggagaccaaagtgcagggcaagtttcagggctctcctgccattatcacataccgtgttcccacaaaggccgcacttcaggtacatcaaaattttcatacttacacttcaggtactcatgcaatttgatgcttgtcatatgctttgtttcacaagttaaacttgaattttcgtttcgtgatgctttgtttcacatgccatcacaatcgagtgagtatacctttagtattgagcaccggatgagccttttctaaggactgcagtgtgatcgatctcattattccatggatcatagtgaaaggggctaactttgctcagcttaaatagctcattacgaccctagtacttggtgttctaattatcattttcaccatactattcctgcactattctcttcttgagtttaaactgccaattatttttctcaaggaggcttactcaacgcccatgtttccacttgatattcttgctgagagacctccccaacagaagtttgaattggttagttatctcataccatttgctttcattaagagtaaaacctttcctgattcttatgtctcaacgccttacttttttggtgctggtactcaacttatggatatgcaacttttgcacttgacctttccaggctaaggtactgccattgccctctgttttatgtaaacttatgtgttttatctaagtaggaaataggcgataagaaaagaaaaccatatggctagacattgtgatctaatgtgttaacaaacgtcatctgcagagacttgtggggaaatatgggtcgctggtctccgttgtttcctttgtcggtgtgtttatctacctggttgcaagcccgtcaaaatccactgctgcaaaaggaagcaagaagaggcgctaaatctgttttgttgccttttttttgttgtatttggttttacaagaatgtactctctcaggttttataaggttctcctatgtactctaagggattaactagactaaggcatcatctgtcattttggccttctgtagttgagcatctcgggtgaggcctgagctgactgacttaaaatcagaggtgtagatttgatacatcttaaatcattttagtacattcaaccttttgtgcctggttctcatttcatctcccgtcatgggtcaagggtaagagtgttgtctattgtgattcggatagggcttgaacctagcttcaagcgatgttctcggggagattttgtttgattgctactgtaagcggtaagataatagtgtatgatatggtaagcttagccgtttc

SEQ ID NO: 50038 - DNA, 1501 bp, Oryza sativa
cggatggcctccctcagctcctccgggcagggcccatagaagggcgcgtcgaaggagtcgacgagcctcctgtcgtcggcggcggcctcggcgagcaggtcccagaggtggcagtcgtgcggcgagggcaccgcctcccgcctggccacgaaggtgaggaggaggacgcctccgcggcggacctcctcggcgcggcaggagaggaagaggcggaagtcggcctggaactgagccctgtaggcgtgcagcaccctggagctggagctcgagctcgacgacgccgacacgtacatcctcccctcgttgggcgccgcatctgcgggtgccctagacaggaagtggaggctcgacgacgacaccacgtagtccaggctatccgccgggaacacgcgcccgtagaaggaccccggccacgccgacaccaggcaccggctgctattggcattattgctcggcaccaccagcttctgcttctgccggaacacgctgttgaagtcgttgctggggagatcgttgaggaagacgtggaactctgcaggcgccgcctcctgctgccgctccgcgtcgcccagcatggcctcaacggcgtcgccggccatcagcagcgcgttcggccctgtggcgcacccgaggtcggcgatggctatggctctcgcctgccgccgaccgcgccgaacggccgccgccatctcctgccgctccttcctcgtcgccgcagcgatcgtccgctgcatgtccgagttgttggcgtagctcagctctccggcgtcgccactgttcatgcccaccaccacaacgccgcctgcttcttgcgacgccaccagcagctccattgctccagctgcactctgcatcatctatcatacgcaaaaagaactggttgctgctgctaatagccgcctagctaatcactactcacaacagcatgtgtacatgccagtttaccaccatatatatagccatatagggactgcgtatgcatttatcaatatttttctttcaaaaaatttgacaccatttttctacactgatgaaaacggtcttcctaggcggacggccagtccacctgtaggcaaagacatgcgaaaacaatcagcagccggccgatccgattgggaagatcaattttcctaggtgaacgagagcatgatgtgccgcctacgaaaatgctagtctagctacctggaaaaatattcgcgctaaaatatattttttccccaaaatttttaatattaatttttaatcaataatatttcaattaattaataaataaatacatttaaccactaaatgtatttaactattttcagtttattaatacggatataaataatagtctattaatacggatataatatacatatattgtaagaaaaataattataaatatgtgttaactattttcaatttattttattccttttaacttgtaaaaaaatgtatttgtcttgtatttttgtgaaatgatatattttatattaattatgttaataatttttca

SEQ ID NO: 50039 - DNA, 247 bp, Oryza sativa
ttcctgcagccccgcaggctagaaacacgtaaaaccgacacctttaaataactatagctgccggttctaaagaaaaaccgacacctatagtatatgtcggtttttttaaaaaaaaccagcacctttgatatgttataggtgtcggttaattaaaaaccagcacctcggttttttataataaccggcacctatccaatctgagccgagctgccaagccgacacatcctatatgagccgacgcagccaa

SEQ ID NO: 50040 - DNA, 298 bp, Oryza sativa
tcctgcagccctttccttttaatgtcccggaacctctgtaggctgatcaaccatactggcccttaaattctagagcccctcagttataccacctctgtttctttattatataccgtcgtttttagatagtcacgtaaagaaaaaataggtgcaccctagctatcgttggatttttagagggtccgtatgtcatccatgcaaccccgttctgcatggatgatacgtggaccctctaaaaatctaatgaagagctccacttggcttgatgtgtgtgacgctccttttgactccctctagg

SEQ ID NO: 50041 - DNA, 1501 bp, Oryza sativa
tgccgctgccaccgcccctagtagcaccctggactcgttcttttcgtgtgaccttctccaccgataatggattattggtttggttgtttcgttgtttcgtgtcatcaatttgaggtctagttggatgggtggattggttggttgattagttttcaagagggaatgaggtcttggaagccatggtgccagccgagaaaagaagcgtcgccactgtatcacactactgcaggacagggttatagtaacacgtctttgtgctactatatctccagaaacgtgttactgaggattctagtaacacaactgatatgtgttcttgttggccgtgttactacacatggatccttgtagcacatataagtgttccaattgataagaataggtgttacaagtttttagctaggaacacctttgtttatctcctgtaacacaacgccctgtgttgctacatagtcgagtaaaacaaaattttggcactagtaacacaagtacaaatacaagttctcaagaaagtagtaaaaccatttttaattgtagcagcacattaatagcatgattagcaatatagtttaagaaatcattgcttgttgctgctatatattaaaataattattagaaatctttattatgcaccatacgtttgttgacttattgcttacattgaagtatactgttatatacatctacagggaacatgcacaatacaaaaaccaaattctagtgctcaaatcaaaatatataactatttctatattcttcatgcatctttgcatgccgcttgtcccatggtgacttgatgaggcaatcagctgaacaaccatttcttattgagttcaacttgtcatctacttttaagtgtgcacacacacctcgcatgctatgcaagtacctgtagttgagaaacacgatatttagctattagccattagaaattaatgtgcattataaatattaagcagataaatgaacaaaagcattcagtgcacatcctgttgaatcaaatgataatatctaaggcatgtatagctacagttttaaacattgttttggttaaaatatcacggatgctctgtttctcacaaaatctcaagagtatagtctagaaaacaatcaagaagcctgattgaacaaagaaaagaaaagcttaaaaataaattctagtggtctcagcaacaagaccattgatttccttggaatgagaattaggggtttatttttatcaacattgacttcatgaagtagagatttaagatcatagcagagtatttctaatttgtaatgcaaagcattgaactagttactagttatatgatgtacacaaaattgaattaaaactatttcatgattagagtatacaggccgtaactataccttgatgcatgttttccatatatctgtatataatttgcattacaaacataaatgtttactttatctgaacctctgaattagaacctgaagaaataacagcgctctgaaaaaaaaaatacaaccattagtc

SEQ ID NO: 50042 - DNA, 543 bp, Oryza sativa
ttcctgcagccctaagcaccagcgcgtgaaaaaatatatataaaatctaataagtttatgatattattatcatactagtattattaagacaaatctagatgataacatcttcttgtttaaattaggtgcggagtatgtttgaagttattgatggccaagtaaataaatagttatccgagatatctactcatagagttataattaacaaatggtttatagaaaaaaaattatccatgcagcgtacatggcatataatctagagtaagttaatttggcattagctcaaaatttggagataagcgcgcagtgatcaaatttttggaaggagtgaaattggtttggcgggctttagctgcggcaaagagctgtatagatacgcaaaatcctttgaccgccccttcgtctcccttcaccgactcccaatccccaatgtctgcctaccagcccccttccctcatcgtccttgccgccggttctctcacagacgcgcgcggcaacgcctctacctccccgacgaacacctcggccagatcctcgtgacgc

SEQ ID NO: 50043 - DNA, 1501 bp, Oryza sativa
aaattttgttttactcgactatgtagcaacacagggcgttgtgttacaggagataaacaaaggtgttcctagctaaaaacttgtaacacctattcttatcaattggaacacttatatgtgctacaaggatccatgtgtagtaacacggccaacaagaacacatatcagttgtgttactagaatcctcagtaacacgtttctggagatatagtagcacaaagacgtgttactataaccctgtcctgcagtagtgtgatacagtggcgacgcttcttttctcggctggcaccatggcttccaagacctcattccctcttgaaaactaatcaaccaaccaatccacccatccaactagacctcaaattgatgacacgaaacaacgaaacaaccaaaccaataatccattatcggtggagaaggtcacacgaaaagaacgagtccagggtgctactaggggcggtggcagcggcagatgaggggaggcggtggcggcagcggcagatgaagtagacggaggagccaatcgagccgcgttggcacttggcagaggcggattcaacctggatgcaggggggactatacccaccgtacacatggatacccccctgagttcccccttcaattttttcaccatggatgataaggtagggtgctgaaggtctccggatggctagaggttggagaaaccgcgtattgggccaacgatccgcataattgtgccaggcagccaagggcataaaaattgcctattgcctattgggctttgaactcactcacatagacccacatctagctctctatgctccgcccaacccccaatccccattcccaatggcaaaccctagcttccaaatccaactaatcgaggtagcttaggcaggcaggcagcgagcggcgccgacaagttaacggcgccgtgcacggaatgtgtgacggcgctaccgcacgagcgcgggctggctagcagcaccgcggcgcacagtgccagcgagcgatggcgcattggcgcaaggctgcgagcggcactgcggcagccggcagccaagccgcggagcgtcggagcacgcgacgacacgactgcgcgagcagcaggctgacggcggcgcgatgccgcgagagcacgctagcgggactgcaagaggagcagtgtagcaggctggcggtgccacgggagcgagcagcagcagccagcaggctggtggaggggccggagcgagtagggagcagaatgtcataaaaaacattgttctgttaaacaacatgcatgtattaatgtatatcttgcctaactgatctagctgagatttagattgttagtttagataagatgtatatcctttagatcaaatctgggctagattagaggctatataatcctgtaatctcagcgccgattggtacgccaatataacacgcagccgtcgcaccgaaacaaagggcgacgttcaacccatctcactttcgctgttttacatggtatcagagcgagagaaaaccaatt

SEQ ID NO: 50044 - DNA, 644 bp, Oryza sativa
tggcgcccccaaaaagaccatttcagtggtctatttgcgaaataagtttttcaaaaggacctattaagagtgaaatttggtaagccccgaagacatcatcgacctagagccagtattgtcttcagaatcccggaatcggccgatgagaattatcacgtcgccaatagtcggattccttctatattcggttaaggaaattcatctattaaaggaagcttatccagaagtcaccgagttcaaggaggatgcggcatagcaagctatctattaattaggaatagttttttagtttcctttatctttcagaaagtgtgtttagtgtcttataaatactctaagttttccttttatcttttaggaaagcttctttattttcctacaagtactagtatctccccatggatataaatatgtacacctggggtcattgtaaactatctcgacgatcagtacaatttaagcgcatcgccaccctttttacttttctactttttatcatccgacagaacttggcacctaacgcggggctacatcggctttcgatctccggcgaaggggtaagtcctacgttccgcaggctcaggcaattatatcatctacattggtgtcattcaaggctgcatcagtacatttgacctcttgga

SEQ ID NO: 50045 - DNA, 1501 bp, Oryza sativa
gatggcatagtagggtttcatttgcaaaagcagcatttagcaaacatttgagtatgtaataaaacagttaagtaattaaacaatattgatccaacgctatacaacataccctgttgcataggcccaaccattctgaacaaccatcccggctgtacagttctatctccaaaccaggaatattccattccaaaccaggagctaataaaattattaccaattaaagcatttattatgatgagagggtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccattcctggatcataatcacccccttataaacaaggcatggactccccagcgacccccgtgggcttatctccgccacttctcagtctggtgccccgcaatgaaccatgctatacaaaagataaagccgttgcccacgctggcttgtggctagcacggttaatgtttcacaaccgaaactcgtgaaccggtccttaattgtcatgagcacgactctcaaaaccatgtgctcacaacccaccattaccaggttttagttggcacattaattaattaactaatcacgattgaccatcgtgaactatcattaagccatcattaaataacagtgagtcataagttatcccaatagtgagctaatgtttctaagcagggctaagcaattatatctaatatctagttgaaccaatatacataaagctcaactagtcaaattataataacccaaggtatcaaggaataaagtaatcaagaacaaaagggctataacaaacaataggttaattccacccaatgacattcgaaaataaatgcagtagttgaaaagaaacaatagctttaaacgggatcaacatgctcaaagggttgtttgggatctgtgtgacttgccttgctggccttggaactcttcaaattcttctccgacgaaaacggactctccggaaacgacggaatctaaacagaaaagagaaaaaacaccaaaacagcacataaacaagcatgaacagtacatgtggatatttttaacatgtagatctcaattttagaaaaatttagagacttgaaccaactaaatccgagctaagatgaattagttatgaatttttgaagattaattcggattaaaacacttatattgattttaattgaattatgacgcaataatgaattatttttgaaaaggaaaaagggatttattgcgtcagcggactagggtttcggtggaccgggcgcacggcggcggttcacgcgaacggacggccgagatcgacttgatccaaaacggacgaccgagatcgaacggtccacgaccggctcacgggagagggcgacga

SEQ ID NO: 50046 - DNA, 1501 bp, Oryza sativa
tttaaaaagtatttctgccctgtagagtactgccagttttcccctggcattttctaattgaaagtatgcataggattaattggacttgacatttgctgcagacatttaatggcaagaaatgggagaaattcaatagtgaaaaggtggcgtcgctcgcatacgcccggattcaaggaaggagtgctttgattgctcattttcagaattctagcctgatgaatgaagacaaatggtgtcgacctatgcttttccacaaagatggtccaaatgcaggagatcaggtgtgaatatctctagtgcttattgtatacactaaatataccatatgagtgaccacttctgactgaccctattcgcacaaaatgattgacatggcggttttatacatattattattttctgataaagatacatattattattgcaggagccttttcctgtggggaacaatgtccggtctagggctgggagaaataggtcgctcatcagcttggacactaaagatgcaagtccatcaagctccccagaccaagaaagcaattctgtcggcaccgcgaactcaacttgccgtacgaccttggagcaaacctaatcactaactggagggcacaagaagctgtaatgataaactagggaattcccagttttgctaagtatttatttgactatcagggagccaaagtttgtgacctgtgagtgtaatgatgaatgaaaggctctgccaggcaaggcatcacctccactaaaattatgagagggatcatcagttttgccctgtgtatggatggagctgtgaactggttggtattgtaacggtactactacttcagtagagcaacaagtgtgtgcgtgtgaatgtgattgactctctgagagatgagaactggaagctgtacagttgatgagttgagtagtcgagtctttggttgagattgaccaccgaaagtacattcattctcttctcagattgactgcgccttgattcattcatttcatgtactactagtacatgtgtctctgactcttgtgccccttcttcaccccttgcacatcacacaactgcatggggaaatagtacacgagctgttggagttcattgcacatcaatctcaaaacctgcaaaaaagagtgctgtgcagacctagctaggcaaacttacaagtctaagggcaagttttatagtagtggtgaatacaacctctaatttaaatatatcatctactcattaattaaaaggtaacaagtgcaatatatcacatataatacacaacctctaatattaattcactctcacaccatcttacacttgttttgaaaattgtggagattacccaatgctcattctctcctaacttctctcattcacctcatcccatcccttaatcttatgtggcaaatttaagagctaacatataggagctctaagcagcagattagatgagatggtttacaagacattgcagcaagaaacaaggcaaacaatgatagtgctaggaaaagg

SEQ ID NO: 50047 - DNA, 1501 bp, Oryza sativa
tcaagtttgctaaccttccagtatatagaaaccattccccatggtcctcatcatcgacatacccacccgagagggctaccgactgagcaccatgtgtggattggccagcaataccagccacgtgaggaaaatgggcaccccattgcctgcactcaagtctgtcttcccatgtatccccaactagaacaccaatgcttctcttggggtcattctctgcaagaatggggccaaaatggtcgggtgggatagtaacaaagatctggccacttgaagcattagcttttccagccctcttagccctttcagttgtaaaagccttgtcaggtctatcatcatttcgtatgtaatgatacgcagctgcagagacagctgagttggcattctttgaaaccttagccatacggataacagaaactaatgctgagttgattcttggctgctctgccatttttgctggtatttgtgcccggcatttaccacatgtcctttttccgctgtggatccatttctggaagcacttcaagcaaaagttatggccacatggtgtctgcccaagacaaaagtagaatctgatggttagaaacgctacccaaaaaaaaaagggtccaatgaattgacagaatagcaagaacttttacctacctacaatgcatggatcaaaataagaattatgtgcagaaactggaaggttaaaccaataccccaaaagaacaagacagcacttttaacaatgcaaggtattgcatcaatccagaagaacaagcatgtgatggcaatagaagctagctgtaccacatacaaatgtctagtgactgattaggcagccgcttgggtgatgtaatgagctaggctggcaaggcaggacggtgtaagcctaatcctagagcctaggcaggttacgtggattgcctttttagaatactgtttgcattatcagaattgtacggtggatttggtatgagctaaaacaaacatatctaggcatagtaaatgtgtgcatgtggtgaaaattaggagtgacataccagttggcattaccaaagcaaacaattatcatctagaaagggcatgcaatcgatgtgttcaacaagttaaacttgaattgtaacaagcattgcagtctcaattaatagaaataaagaaatgtaagcatcactctacgaggtgcgtaacatcgatgatctggttcatgataatcagttaagagtggtctggtgggaggatgtaagcctagcacctaagcaggttatgtgggtgcctttttagaagacttgttccgttattggaattcaaatggtagcgtaaataagaaatataagaaatgagtagcaaaagcaaacaatatcatgtagaaatggtacatggtcatttcaactagttagaaaccttaaacgataacaggaaatgcaaattgaaccaacagaaaagaataaatggcagcgtcaactcaaaataagattgacggataatcagggatgatacaactctaatgtaagtaatg

SEQ ID NO: 50048 - DNA, 1501 bp, Oryza sativa
acatcagcaaacactacatctctttcagttgttgctgtccagaaatcaacactggcgcggatcctatcaacagcacctcccatcacacccaggcaactattggcaattctacttagcacataggcgcagcatctcatgttcagcaaagacccacctaacaaaagttgttcggtatccagcctttgctttaagagccccgtaaccgtatcatctgtagaacaatcatcagccatcaccattgataccctccttccaagattccattcgttcaaacaagaagacagagtttcagaaattgcttgagctgtatgcggccatggcacatgtataaagctgcatgtggcaatcaaagcacaataagtttttacattaaaatagtctgaatagaactttggaccgagaaaactgcaactatatttgaaaatatacatacacacatctatgcgctcgaaaaataatgaaaaaggaacacacctcagtagacggcactggaatgtccaggattggtcgataaaatgagctctgacagccacataacctctattttgatcatctgatgtccatatatctgctgttattgcaatccgacctttagcctcccacaaaatttccctggttctgaccctctccgtctcataaatgctgataacatccttcttaagactactgttgggaaccagctggaacaatggttgaagagccctaacaaacctttggaaaccgtaatgctccataatagacaaaggatattcatgcaagataatcattctcgcaagctccatcctggcaacatcctggctaaaggtggagctttctaaagaagcaacagtgggttcctgatcaatatcctttgtacatttggagggagttggcttgctgactttattactcctgcgacgaggacatttgctgagatgatcgtgcaaatgtttggtgccattcttagtgtcccctccgagcctcttatggcaccataggcactcggctttccacttgctgtcgattttcttcctcttgaattctttccacacactcgatgtcagctttctcttactaacatattcttcttcaacagcatgactggaatcaggagcagcagttgagtttttggcagctccaagacccagagggatgtcatctttcataaccaactctgaattctgcaaagtagaacaggcaacaggggtagtgagaaacaaatggcagtagaaagatgataattctccctggattttctttttcacttgggctaatttctcatctctatctctactattataaaaattcaagatgtttttgcggtactttggtacgtcatccgtgtatgagtcggtttttaagttcgtttgcttttggaaatacatattcgtatttgaataggtttttaagttcgttcgcttttggaaatacagaaggagtcgtataagaaatccttttttttaaaaaaatcgcatgctaacttacacggttggactcctaactacagctcatgatttttgta

SEQ ID NO: 50049 - DNA, 1501 bp, Oryza sativa
ggtaataaaccatgttcctccgtcgccggcatccgccctctcggtattcttctgtcgtgtgcgcatagagacaaatgagaaggccaccatggagcagctttgctgcccggggtatgtgtctcacacatcctcgacactaagttcgtggtctctttggttccaccgaaaataataaaataatatctcgggagtccaacagctaattaccatatttttaccgtgtctacgagaagatacacgttctttgaatgtttcacaataaagaaattttaccatataataaaaatagaaccccatatttagaaacacgtgatgccccgttttgacagtaatggatccccccaaatccactcacctccaacagttggttccccatctccatcatctgtggggagagagcccgagaaatttagggttgagaggtgagtggcggcggaaggaatccacaagttgcaagggtgtggaggcggaggagtggcctcgattggggatcggaggtggtgaatctcggtggagaggcacaatccaaggcgataagcgtcgatttgcaagggtggttcgtgggcgaatggcgaatcaagggcatccaggcggagggtggcgtcggcgtccagccgtggtgaggaaggtcgccctcccgcagtggcgcaccaggggggctcctcgcaagctgggagtgagcaatccaccaaggctggaggtggagagatgaggggccagatgaacaaaggggggaagctgcagcaatatcgtccagttcagaaggagaagaatcaaactgaagagaagattgcgacatctgcagtgactcctcagactgcaacccagcaaccaactccaccacccaattctcgcactggtatgcaaactaacccacagagaattttctgccacagatgcaaaggttttggccacatggctagggattgtagcaatgttgtcttctgtataaattgtgccaaacccacacataggacagaggattgcatctatgacaagcagccgaggcctatggcaaagctagtagggtatggtgctccaggtttaggttgcatcttaattcaaaacactaagcctgacccacctaaggagcataataatcctctggctatgatctctactgtctttggtggagaattgacagaagctcaacttgagcaaggtttcacgcaacaatttaagtggaattgggtttggaaagctaaagcaatgcctaatggaagctttcagatgagatttcgtaacaagataaagtttgatgagcttgcaaactttgattatttcaatgtcaagggcactgatgtgcaagttaatgtgaaagaatggacccagaaatctgaagcagttgggaagttgcatattgtctgggtcaaaatcactggaattcctgaggaaatgaagggttaccaagctttgtatgaaattgggtcaaatctagggcctgtcttggaggttgatatggctactttcagagctagcaatgtgatcagggcaaaagttg

SEQ ID NO: 50050 - DNA, 1501 bp, Oryza sativa
ttgtatgaaattgggtcaaatctagggcctgtcttggaggttgatatggctactttcagagctagcaatgtgatcagggcaaaagttggaatgatggagctgggtgttctgcctttgaaactagtgttaacttctcccaagggacttttgttccaagctcatttcagtctagaggaggtggtggaactggggtggtttagtgatcagctagatgacacttttgagaaaattgagatacaagaaaatactctggagggtagcagtcagagagagggtaagcaagttgtggtggtggatcccatgacagaagatcaccatgtcagtaagacgggtaacgggctattgaagtttgtcagaagcaagtcctggtgccagaattgatgctgggagaacataagatcaaatgtgcacagatcttgagagacatggagttggcaatgcaactgcagaaaggagactgtattctgactcagtgctgtgaaggaaggaaagaggttgggaaaaaggaaatgtcacaggagcaggttgatactctgcagcaaccgatgaatcaaaagttggctgaagaattagaaagctcttagacagatgttccaggggataaggagaatagagtcagttttgatatgggtttgaatcaagaagacaaggacaaagtagatccgggggacagtgaagattacatggattctcaggagtctaagggaagttttgctaagaggttggggattaatctaactgaagaagctcttggaagtcaagatgaagagatgaggagaagcaagagactgaaagacaaggaagataagaggtcccaagagatggcaatggaaaggaaagaagcacaaaatgctttcatcaataaaaattccctccttcatacatgaatcaaatgtctctttaattgatattgctagtgttttaggggtcaatctgggttgtgctgttgatgatatagcctctaatattaatctgattagagacttagagatggccagaattaacctctttctgaaagagggaacaaattctgaaggtcaacattgtcttgattcctttgagaattcaaatcctgatttaaatgttttttctgatgatttggattctgaaactaatgatgaggattttaaagaaattgagcatgtgcttaaacagattcaatcttcagctagaaaaatgaaacagagaaaggggaaccttgagattttcaaggtaacccccaaagttgtcaggaaaagaaaaaagaaaactaaagattaatgaagggcctcttttggaatattagagggatgggaaatccagaaaaaataggtcatcttcaagaccttgttaaagatttaaaattagattttgtaggtattttagaaaccataaagcagaactttactgctagtatgttacagagcttgagtggtaagagaaatatgaagtggacttggcttccaccttgtggtagatctggaggtatcctggtgggagtaaatgaggataagttctctat

SEQ ID NO: 50051 - DNA, 1501 bp, Oryza sativa
gagtttcggttgtgaaacattaaccgtgctagccacaagccagcgtgggcaacggctttatcttttgtatagcatggttcattgcggggcaccagactgagaagtggcggagataagcccacgggggtcgctggggagtccatgccttgtttataagggggtgattatgatccaggaatggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcaccctctcatcataataaatgctttaattggtaataattttattagctcctggtttggaatggaatattcctggtttggagatagaactgtacagccgggatggttgttcagaatggttgggcctatgcaacagggtatgttgtatagcgttggatcaatattgtttaattacttaactgttttattacatactcaaatgtttgctaaatgctgcttttgcaaatgaaaccctactatgccatcctttgttatcctgtgcacttgcatatttgctgcgtggcttgctgagtatgtcatatactcaccttgcaatcattcatcagaggaatagttctacagtgaagctgatggtgtggaggattaggtgtagccttggtcaagctgcctgtggagtggagccgtctgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagccaggttgaccctaggttatgccaaatggttatccatagaagccctctaaaaatattggaaaagtagaactgttctcctccctttctcttttaattaaactaaactaatggcacatgcacttcataatctcttttaatggttctcattcaaaatttattccagtgttattagtactgtacatctattaccgtactaatggctcattttaccagcaaaagttttacaatattgctttatttaatcttgctgcaacaaaataaatttagcatgttgattttataactttctttcatttcttttgaaatctgttattcaaaagtacaaaacttgtgaccttgtttccaactgtttcaacttatcttgcaagcttggtttactttatttacttacctttttactttgatttctaaactttattcaaattaatccaaaaacttgtgctattaattggataaatgtcttaactccctcctttcacttgtctttaga

SEQ ID NO: 50052 - DNA, 376 bp, Oryza sativa
aagaatccaagcgcaaccattccaagattgagtgggtagctacccaagatgatgaagacgagccgaacgagccttcaatcgacctccgatgctcggaagaactagagtgacttgttaagtcattgtcttagatcgttgtgttagtttgcttgttttaagtttgcttgtgtgtgtctcgcatgtgatttacatcaggggtgggatgtaagtgcatgcgtttgtttgctttcgagtgttaggtagttggtgagtttagtggtgtgagagtcttcagtttgtaataatgaaactcagttaagatcaataaaagttaaagtaattctctgtcctaagtagtttcccccggtttctcttcttgtgccctgcccatgccaga

SEQ ID NO: 50053 - DNA, 525 bp, Oryza sativa
aaaagaaaaaaaaagaaaaagcggcgtcaggacgacggatcggcgcctcggcggcggctgcggttgatacggaggagatcgcggcagcggttgagacttgagaggaaggcggacggatcaagacaccgctcggccgttttcttttcgctgattccggatcgcatcgatcgagtcgcgcgacggtggtgtgcggactgcggaggaggagcgcgtagttccgattttctgatccacacatgtgcttacatgcaaaaatttcgcgattcccagcgacacgaaatattaacagaattcatttggtttagataagccatacgcgtgcgacggcgccgaatctatccaccaagataattaaactaatctccagattatttctcatccaagcctgcttccctcctctataaattgactccaccccggccgaggtttcctcacccatctcatcaacgccttcttgctctctatctctctctttttcggcatccttcttagtattggcaaaagctcgttgtcgtgctccggcca

SEQ ID NO: 50054 - DNA, 526 bp, Oryza sativa
ggcaatcctaattaagcaattggtctctctgggctgccattaattaatctcatcctgaagcctatgttctattcttatattcttagtagtatcttgaacacaaaattcagatagaacttcactaatttctttttgttctatagctactagagttgactggttgagataggagctttaagtgaataggttccttctcagttcttacgatatgtacgtagttaattagtatctctacatcacaatcttcttggttgagtcattcctcttgcagtcttaacactaacagatgacgtgctctttaatttataggggacatataagatattataaacttaaatagtttcaatatttgatgtattccttgtatagcgtttatactattcaattatcaccaaacgttactttgtgcttaatgatgtcttaaagttcaacattttttcctatttaaaataaaaaaaatattttacatatatatttactagctactagtattgtagggccctttatttttgtctcgtactaggcc

SEQ ID NO: 50055 - DNA, 1501 bp, Oryza sativa
caagtttgacattggcaacagcccaaacaaaaacatagccacataatttatccatctcgtctccccataagtcttgaactatcataagaatattaagtagtgaatgaattaattagtagattagaattagtttattcacggagaaaaacaggctttatacacacaaagtagctgtcttcttattattcaccacacaaaattaacaacagagctgagagacatttacaaaacatcatacagatcatcagttaattaacaagcaaattaaagcagagccacaatccagagacaagcatgcatgcagctatatatccagccaaagagctctcctacttcatgaaaccctgcgccatcttgaacagcccaccggcggcgccgccgctgccggcgctctcctccccgccgcccttcttctccatcagcgactcggcccccttcatgacgtcgtcgagaccgaacccttccgacgacgacggtggcttgccttcctccttctcagccggcgcaggctccttgggcggctcctccgccgctggcttcggcgctgcggcgtctccggctgccggcggtggcggtgcggcgccgccactgccggagctgaagtccttgaggtacccctccgccttgtcgatgtactgcccgaccggcttgtcgtcgagcttgccgtaggtggacgccgagtgcagcaggtccgcggcggcgccggcgacctccttcttgtcgacgccctccacgctcttctgctggaacaccgacatggtcgcctccgcgaccaccttgccgctcgccatcaggtcgccggagccggacttgttctcctccgccattgagcaaagcttacacagttatacactccaagattttttttgcagcgttaagttcagagcgggagcgagaagcagtgtgcagagagagtgaggatgatacgagccatccttatagatggatgagatagaagaagatggagacgtgatttggacatgaggcaaagctgccccttgtgtggatggatttggatatgaaggaacaaaatatctaagattaaactagtatcttatgttagcactaatgagatgagggaaatttatgtggttcttgtttaattcagtggtgcaatttgggttgtacaaaaagaaataatggtgcataaattaaatctcattgattgattgatggaaacttgggtggagtttactttggagattttttttttcaagctagctaggtcataaaggagaagatatgggaatcagttgatgatttctgggccataattgcaagtgaatttaaacaagaagcatgttggcagcagggtgggcacacatttgtccaactttcctgtgacctgtgggtaccaagtgatggttacctggtgaccccttcatggactgtcggcagagtctaatactctaatggcacgggtaactctcttctttaattaatttatgatagctatctgtgtcaaacctttttcatttgtaaacaagataatctccaatac

SEQ ID NO: 50056 - DNA, 463 bp, Oryza sativa
cctatacagccaggtcaagctataactaggcgtcgagactaagccgatggtcaaatcaatggccttagccgattcgacatagcccttggtgccaggttatagcagggcttgcctgtataggtagcagatacacatgcaacgatttaagaaacaagcatatcagataagatcggtgaaaccccgatactacccctagaactgaccaaaaacaggctatacccctatggttctaatcacgacttagcagatcaaacctaactgatgtagcactaagtatgaaaagaaacacaagatatagacaatcaagctgtcggtcagtagtcagggttgtagataccctggctaatctaatatggtaggacgatttagccgataccagcatcaaccctaaagcgaatatcagccgatacgggtaaattgggctaccaagctagattagacaggatataagataaaaccaagc

SEQ ID NO: 50057 - DNA, 1501 bp, Oryza sativa
tcagtaaaagcattttcgatttcctgaggattgtgtctatgctatcgtttccttttgaagaatcttggcttgaattagcacgctcgtgcccgaccctgccctcggtggcccgggccggctaaaatcgccaaacggggcccagaaccgagccgtgccccggggcgtggtgaactccggggggggggggaatcggcaaaggcccacaatcgggtcatccataaccctcggtcaccacgctcccggcctggccagtctcgacacgcggatctccccaggcactagccccgacccgcgccacttgaggttgggacctgggcacgagccctcgttcaagccaagacacagaaggaccgcggcacggaccatcctcgtctcatacacacaacaaacttaactgacgcagaaatttcctctttacttgattacagattaaatcagtctatacaagaagggggcccgaaggcctcggaagaagaaggaaaagttattaagattggcgggggcctgggggctcactccgacgcccccgggccgtcggcctcgtcgtcgctgtcgtccgcgccgtcgtcaccgccctcctcgtcggagtcgagcgcgaacgcgagtcgaggggctgtaccctcgaagctgtggacgatgtggtcggcggcgtcccggaccctcgcacgtgcgccatcctcggttccgggagggaactcttccagcgctgcccacggggagaagtcagggttcctggcctggtagcttgccagtgcgagctccaccgccccccgggcgaggtccctcgaggatgacttgatcgcctcctcgagctcctcggggagccgctggagggtcccggccatctctgagaggcgctgggcgaggcccccctggttggcggcgtatttcatggtccgcccgccccagaggcccacctgccgcccggcacggtctagacgggagacggcgtcccgaagcatgccaggccctacctcgcccgccaagcggagggcttcgacctccccggcggacgagtccagcgcgccctgcagctcggtgatggtgtgttcggcggctgcgaggcgggcggctaggtcgccgtcgcccgcggccgccccaccgctgcacgctctcgcgtccagctccttcgctcgcgcctcgaattcagcggcccgctgatccagtgcggccctctcggcgcgggcgccttccagattgaggcgcgccagctcctcccgccgctgcgccgcagcctcggcctcctcgagagctcgctcctgctcagtgagctcgtcctcgcggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccgcctggctcccgt

SEQ ID NO: 50058 - DNA, 1501 bp, Oryza sativa
agtcggccacgtcatccagccaacgtcgggctggagtctctggatcggggacgacgggcgggtgacgcaagagcgcgcccgcagcttggagcgtgccctggggcgtgctgccatcgccgtagacgaggaggcgacgctccccgtctcgccgtccttcttcatcgctcgtgggcggcgaagtcgcggatctttcgaccccctcgagcgcctcctcccgcctaagacttcggcgagaggggggcggtggagtacgagctcgacggcgcgggttctgctccccgtcgtcaccgctagcgctcggagagaggttgtgcgccactgcccgttcggccattgggctgagcgggagaagcttggcgcacacgaaagaggacgagggcttagaaaaacacacgcgccccctacctggcgcgccagatgacggagcgtggggctcctcaccgggagaccgcgcgggcccccctttgccggttcggccgggggcgctaggtgaggttctaagcactcgatctatggaatgtttcgtgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtcctccttttatatctcaaggggatcccacctgcaccacttctacctactcttcttttgggtggggactcaccctatcttcccaaaaaagaaaaaactagcttgcgccttcgcctggaagctaaatcacagcttgtctttgagtgaggcccagcgtcatcactcgcctgacaccggggatctccctgttactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcatagaggctctcatcattccgacgggacggggcgaggcgtgcgaaaggccgcctgttgccacctaacccgcgatctgaccggtctatgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagg

SEQ ID NO: 50059 - DNA, 1501 bp, Oryza sativa
aagatttcggcaatactaaaaggggtggctatcaagctggaaaagtggatgggtttagagacaagaaattttatacaggtttaggccttcttaataagaagtaataccctacttctgtctagggattgatccgccgagtgtattattgatcgtataatctgggagaaaaatcgtgccccaagaggcacccagaccccttcttatatagaggaaggagtccgtattataaagtacagcccatattcctaacggaataagcagttatagataaaacacaatcgtaaccgactaaaatcccgggtgcttccttgatatacaagtttatgaatttaacccgaaaccctttaaagatattctatttatacatggtacccccatacccagtcggatatacatgctgtgtgggtatggggtatccataatcttcacagtatctcctgagacctttatagtcgatgaaatagtcttttcttgtaatctctaaaacaataatccaagtgctttaatttctcctgccttggtctcccgagtactgaaattaaaaaccatgaagggctgaaaataaaaaatcaggtgcatcgactagatacacctaattaggtgtagcccccgactatgtgattagttgaataaaaactaaacatatagtcaaggcacatgaaatatccatccgagtggttttacaaccgaatcaccaaggtgactgtataattaagctcaggcgacatctaaaacgcattctgctgactgctttagctataatgcgcccaaaaagaaacccgagtgaaaaaacactctaaaggtccataaaccaacatatgcgataataattcgagtaaaaaactcttaaaggattcatcgactgttgtatagaaaacgacaaatgacaagtcaaaatagcctaagccatgacttatgtcgttatcaaaataagcatataacatgctgagagaatggccataaaaaagtagccatctcaataaaatccaaacaactttgttgcctaaaaagaccaacaaaattagcattacacttttctgtcgagcacattttcattccgcattgtagagattccaaagaatcatctagctgcatcaaaaaggatttttgcggcattgggctattctgttgtgagaaatttttaccaaggcaaaaatatatgcttaagtccctaaggagtacaaccaaccacgtcaataataaagttgggctgaaagtactatgcaggcccaggcccattagtaccttccgataccctagcgaaataatcgctaaaacagagcgccacttcgtcttccctgccgtggtctcctccattttccccactcctcgctacagtgaaaaaactgcgacggcaaaaactagggttctcaaatccgcaccaatccactttgccgaggctttacagctcctgcgaaaatcttccgcgcaacctccgcatcaatctcccatccattcctagccatttcctcatcaaatcgcatcatccatattgcatcca

SEQ ID NO: 50060 - DNA, 1501 bp, Oryza sativa
gtaacatcattagtctgattttttttcctttcttcgggtaattagccatatcacgttgagttgctttttttacttttcaaatataatttaaggttttcaattaaaactagctgtgtggcccgcgcaattgcgtggctagcacccatataaaattatatttttttaacatgattttacttaaaatttcttaaatagttatctcgttgtcttaagattttaaaagaacaaaccttatcattctcgtgtttataattttataattttgtaatttttagaagtcccgtcaaacgcttccattatactcctctatgaccgtccactgcatcttctctttattatcattactccctccgtcccattttaattgcaaccataagttttcgcgcccaactttgatcgtccgtcttatttgaattttttataattagtatttttgttgttatgagatgataaaacatgaatagtactttactcgtgactaatgtttttattttttttttaaaaaatgtcaaataagatagacggtcaaaattaggtgcggaaaactatggctgcatttaaaatgggatggagggagtattattttaaaaatcgaacataattatcgtttaggtttatttttttacttctagaattccaccaaaacgtcagcaactttgtcactatactcctctgtggctcgcccgctgccgcccttctttattgtcattgagattttaaaatcaaacatgattatcattggggtttatttttttactttttagaagcccaaacctttaaaaattagaccttatactttttagagtttattgtctcgttgggtttcattttttcttataatttatagaaatcccgtcaaacggtgccactatactcctctacgacccgtccgccgcatactctttattctcattgggattgtaaaatcgagcatagctatcattggaattcatttttttactttctagaagacccaccagccatcagcggctctgccattgtactcctatatgacccgtccgctgcctctcattttttttttgtaattgagattttaaaaaataaaatatgattttcattggggtttattttttaactttctagaagtctcgccaaccgccttgaccgattacttcacgacatgcccgtcgtccttccttttaatcatcattaggattttatttggtgatttattaatagtttttagatgtcccatcaaccgccaccactctgttcctattagagtggttcctatataggcctgttacttaattaatctcgttatgtgttttagatggtattttctttcaatggtctttacttttttatcaccaatttcagaatttattttatttttcttattgtgttcttttgttatttttattttttattttcataagctgtttcaaaattgtattcctactttaactctctttttcatttgcctgattttagattttattttattttttattccaaatttaattcatctactattggg

SEQ ID NO: 50061 - DNA, 1501 bp, Oryza sativa
tctgaacttgtttgcgcctccttttcccatgccaggtacttgtaaaggttcttaagagtagccagctagttggcaagcagtagccagattatctctcatatttagcaagcggaatgtgcaatattttgatttggtgttgcagtggccagttggataatattgcgaaacgatatgtctgcacaaatggcacagtcaggccagaaagattttgacaatttgctagctaatgtagtgccaattacacatactcagattgtaagtagggccaattcagtcatctttctgattgtagcctgatgcatgccacctccttttaccagttattgttgaataggtagtattcacatgatggtcaaatagtgcagtgatctttctagcctccaaaatccaaaataaatatctgttgggttgcctcttattgatttagctgatcttgccttcaactccatctacaaaccaataatttaacatgaataataatgaagagataatgcccgtgcacactaatatgaaattgttgaattttccttcgaataaattctcggaaaaaaaggggggaaaacttggaaaatgagcgaatgagcaataagcactgggatgcaaaatactgtatttgataagattgaccagaaatatattatttcactaaaaaccataaattccactataagcatataggattcaacagagaaaatactggctgcatccaaaagtcaacctggaaatagttctcttggtgcttatataacctcagattctcagtacatcagcgcacagctgaaatattcaaatcacaattaatccatatttccaaacattagttataccattgtgcattctgctcaagcagttagctttcaacagcacacacatgcctaatttaatttgtgccagtattaaaaaagtacatggcaacagctaaattattgtctttgtgaccaacttatgtaagctgattgatacttggtttgtccgttggccccaaatctcataaaaatgaaaacactgtttgctcttggtctgttgtcctgtgcaaatttgaagagtggcaagaagtgatttgggatgggaatgacttggtacttgtagttgagggataatgcatcttgaaggaagaaagctctagagacctagaatatttgttattgagcatcgcttgggttggttgtagtggggttgtttccttgaccccttctttgtacatatatttgctttcttaatgaaatgaaacagagctctcctgtgttttcgagaaaaaaagacctagaatatttgtagaagtaccagattgttagacagataaaaagagattgatgatgtggagcattggaataactagttttgcactaatatctataatgattcctcatttttctctgatggcaaaaggaaaggaaccatagctaacctgcacattatttcccttttgttccatttttttcctgcaatgctttctttcccaagatcataccaattcttcacatggaatgattgaaatatg

SEQ ID NO: 50062 - DNA, 1501 bp, Oryza sativa
tattggtttaatagttcagtaatcctgcaaatgtggtaaaaaaaagcgtagtggagaatttgttgttgtagatcttgtgaattgatgctttaattgtgagtttggcctatcatattagtttcattgttttagagagagtcctagcatattagttgattcatacaaaatacctcggtgatgttcagggaacttatttattaatgtttcatttgctggatgctttacagtcgcatctcctaaagctatcagtgtatctgtaacttatgcatggcatagtagaaaaaggcgtttctccatgatttgccatcaaccaagcaaagcaatttgtacacttataacgtgatgatatgcacattatggtttgaaggaacgcctctatgatttctacaggaaatttcttttatgctttttattcatgttttggagaaaatactttacgttttttttttcaataattacgtaatgcgttgatctaacttgaaattttcctgtttctaggaagacactgtcagcaagaaaagtgagcgcaactaggggagctgcctctgtgcctgacgaagtattccacagagcccaggggattcagctatgcaacatacaggcgtaccagtgcactcctgcattcttcgccgattcgtaccagctcaaccagttctcctcagaagtcgtagctagccggcttccagttccaccgtccgcgagggtcatttccgagaggcacatcatctccgtcgtgcctgtgatccgtgtcacaatggctcatcgcaagcaatgtttcagcttctacgtcgtcggctacaatagggatgttttcataagagattatccttcgaaattctgctggggcctctgctgttgctttgagtggctgcggaactagttatttcttgccatgtgacaaaaatcgagtgtgcagtattttatagtattacatacggagtaaggcttgtgtataattatagcaaaaccgaagattaaagagggttgaatgaataagcataaccctgtgtgttatgcattttttacattacagaagctgtatcctcgtattctattactagggcttcgtccatgtagatcatatctgtaacaactgctcgggcatgaatcaaatcagttgtgaagactttcccttagacaattgtgtcggtgttttaattctggcattgaaattttcagatgaaattttaaaataatttgctgaaagcataaaaagaaacgtacgtgcaaatcaattttaaatataaacattttgattttttttatcacaccatagcggcgacgcggcgtgagtctaaactccaaacccatgccacggacggcacaattctttcaagatgcgtaaagtactaaagtgtgaggcttagaaacaggttatggtattctttatttttaaatcatttttagagaaatggttcaaagattagagacgatcagaatttcatattggattttggacagtttcaatccctaatgccaaattgaggacagtttcaacggc

SEQ ID NO: 50063 - DNA, 1501 bp, Oryza sativa
atttcaattctcacagggtgttccagtggcaatattaacgaaatctggtagatcgacgttctcacaagatgtttcagccgcaagagccacagcttcccgtggattcaaggaatgtgttgaacgacccacttgctttgttggtagacagcccatcataaaaatccacacccagcagcttgaatccaaaaatgaagccgagcgcaaatcttaagcacaagacagctagtacaattcaaggagatggagcagcgaccctgtaagctgtacatgcaaataaaacagcaataagaacagaacaagaagggaatataggggtgcattacgaatatacagcaacaaagatgttcctaactgtggccggtgttctttgccggcccggcgaaaaaaagatgttcctaactgcttatatccttcaggaaattacaggtggcaatcttttactgttaaacctacagtctcttaagatagttcagcagtgcatatatgatacatagtacaacatactgttactgttaaatactatatagtatcttaagtctaaaacaaagttcaacagtgtgatttatattgtcaaacactacagtgttttaagtcagttcagccgtatatgattctccatatactggattaacatttcaagccgtggccaaacatgtaaatggattgtaatttgcaagattgttcatggtacttggaagggaacaaacaaataaaactacaaaaaagaaaaaaaaaagcaatctcaattcagttgaacagtgtatgatatatataatagagtaaatattttagagatgttaagttcatgaccagacatgtagattgcttgtaaaaactgttcacggtaatcgggaaggaacaaaaaataaaaattaccaaaaagaaaaaaaaatcccattctgaaccaactgtttaagaaaggaacatttttttgtttttgggccccagttgtgcatcgattgtccgaattatataacgccgtcagaatattcctcagattggtcaacccctcaactcaaatgggcggctcggcgcctcccaccagcctataagatcaatgcggaagagcacgatttccgcaggataaatcaagaaacggtagcactacccgaatgaccaaatccaccgagaagacgagaaacggagctctccactccactccatcaggggagaaatggatgatttttttttaaaaaaaaaggaaaaagaaacggaggagttcgaggaagacgaaatcaccatacctgccgccggaggagatggattcttgggcgcgattgcagctcagcgccggcagttcctcttcttccggatttctccgtcgtcgtctccggccgccgcttgttatatccttcgcttctagcagcagcgcctgcttctgtatctgtacttcgataatcctcttgtcgattgacttgcagaaaatgacacgacatcgctgtagcgaataggggagatggcgtcaggggaagggaaagagacggcttttactttccgcctc

SEQ ID NO: 50064 - DNA, 1501 bp, Oryza sativa
tctaacagataaatactctagacgatccattgcagtgatggtaaaattgtcctaaaaaaagttaagactaaaaaatcaatcccaatgcatctgtgccctaagattgacagttaaaaaacaaccaccatacttccacctttactataaaatcaacaaaatcaatccctatgcatgcaggacctaacaatcccaacacaaaaatcaacctcccccatattcccacttactccacctttctgcactataataacaatcccaacgcatctgactaatatctagcaagaactgctcaaaaaaatatcaatccatcccacactccaactacttcaccaaaaaatccacacttcaaatcgagctaaatcacatacctcaaatgcccggtttcttccagcctagttcatcccagccgccttgcaatgcgccgctgtggtcgcagtggagctcgccggcctcgacgccgtggccgccttggagcgcgctacccccacccgcctagagcgccgcctagccccgccgcacccagcctcgccgaagtcgccggaatcgccgcccgttctagggtttcggggagaaaggggaaattttgcgagagagagagagagagcgctccgctgttatatagtgaccccgtgctaacgtgtcgtccccttgccacgctgtactgccacgtgtacgaagaccggtcaaaaccacccctaattctgccttaggaggttaagtaaccggttttgatagttgagggtgaattatgtccggttttcgactttagggggtatttcagacaaccgctatagttcgggggggtatttcgtactttttcctttgggggactgggttagctgcagagggtgctttgcctactacttgggaagaacttaaggtagctatgcgtgataaatttgttcctccatcatatcatatagatttacacaagaaacagatgtatttagaacaagggaataaatatgtacaggattactatggtgagctacaaaagggatagatacgatgtagcatagtagagggaaccgaggattctatttgtcacttttacatgggattgaggtgcgatattcgggacatagtagataataaggaatttaacactgtcaactagttgtttcagttttcaatgcttgcagagaaggaattgcaggggcgtgatcaacagatcaagaacaaggcgagcacgtacacgccacgggcgaagccatcttcgaggctttccaagcccatctctttttgggcacccccaccaacgagcaagcgaccagttacgtccggagtttctgtagcgctaaaaccacctcccccacgacctgcagttttaggtaaaggttcttcgcaggtatccaccaagagtgcctcatctgtcatttcgacgggacgcacgcccaagattcagtgccaccactgccatggatttggccatgtgcagaaggtttgccctagtcaacgggcatacgttgctacggaagatggctacatcagcacctccgac

SEQ ID NO: 50065 - DNA, 519 bp, Oryza sativa
agggcacaaagaatattacaaaatattctcggccaatgatttttaaaggaaatttttaattccctcaataattcacttggataaattgcttaactttttatttaatttctaggaaatgcattattaaatgatttttaatcccgaacgataatcggggcgttacatacctacatgatgatgaagatgccaggacctcgaggaatcatatctctgcggagcaacatcaagcaagccgttacctgcgacaaggaaagctgcgagatgcccagacacgtgagatcacgctcgctcgagaggagatccgactggctgcatcaacagcaaccgaaggagaagtgcctgcgcccaagatatcaaagagcggagaaagcgatgccaagactaagaaaattcctcttgatccctttgatcccactaagactgctgtaataggcgccgagttagattgtaaataggaaagcacgctcatcacctttcttcaaactaataaagatatttttgcgtggaaaccatctgata

SEQ ID NO: 50066 - DNA, 1501 bp, Oryza sativa
gcacgctctcaaatggcgggatggggaacggtgtaagggctcaaccggtctccgactccgatgaggagttggggccgtcggcctaactctagccagcaaaccgccggtcgacatgggggatgcggcggcggcggacggtggatggcggcggcgggcagtagagacggcggtggtgggcggcggcggaaatagaggcaacagtggtggcgtttcagggggagaaggtggcggcggaaattggatcggcattggatgagaaaggtggcggtggaaacggcggctaaagtgatggaggaggaggcggcgaaatggcggcggctgcagaagaggtggaggaggcgtggccaatcggcggcggcggcggtgcacaccgcgaggggaacggttagggttctaaccctaacacccccacgcccccctgcgcccttttcccctcggacccgatgggccagccgcacagtagcggtggtgggccgaatcctattgatttcggctcaccacccatttaccgtttattttttttagtttttattttctaatttagcagcattttcttattagttcctatatctttgataatttagtacaagcagttcatcagttgtacaaattactatgtactggtcctgtagaccactgatgttatatgttacttaacataggtgtttatttaaataccctgcttcactaaatttatttgttgtcttaataatatgccttttgcatactatttcaagacacactctactttctcgcttcattaatttacaaaattctataagttttgtactttgatttagcaaattctcttaattatgtacaacatgattaatggaggatttaatgcatgttccacttcacattttgactcggacattaatcacatgtagatggagtcctatactttggtcatattgaccataacttaggcagcgagtatctcgcccatcatcaagtgatctacattttgagatgattacccgatggagtcctacaaattggccgcactggtcataacctaggcagcgagcatctcgcccatctcacagaggtcaacatctcacgatgattacccacatgtgttactttccgagaatatgttttgaaaaatgagattatttgaaatttggttgagcacaaggtagtggagtcctaaacatcggctgcggtatattcaccagaatatatttgcctggagaccgtgttttaggcagcaagtattacttgcccactattaagatatctactccactatttaattatttggagattatccacattgtgccacctaattttgaattctaactcaaattgtcaggtctatagcctacatcttttcgaaacattacaaaatatgaagtcttacattacgcattgagattacaacctcaatatcatgtttttattaatttacctctgtaaattaataatgttaatcatgattatagggacatggcaactatagagctcgacgaactcgccctcgatgggagtaactacc

SEQ ID NO: 50067 - DNA, 1501 bp, Oryza sativa
tgctctttaagcttcagcatgcattccaacagggtaggcacctgagaagcttcatctctcattggaagcgagttcaaggtttcttggtatgttggagggaggcaagagtactcgggaagagctggctaagggttctgcacataaaaccagtttgcatgccagcctttgtttgatgttttgaagggcatagagaaatatttctggctcagggtcccccttaactgaaaaccggctcccccaacgacgcacgacttgctcttgtttggctgaggcttcaggaagaagatgcggcggaataaggcaaaatgcgacctaatccctagaaaagcctcgtaggcatggatgaaattagcgatgtgaactatggaattggggtttaggtgatgtaagctaatcccataaaactctagaattcccctgaagaactttgaagttgggagagaaaaaccaccataaaagaaatgggagaatacaacgacctcgtgtgtatccggggtcgggaatgcttcgtcacatgccggacgccagccgatgatttccttcgctggaagaacaccatgcgccaccatctcttttaggttctcctccgttacgtcggaaggagcccactgactctcgaagctttctctttcctctgccatggatgcaatatggatgatgcgatttgatgaggaaatggctaggaatggatgggagattgatgcggaggttgcgcggaagattttcgcaggagctgtaaagcctcggcaaagtggattggtgcggatttgagaaccctagtttttgccgtcgcagttttttcactgtagcgaggagtggggaaaatggaggagaccacggcagggaagacgaagtggcgctctgttttagcgattatttcgctagggtatcggaaggtactaatgggcctgggcctgcatagtactttcagcccaactttattattgacgtggttggttgtactccttagggacttaagcatatatttttgccttggtaaaaatttctcacaacagaatagcccaatgccgcaaaaatcctttttgatgcagctagatgattctttggaatctctacaatgcggaatgaaaatgtgctcgacagaaaagtgtaatgctaattttgttggtctttttaggcaacaaagttgtttggattttattgagatggctacttttttatggccattctctcagcatgttatatgcttattttgataacgacataagtcatggcttaggctattttgacttgtcatttgtcgttttctatacaacagtcgatgaatcctttaagagttttttactcgaattattatcgcatatgttggtttatggacctttagagtgttttttcactcgggtttctttttgggcgcattatagctaaagcagtcagcagaatgcgttttagatgtcgcctgagcttaattatacagtcaccttggtgattcggttgtaaaaccactcggatggatatttcatgtgccttgactatatgt

SEQ ID NO: 50068 - DNA, 1501 bp, Oryza sativa
tggtgatttcgtcttcctcgaactcctccgtttctttttcctttttttttaaaaaaaaatcatccatttctcccctgatggagtggagtggagagctccgtttctcgtcttctcggtggatttggtcattcgggtagtgctaccgtttcttgatttatcctgcggaaatcgtgctcttccgcattgatcttataggctggtgggaggcgccgagccgcccatttgagttgaggggttgaccaatctgaggaatattctgacggcgttatataattcggacaatcgatgcacaactggggcccaaaaacaaaaaaatgttcctttcttaaacagttggttcagaatgggatttttttttctttttggtaatttttattttttgttccttcccgattaccgtgaacagtttttacaagcaatctacatgtctggtcatgaacttaacatctctaaaatatttactctattatatatatcatacactgttcaactgaattgagattgcttttttttttcttttttgtagttttatttgtttgttcccttccaagtaccatgaacaatcttgcaaattacaatccatttacatgtttggccacggcttgaaatgttaatccagtatatggagaatcatatacggctgaactgacttaaaacactgtagtgtttgacaatataaatcacactgttgaactttgttttagacttaagatactatatagtatttaacagtaacagtatgttgtactatgtatcatatatgcactgctgaactatcttaagagactgtaggtttaacagtaaaagattgccacctgtaatttcctgaaggatataagcagttaggaacatctttttttcgccgggccggcaaagaacaccggccacagttaggaacatctttgttgctgtatattcgtaatgcacccctatattcccttcttgttctgttcttattgctgttttatttgcatgtacagcttacagggtcgctgctccatctccttgaattgtactagctgtcttgtgcttaagatttgcgctcggcttcatttttggattcaagctgctgggtgtggatttttatgatgggctgtctaccaacaaagcaagtgggtcgttcaacacattccttgaatccacgggaagctgtggctcttgcggctgaaacatcttgtgagaacgtcgatctaccagatttcgttaatattgccactggaacaccctgtgagaattgaaatccatctttccataagaaagaaaaaggatttagtttgtttttggatatttttatgattctgtcttaaaatgtgtggattagcttttcttatgttagtcgttcaaaatcaaacaaaatgacaatgcactgcatatatgatgtgtattatcctgagtagaatggaactttgaaccaataacttcttttctaccacagtaccagtaacccaatggatgccagggtaggccaatttcatctaaaaaagcatgttatacattatca

SEQ ID NO: 50069 - DNA, 1501 bp, Oryza sativa
caccaggggagttgccgctggacaggtagtcaataaggagagcgagggcctcctcgttagcctcgccatgctggagtacatccacatgtgcaaagacgacatgaccccttgaggacacagccgtttccggcaccattgtcggttgggcacagaggccgagttggacagcgtccgacggtatgcgcgctgcattgggcttctcttctaggtggtggacaacatgctcaatatgatgagcacgttggagtagctcgggaagtggagggtgccctatcgttggtgtcgctacggaaagtggaggtcgcccacattgctgacatacgcccacggcctctggtggtagatctggagctggatgggttcgtgatacacgccatggtggaggccttggagaggattagggagagagctgaagagaggggagaggggagagagagaagagaggatgaaagacaatgctagtcactgacatgtgggtcccacataggtcccgcaccgactcagctttgccatgttacctaaaagccgaacatagtactgcttaggacatcgggtgattccttttgtaaattgagtgacccgttatatttggtatttcagtttacgaataaatttcagactcggcgacaaattgagggacctaaagtgaacttattccagcccaaaatgattgtcgcgggccatcaaaatctcataatatggcccatatagaactccttggtccaacggaattctccaccgaggccttgttccccgcaggcctggtttacacaatttcagcgaaacatccatagaacgtgtaacatatggtatcacgtgccacaggaaacatcatccacggtgtagggtgtatttggattgtagagaacgtgtagcatcagctgtaggatgtatttggagtttcaactagttccaagatttttcagaaaattggacagtttcaaaagaagcgaaagcggaaaggtggtcgatcggaagctgcctccctgctccggtttttattcgcacagccaatcgatgcccccagaccggcacacgcgattcgtcacactgtcgccgcaggccgcggcaggagcgcaagctggcactgtggcacaggggtatcacacgctggcggtgctgagctgaggcgcgccgctgcgacgacgacgcgagcacgggaacgtgtccgcaccgcaccaccgggttcaccggctcgtgggccggctgcgaacgaatcagacaaaaccgcactagtcactagtagctcacctccaacatttattccgctccctcccgtccaccgccgctgccgctgccccaccggaacatgcgccgcagaaagccagaaaccctgcttaattaattcagtaatcacctccgcctaatctaatctcctggaataatggtttctactcgcgcacaactccgcttcttttataatagccgtccatacccgcccagcccacttcacacctcttgctgctgctgctgctgctcatggcgcctcctccgtctttgc

SEQ ID NO: 50070 - DNA, 1501 bp, Oryza sativa
aagaaaaggagaatgtgatgatcagaggactacaataatatggtttcgatccccagacttctaaggcagatgcatgtaaaacaagacaggaatcataagctgatctaacctaatttccatcaggagcagacccagctaaactggacttgtgaacctcacacacgcatgctttgcaaataaatttcaccttccataaagtgttcccaaatatgtacaacacatttccaaaatacccatagaacagtaccaatcagccaaatgacaaaatggacagttaaaaagcatacctccatcgctaacccaaatgttgctcctgtaggtatcaaactattccttctcatttgctgaaacacccaaaatacccctttccactgctgtgatagaacgcatgcattaaggacctataaaaacaatggtcaaagtgaagacatgcaaaagttatacagttaaaaaaaataaaagacgtgcaaggttatgaacaagacttcttccaagagagtgcaggaaaacagaaataaaacaaaaacatcaggcgccatccttaccgagttataaatcagaacatctggctccaaggaaggatcccaatctttgcgacgcatcttcattacccttttcgaaggcttctgtctcatatactctataatcttgattagctcgtttagaaggccagctcgaccaagtgtaacagcaatactatggtatgcagccatatcagggtatatttgagcatcactctgatttaacgtaagatataatgcttataccattatgttttctcaattttaggctggaatataagagacaaatggagtaaattctaaatgggcaacaaataaattctacccgcatgatggtgaaaactcgaagtgcttcagttggcctccatgcttttccaaggattgatagtaattttgtatacacgaaccttgatatgttatattccattagtcaagcatcagtacttgagttcaatttcattagataacttgtgcttgcagcgatctgaaacctagtaaactaggatatacctgctttttcgatgcttgtagatgttctcattgtacacccactcagtaacagataaagcctgcctccaatttcctcttgcctcaagcccttccagtatttgtagcagattatcttcattatatattaggtcagcttttttcatcaatctagtaagcctccaatcacgcatacttagatcatcttcgttcagcctgacaaaaaaaacttacttatgcaatatggaacaaagacaacatttcacgcaattcaattcattgtgaacgatttaactcaataatggcattggcatttaggataatgaagagtgcaatgaagttaaatgcacataaggtgaatcctaaaccgctatctatctaaattctgccatatctcatattcttgtaaatgtgattattaaaatcataaagcaaccaccactactcgaaagcagtgaaaggccaagaacgcctgaaacagcaagagcacgaac

SEQ ID NO: 50071 - DNA, 1501 bp, Oryza sativa
aatttacttctaatgttgtgacaatgttactttctttttgttttaagttacttttataatttatctaaattagttttagactttactaaatttgcttttatatgtctaagaagtaatttagtgaaatctaatagtaatttagatatattataaaagtaatttataatttttcattaaaatataatcatgtgagatcttgttataaagatttaattgttacgaacacaacggtgtaatcggatcatagatcggatgagtagtttaagagaaaattttatttgaagcataggatgaatagtatatatttgaagcataggggagaaacttctctctctggcgtagcagagtgcgtcatgtggcttaagattcggactattctggccttcttggcaatgtcggcatgtggaacggacgactataccagcgtgcgtgggatcggacggctctagatgcgttgcgtgataagaccagatcgagaggcctttcgagatagattttacgtttttcttatctttagaaattataggcgcttggtcaattgaacattcttcaagcatgcatggagctatagataggtctttttgctcttcgtctttattctcttcctcctcatcgtcttcaacgtcggaggtgctgatgtagccatcttccgtagcaacgtatgcccgttgactagggcaaaccttctgcacatggccaaatccatggcagtggtggcactgaatcttgggcgtgcgtcccgtcgaaatgacagatgaggcactcttggtggatacctgcgaagaacctttacctaaaactgcaggtcgtgggggaggtggttttagcgctacagaaactccggacgtaactggtcgcttgctcgttggtgggggtgcccaaaaagagatgggcttggaaagcctcgaagatggcttcgcccgtggcgtgtacgtgctcgccttgttcttgatctgttgatcacgcccctgcaattccttctctgcaagcattgaaaactgaaacaactagttgacagtgttaaattccttattatctactatgtcccgaatatcgcacctcaatcccatgtaaaagtgacaaatagaatcctcggttccctctactatgctacatcgtatctatcccttttgtagctcaccatagtaatcctgtacatatttattcccttgttctaaatacatctgtttcttgtgtaaatctatatgatatgatggaggaacaaatttatcacgcatagctaccttaagttcttcccaagtagtaggcaaagcaccctctgcagctaacccagtcccccaaaggaaaaagtacgaaatacccccccgaactatagcggttgtctgaaataccccctaaagtcgaaaaccggacataattcaccctcaactatcaaaaccggttacttaacctcctaaggcagaattaggggtggttttgaccggtcttcgtacacgtggcagtacagcgtggcaaggggacgacacgttagcacggggtc

SEQ ID NO: 50072 - DNA, 280 bp, Oryza sativa
cccccccccccccgaatttttttatttttcttttatttttttgatattttttgcacgcttagggacacataagaaccaaccatagaaaaaatgaactcaaatggacgtaatatgtaacatgtagaatttttcctctcctctcatatctctccgaactaatgcagaggagagagatgtgcaacttttttacttttattttatttttttgatatttttttcatacttaggaacttacaagaaccaaccatataaaaaataaactcaaacggatgaaatatgt

SEQ ID NO: 50073 - DNA, 1501 bp, Oryza sativa
aggtcagcagcgtgcagaactgcatgaccccaacacgacgaaggtaatttgcaattcatcaataatggtcgagcaataagcttaattcttttgatcaacgattcagccagaccattttgtgtgtggacatatggaacatagtgctgaacctgaattcccaatgccatacaataatcatcaaaagcatgggatgtaaatttggcagcattgtccatacggattgattgaatcctatgttcagggtaatttgccttcagccttataatttgagacattagtttgtcaaaggtatggtttcatgtcgatagaagacacacatgagaccatctagtagatgcgtcaatcaaaaccataaagtacctgaacggtccagatcttggcacaatagggccacagatatctccttgaatgcgttcaaggaatttaggtggttcagctctgattttgagataagatggtctcaaaaatcagttcccagtagcacatgcagtgcatacgaaatcagaggatttgagaaatttatcagtgatcaaatgatgaccaatagagttgccaatatttttttctcatcatcccggtactggggtgcccaagtcgatcatgccaagtgtggaatgcatcaacattttgaaaaattacttagtacgcaacatgtgcaatgggcttaatatatgtatagtacaatcccaatgtgagagatggaattttctcgcaaatgcgtttgccatatctgttttatttggttaagagaagaaattcttctcgattatccatatgggtttcaatgtgaaatccattttgacggatatctccataacttagtagagtacgggttgaatcaggatacaataaagcatcctcgattataatttgtgtacccattgggagtgtaatagttgctcgtcctgagccaactatcacagtatcgcgcccagcgatagtcaaaactttgccttctctctttttgagagtttgaaagtatttgatctccctaagtatagagtttgtggtaccactgtccacaagacataattcctctccaattggggcgatatccttagacatctatagtgaaagaagaattgcttagtgaagaattctttatccacaatatatacatacatataataatgaaaacatcaaatacatagtatgacgtttacataggttaatagtacatactctaatgactagcaggtcttataaccttacaatgtaagggagtttgtacgtatctacttattacaaccaatattgttttgacaaactataggatatcaatataatgtctcaaacacactgagattaaagcagctttatctctaagtgggacgcactgagattacagtaaatctccaagtgggtccgttgagcagtattcgatgagcatgtcatccactacagaaagtgcagcggtatcctctgggaaaagaacgaggttgttctctggttcaataggagccaggtgagaactttcaacctcaggtctttcttttgtaag

SEQ ID NO: 50074 - DNA, 1501 bp, Oryza sativa
gtacaaccaccgtactcaacaagacacacccacaagtgcataataaatgcaagggagtacaagggagttataatataaagggttagggttgcagtaaacagcatttaaagatacttagttgctcaaagctattttgtaaacacgattctagaactatacaatattatttatcaaggccgtgaacccacacgaacctgccttaacccaaggcctacgatgattcagaccaaaccggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggtaggcaggactgagcccccagcagcaggacaccggccctgtgccatgacatctcgactaccgggccgcagctcgtgtagccttcatttgccctggagatgtccatcgacccccgacttcgtccatctctatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccatttttggggattttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacacactagttggggttttgtttatcctagggtgaacaaggtaataataacaatagcaataataatgtcttaacaaaggtaaataggcatggctaaataaaacagtgataacgcgggaatttaaataaagcggtaatgcattaatttaaattaaaataattttataaactgggattcaatatgctcaaggatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttc

SEQ ID NO: 50075 - DNA, 1501 bp, Oryza sativa
catcaaactcacatcttccgttgacatcaaagagcccatgactcgggagtgtaccaacatttcaaaatacaatgtgaggcaataacacatcatggataatagtaagtgcactgtatcattgaagtacggagtacctctttttcccttgctgagtgggacataagttgtatgtagtgggctacgacgcctgaggcgcatcgggcagctgtgacatgccgatctcatcagcatccggtgcgatgtatagtcatcgtcaccggcattgtcatcatcatcattcaatccatcatcatcaaaatcctctagacattatcaatatttgataacaaactaaatatatctacatgtttgttatttttaccaaaaaaaaattgatatagctaaaaatagcccttataatgacaaagctaatggcgccgagctaatataataactcttaaaacattacaacatattatgggacagttggatgggcgtggtgtagttgtcaatgtatttgttgttgcatcttggagagctagctggttcggactcatcttccttgctaggaccagcggaagttttttttttctaaagtaattaagcaaacagttaatacgttaattcatgactgaaaggaatgaagaaaaggaaaggaacaaaagaaagaaaaattgaccgaatttctgacctttgtgccaaatttattttttttagataatggaatgaaatagcatcccggcctttactcgaaagagctacagccaattattacaaactagcactctgtaatagtgaagttcaaatagaagcaaacacaccaaccaaactagacaaaataacattattccagtctattggtaaatctccatccatgattggcaaacagttgcataaccgtcgtttcaaccttacgacatgcaacaattaagaaatctgcatcttcatcacacttttgtaactgtgcccatagacgaagccaatatgttgccttgaaaatgacctgcatataagtaatagtaggtgatttatcaaaaaccctatcattcctactcagccacagtgcccaacacaaggcagaaactccaacaagtatcagtttgctctttttgtttatgactccctgaagccaatcataaaaaatatgagatatgctagtaggaatatataaaccaaaagaaaactgaactgccctccaaataaactttgcaaaatgacaatcaatgaacaatgttggatagtctcatttttcgtacaaaagcaacatcttaaattaccagtccaattccgtcttgctaaattatccttggttaacacaactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaataatcagaagtattattcaattgaatatgaacaatagatgcacacaat

SEQ ID NO: 50076 - DNA, 522 bp, Oryza sativa
tgttgtatgcttggctcgttgttgaattataaattcaacgccgaatttaaatttagatttttaggtgctttttggtcgttttcatggttgctaataggacaaatggaaaaatctttgaaaagtgaaactgtgaaatttgataaaatcgctttggattactccaattagggatgaatataagggtttatttgtggaacttaaaattcttaaaaacagctggtaagaatctggacaagctaggaaacctaatctctggcttttagttagattttaggtgaaaaatctaaattgtctgacgagcttttgatagctggatattctaaaagaagttgaagctcattgtttcgtaaagagacggataccaatttggaccaagtgtactagtactagttcatttttatggcattttaactatttatcattttagatatttaccatatgtgtaagccatatgtaggttaggtgttaaattagtgaacgctgatggttaaatattttgtcttttctttttttatatatagt

SEQ ID NO: 50077 - DNA, 1501 bp, Oryza sativa
gaattgctctctgtttgtttctacttctcttggttgtgggtggcgagaagaggcgggcatggggtggcatatatagcacctgtgggggggtgcatgtaggaagggtggtttggagcagaggacagtgagatgagacgcggcagggcagcttgggttgttagggtgatgcgtataaaataagtcagctagctacgcattgtgctcaactgcttcagtaattccatcaattatcagctaatagtaactccaacttgcttgcaaggcttttcggtcgtcttattgttttgtttggggctttaattttagcaaagtcatttgaagatttaatgcttgtcattgtcaacaagtgtagatggagtgataagtgataatctctcaaaaatgaagctcaatattgcttagcagttggagagaggataaaatggtctgatgaaacagaaaatgctacttaaaaataagcattccaattaaatattcatataactgcttgtactatgaaaaactagaaggcagcataatctgcccctgtacactacacattatctttctactcattatcgaaacctttgatggattatataatattatattataccctcctgtatcagaacgttagagatgttgttttaaattaccataatgaggcaatgcatatgcacaaagatatatcagtcgttcctctcactttaacctttttgcctcatagtaggcccacacctgacaggttgtactagtatgtatatatatatatatatatatatatatatatatatatatatatatatatatatatatatatatatatatattccctggaccatatccaaaatttaacctcacaaaacacatgataatttgcacatcatgtgtgaaatcaaactgacaaagcacaaaagcgtagacaaaagtaaggttttgcttccgttttaatcctactactttggttatacacaagtgtcactacagatcatacggctttgtttaatgcaataccttatgtatgctggactattcacatgaatgttttctattgttggtggtcatcaaacttggattcgtatccctgtctttggggatcaaaagtatgatgctacattgccgtatatttattactacaaacgttatatcacagtataatctctaaggtttcttcatatattctgttgtccttgtagataccaccaaactaagttaccttttctatgttattgcagcgatcaaactggcatttttgatggctcatttaaagtatgatgctacattccgtatacttattagtagaaacgttatatcaaaggataatatccaacatttttcatatgctgttgtccttgtataattgtactgccaaactaagttaccttttgtatgttgttgcagcgatcaaatcaactgggagttctgatggctcatcaatggtcggagagaggatgtgtagtaccatggtgcattttgttgtacaacacaggtgctgatatcctagctaacacatgcatggaga

SEQ ID NO: 50078 - DNA, 212 bp, Oryza sativa
tactgccacaaggaaaacaataggaaaagtgcttgcctagatcttggatttggggctggctcctccacatcgattcctgccacttgtctccacttgatttgccaaaagcaggtagtagaggccaccggtccttctctcggtcaaaaggccatccaaaccatctccaaaaatctccgccgccctcttctccaaccaactccgccgccatatga

SEQ ID NO: 50079 - DNA, 1501 bp, Oryza sativa
agaaagtgaataatcaagaaatcatggtacggactcatcatatcaccaaggcagaaagtagtgctcgcatgggcaatgttggtaggctatcttatcagtggtaaaaagtttgcctaataactatagattcttccatgctcctaagggtaccttttttaatacctaggtacaaatataacaaaggtttgatctcctacactttgcgttttcgttatgtaacagctaaagttgcatctgcaaatacatgtcttttttttctctatttttgatgactatttgcaataccttcatatggatttaaccatcgcaaaagcaagtgaaacgcatataattgcctttctagttgcactaagcatacaactcatttgaattatgtttttgcaggctacactgcaggtgctatgtcaaccgagcaccattagctttgtgaagacaagtaaagaatgctacagcagaagagaaatcacagtaccttgacaaagcagtcatgaaaatgcagcctgaccaaggatgccgccatcctggtctccctggccaccgcctgtgctacgatggactgcacgatctccttcgccttggggcacgagtggtcgtagaactgcgggaacaagccatacccatacccataccacgggttgccgtggacagaggtggcgaggaggaggggagaaaccaagcagagcatcaacaggcaacccatggaagtcgccaagtaaaccttcgctgcactgcactgcactgcactaggttgctaggtaggagaagagaattgctctctgtttgtttctacttctcttggttgtgggtggcgagaagaggcgggcatggggtggcatatatagcacctgtgggggggtgcatgtaggaagggtggtttggagcagaggacagtgagatgagacgcggcagggcagcttgggttgttagggtgatgcgtataaaataagtcagctagctacgcattgtgctcaactgcttcagtaattccatcaattatcagctaatagtaactccaacttgcttgcaaggcttttcggtcgtcttattgttttgtttggggctttaattttagcaaagtcatttgaagatttaatgcttgtcattgtcaacaagtgtagatggagtgataagtgataatctctcaaaaatgaagctcaatattgcttagcagttggagagaggataaaatggtctgatgaaacagaaaatgctacttaaaaataagcattccaattaaatattcatataactgcttgtactatgaaaaactagaaggcagcataatctgcccctgtacactacacattatctttctactcattatcgaaacctttgatggattatataatattatattataccctcctgtatcagaacgttagagatgttgttttaaattaccataatgaggcaatgcatatgcacaaagatatatcagtcgttcctctcactttaacctttttgcctcatagtaggcccacacctgacaggttgtactagt

SEQ ID NO: 50080 - DNA, 1501 bp, Oryza sativa
ttgaagatggctcctaatatcctttgacttaaaaaaatctcagtcacatggcttaagcttatctagtactcctaacttcaggattttcacaaactaactattctgtctaaaatcataactatatcacctgcaaatttcatcttccgtttatctagcaacttcaggttgcagaaagactcaaaaaccatcgtttaacaagcagttcatattgcttggacattttattcatcagacagaatagtaccatgttgccatgaaacatggattttccaaatgcctgcagacttcttcaacaaacgactggtcaagtggtcacatgtaaacaattgtacccaacacataactgctctgctgagacaatattatagagtgagcacctaccctacatccttaccatccacgagtgatactaaaactagttcgagccctgagtggcactaaggtggtgtttggatccagggactaaattttagtccctgtcacatcgcatgtttggatactaattagaagtatttaacgtagactaataataaaattaattgcataaatgagagctaattcgcgagacaatttttttaaacctaattaatccataattagcacatgtgtactgtagcatcacataggctaatcatggattaattaggctcaatagatttgtctcgcgaattaattcaaggttatgaaatggattttttcattaatctacgtttaatacttctaattagtgttaaacatctgatgtgaccgggactaaaattttagtccctgatccaaacagccccaaaacaagttcaagctgaagctgttcaattaaggttaaatattgctctattacaagccaaggaacacgagttccagaaatgcatcccaatctgatagacccaggcacccagccaatattctagaatgctaaagttcatataccaaagttgagcagttaagcctgtccgtgcatctctcgtagcaaggtttcataggtagaagggtttcacaagatacaagcaattggataacaccaaagaagagtgtggcatcagtttatggtgattaaccattattacagaacaatttagtggaaaaaaaatgtgctgccatgcctaaactgggaaggagattattactttaaaaaaagtccaatcatacaatccaaagaagttaaatcaatatcccagccaccaatttccagaaattatctagacaagggttttcctttttcttcttgagactgcaaccgtggtatcatgacgggaatatttctttttcattttgagactgcaaccgtggtatcatgacgggaatgttcctttttcattttgagactgcaaccgtggaatcatgacgggaatggttcttctcggagggaattagttgtattttgcgacgtaacagtcaaaggttaaggaatcgatgaaaaacttctgaatcggagagtgtgggggcacggggcggagatgggtttacctcccgagcgcgcggaggtcgtcgaagtggcggtgca

SEQ ID NO: 50081 - DNA, 358 bp, Oryza sativa
ttttgccatgccaacctgcattacatggacaaaggttcatatcatggaaataaaatttagaagaatttatttttaaaactaaaaattaaaatgctcaaaaaataaaaaatatattcttaactaacctggtgaaacaaaagaagcccaacagtcaggccttatccaggaaagcggagcccaagcccaacaaacccatttacccccagcgtgggcaggcgaaccctttccctcccgtgcctatataaggccacaaaccctaacgcccccactcttccacctcgcagtcgccaccccgagcagaagccgccgccgccgcccgaaaccctcgccgccgtcgcttctcctcggggcgcagcca

SEQ ID NO: 50082 - DNA, 1501 bp, Oryza sativa
tggaagggcgtgtgcaacgtgcgtgtcgagatcgaacctctaggggcaacgtttgaagctccattccgggggcttgatgaactccccccggcatggctcggtcttccccatcttccgcagcctcttcttcttccggcctctagcggtgcggcggttgtgggccgtcgacgtggcacccgctaagtgcccgccagcgacgcgctccgtgccgccctagtgggacgggggccgaggaggggggaggagaggaatccctctgcttccgctttcctctcaagtcggagggacgagcgtagcctgaactcccggccgcgggtcctccgtgttgactcccccggccgaaagggcgtgctccccatgaacgcggctgccacctgcgccgccaccaccaccacgccccgcgtcggcagccaccgtctgcataatggccaaaatggagtcccgcaccgggtcacagcagagagggaggatgccctcggggaccagcgacggctcgacattgccgaggttgagcaccctctagaccactgccttcaggtcgcccaaactccagtcctaggtctcctcccggtgggtccgggtggagtcgttcgggccggtgtacgtccactcgccccgggcctgctcctggagaggcgcgagccgccggcgagtgtaatcaccgaagaccatagtgtcgtttagccccagggaccgcagcccgacgaggtaatcgagggccgtgtcgaacgcgtcccccagcaccggcgcctcctgccagttcgccgtgtgcactgacgagggtggtcggggtggacggtgtagaactagtcgttccacttcttgcacagcgtctgcccgatgtagcgctgctgcgtgtttggccgcggctggaagtagcagcccccggcctccgtcggaggacactagctgcatggtgaagaaccaccggaagagctggaggcatggtctcaccccgatgaacatctcacatagatgtacgaagatggccagagtcagcacggcgttcggggtgagatgcgccatttggatcccatagaaatccagcatgtcgtagaaggaagagaagggcgggatcagtcccaccatcgcataggagaggaagaacacagatcgctcggggtactgcggcgctggacgagcctcgccgtagatcaccgttgcccgcccggacggcattggcacgaacttcctcggcaaccccgcgaacctctcgtttgtaatgcgagaggggggaaggatgctgccatcgagcggcgctgagctccgcgtcatgacgtcatcaagagggggaacggggagcgagagtgtggcgaaggaagagcaagatgcgagttgagttggggcgcaggagagcggcagaagcaaagtggcgaaaggaggggaagaaaaccccttcatgcgccctttatcctccctctgcacctcggctcctcgtttctcgcggccacttcctccgccccctcgattcaccacgcacctgtttccagcgcgcgcgcca

SEQ ID NO: 50083 - DNA, 1501 bp, Oryza sativa
tcagagttcgtcgatctctctgctttagttcgtttcggtgcagttacctttgctgatctttgatgttgttgcagagttcttttttggccagggtttgatctgcggttttttgctctgtaaggacggttgggttctttttaattcctgaattttgctattttgatctttctttcgatcggttggtaaaaacaagaaaatgggggcaccatgcaccatttagcaactttgatatcggttaaataaagaagagatgtgcatctatatgaaacacagagacaaaaaccacatcttccgtgtgctgcaatattaactttggttggggttttgcatcatcacctccacagctccacttaggataaaacgccactgtttgcttcttctctttagacttcagagttttttttccaagtcctcaaagatgtatgggaattccacattttgtagcaaactatctttatctcaaaatatagtaattttttagctatgtatttggacagaccattatccaaatgatatgtatctagacacatgtccaaatacgtagctagaaattactatattttgggatggatatagttttttaacaactcatgatgattctcattttaccaaggattgtagaatcactgttttatttcacatttgaatattgcagttttttttatttggtaaccatccatcaactttttttttctaaagaggattactttcacagtttaggttgtgtatgaaggtttgtgcgccaacgacatcgtgatgctcatgactttttttaaaaaagttttaggaggaggcttttagggcctatactcatatgcgggtgcaaggaggagtgatgttaggagtatagccgtacgtacggtaggacaaggtgtaaccgtgtaagtgggttaaccgttaaatccttataagccatttaagtaggtagccctttatatgcgggccaactcacttatattcctctttttttaataataaagaatgatttacttttcgttattgatgtgtgtcaaacttgacttttatttgatgtcatcgagaaaatataacttttttatttacaacttaccaatactacacttttgtgcaaataaggctattttccaaatgtgaaaaggatagctttctggagtcgcctgtctatatacaagtttcctaatctatcatcctcgtggaccctcattgcttatatataggctgtcgaaatatatatagtctcgaattgctttttccaaaatgtactgttttgattcttcatttctgtatacatagttcaccgttttggttccaggatcgcggctatatctatcgattttaatctttatgtatgctagtcctgatcaccataatctattcattgacctggtcttaactttaggaaacttcagtttgtttggttattttcccaatcccatccatcaaatcatcgtgcaatctttcctttttctcttctttttttttttggtctgcagttacaagttgagctgagcttggatggagt

SEQ ID NO: 50084 - DNA, 1501 bp, Oryza sativa
ttcctctcccctgcgatgatgcgtgtatcggttttggaccacacattatatggttagattaattaacccctaacagggtggtttgaaaaaaaaatcaaaagtataggcagaccgcagactgtatttagcaatatatatggccatatttattacagagtatcaaggattgagtattttttggaggaggtggtacggattaatggggttttttccctcacaactaaatcaatcgatcaaatccaaaatgcaggtttgtttatatattataagacggtctttaataaacatagtatatgactattatttgttaattgtgaccctaaattttttaaaaatagtcatccctctgtttcatatcagaatacattttgacatctttttaagtttgactacttcataaaagaaatataacaatatttttaacccaaaaaaattattaagaaatatatttagtgttagatttaatgaaactaatttaattttatatgtgttgctttttttccatgttaacttggttaaacttaaaaatttgaaaaaataatcaaagtatcttataatatgaataaaatggaaggagaaataatttggaagcaattataatgacaaatctaacaattaatatttgtttccatgggatgaatgttattgtcgcgccgacgtccgcggccgcagtcaccaccttgcctgcggtcgaaagcctccacgactccatacgagtctcaaagctaacaagtcgagcaaagagttcacccacagtgatagctttagtccggtttgcaactgatgtcaccaccggattaaaatcaacatccatactagcaaggatgtaggagacgagatcatcatcaaggtgctttcctgcggactgcatcttgtccgcaaggcctttcatcttatatattgacctactccacaacactcaaatcaaattccctttgtgtgagtggtcgtgagagaaatgcgcgtgttgagaataaagtccgagaggcaaatccgcaaatatgtcatcgatcgtctacctactctatcacacctcagcaggcgtcttcaacgcatcaatttggaattggatagaatatatactagtccaataaatctgaacaagggcctgtccaaatctattatattattaaagaaatagaaaaaggagtctcctcgttcgctctcatgacctataaattctcacattaatcggagaaaaagaaaaagaaaaaagcatagtccatattgtaggatcaaggaggccgactagaggggagtgaataggcggttttaaaacttttggccgactagaggggggtgaataggcggttttaaaacttttggctaaaatcgagttttgtatgcggaagcgtaaatcaaaacggttttgcacaattcaaaacctaaatcaactagtctcacgtaagtgcacaaagaagctactctatgttaaggtttgcaagcctagggtgataatagcacaaataagctctactatgtaaacttgctcaaatgtaaa

SEQ ID NO: 50085 - DNA, 1501 bp, Oryza sativa
gcttgtgttgtttggtgcggttcttggtggtggtggggtttttcggggaggagaggagggcggattccgtggggttttaccgtggaagtttctgttcttttgtgttcttttgcggttttcctctgttcttggtttaaagatcgctgcattttgatgcattctattaaggagtttgatttggggttttctttctttttttcccctgatttcgttcgttcttcgttgcgttgttctcggggctttttcgtcttttgccgtttatggtggtttgttttagatgttttttttgaagatttatccgaaacagtgtttgtgcgattctttttcatttttgcgttctttcttcgtttgatatttctggtccttgttgttttaaacctttattttttttgtttgggagcacctccttttgatgcttgttttggtggatatctgcctgtgtagttttgttagggtttaggggtttttgggaaggtttatgatactgatcttgactgggaaaagaagatttgctgattaagaaaatggctaagtttcttgtacttaaaaatgggtaggttgtgtttgttgtagttttgaaagtctgtaggctggatagactcttctcctatctttttggaagaaaaattaagaaaatagttttctaattttgcttttcttttctttttctggaggaaaaactcttgacccagagcattttcattgtctggtatctgttagcatgggttttagtttcctttccttttctgttttgatttaccttgttaattgttgaatgagttatgtattttgtgtgcaggatagggcagcgctttgacagctttggggagttagtcggtaagtgtactacgctcttaatttggctattaattaatgttttaatctttgtgagttgactaggaattttctatagttgtggtctcactctcagtagttatacatattttttttgcatgtactactagtttctcaggctttcttgttaatgttgcaatcgtctgacaaacgattagtgtctttgaatacattgttaaaaactggagtaccattttaatgtagatggcaaacaagaagcttagttgttttggcaccggttgaccctcgaagtagtagtaacctcaggtcattctcagtatgacagtgtatttaaagtgtactggcaaactcatgtaggtgtgataagagtttggacttgaacggtgacttgaaacgtttgttgtgtgttcttttgtgtgcatatgcaacatggcagactgactgacataacgtttgtgttagcatattactatattatgcttttagttgaatgttttaaaccttgtggtgtcataataattttcttgtattttacgatttcatttgcatgcaaaatatattagtgagacctaggggttttctgtatgattctagttttgaagattgatttaacttgttatattctagtctgagagaagtgtttatttagttggcttttatgctctatttcagagaagtgtgcaca

SEQ ID NO: 50086 - DNA, 1501 bp, Oryza sativa
gccggtagatggccgcctcgtgcgggctttgctcgaagcccatccccttgagcgtagaatccaacttggcattccacgccctcgatgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcatcgcacgcaaggtgcaactgcgcctctaggtcgcgaggcaccagtcccggcaccggctggtcgccgagaagatcctccatcgtacggtaccatagctgctcgccgtcgtggtacacgtcgatgcgctccccgtcgtgggagagcggagtagcgaactccaccgggctgcgctcaacacgagctggcgtcggagtagacgtgcttggaggagtggctgttggtgctggagcatgtggagtcgacgaagagctcgtcgtagtcgaagtcgtggcccgagggtgtgttggtgttggagtcggtggagatttgggggctggggtagacacgctaggtgaagaagagctgcctactcccccagctccctcgaagtggacgtactcgacggtgaagtcgtcgtacgtcggagtcgaaccatcgtccaccgccttgtcccatacccaccctcgcccttcatcaaacacaacgtcgcgcgcagtgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgtcgttctgttgcgggctgtaaggcgtggtgtagtgtcgctgaatgccctcatcagcgcagtacgacgcgaattcagccgctgtgaattcaccgccgttgtcggtgcgcagcacgtgcagcttgcggccgca

SEQ ID NO: 50087 - DNA, 1501 bp, Oryza sativa
atcggacgctgtctgccactgcagcatgcaaagaatcttttcttttcttatttattcaaaagattttttttatcgtaaactatttatctaatctacgatctgattgcaccactaaattcgttacaattaaatctttacaacaagaccacacatgattatatttcgacaaaaaaatattttaattttttattgatttttttaatgttgcatgtggtttcttttgatgtttcaactagtagttttacaatgtttcagctagtgtactcatgatgtttcactgtgtacggatcaaatattgcagtggaacgcgccgttgcaataaattatccacatattttggaaaccctctattaagagaatttagtttattttttgttccacaaaaaaatgtttcacctagtgcactcacaatgttccactatgtatagatctaatgttgcagtgaactgaaatatttcattgcaacaaaaaaaacccacatattttggaaacctcctattaaggaaatttgttttattttttgtttcaccgaaaaatgttccacctagtgtacttataatatttcattatgtatagatctaatgttgcagtgaactgaaatattcttctgctatttgctgaaacattgtttttatataagttgaaacaacaccagatttaaacgagtgaaacatttttcaatctacttagtgaaacaattccgatatacctggtggaacatcatgcaacatttaaaaataattcaataataagctattttttttcatcggaatatatccatgtgtggttttgttttaaagatttaattgcaacgaatttaatggtgtaatcggatcatgatttagataagtaatttaagagaaaaatcagtttaaaagtagttttgcacgtaaatcggactatgacgtcatgctgatgtgagcatccgatttttccctaaagcatcggacgtccgacgcatagccctctcccctagcaaacgaggcgaggttacgggcgcggggatgttcacacccggccggatgtgctcgcgctccgcctcacgcacttgctgctctcgccggcgcaaccctccgtgcccatggctgccgtgctcctgcgccgttttatttccgccggggtcacaggatgcgggcctccacgtcggggttccccatgtttatctggaagaagctctcctactccaagggagaaggagatggaagatgaacagggtagagattggaagagaatgaggaagaagatagggatgatttggtcctatacatttagaaaatgtgttgaatgggcaagtagtggcatataatagatatgtatgaaattataatgacgtggtttcaaatagacaaatatcaatggcatattttaaaaccataaaaattataatggcatggatctaattaacccaaaaagaaaaacggtcactaacttacaacgagttccattcaaactctgatccattcaaaacagtagctgatcgaccttgatctttttttctttt

SEQ ID NO: 50088 - DNA, 1501 bp, Oryza sativa
tgtacctcatatgcatcacgtggagaagtcgtcatatctcgtcgaaggtgtagaagtcgatgttctcgtattcccttacgcaatcctgccatggttagaagcaaacaagaaacacacaaaaatatgcacgctcctatcaactactaggtagtggcagctcaaatatcacacacactcaagcttttaacgaagctcttacaagttcttaccaaagcaagcggaatggtgatgtacaccgacttaaccaagcaccccaatggagattggatgtatcgatgccttgggaaacacttgctgtacggctgcaatcatatctgtggagctctgggtaggcttaaatatgtagcaaagggatagcaaatgctcaaatcagagaatgtaaagttgaataatggttcaaagtcaagtaccgtgctggtcctaggctagaacgtactagagaccgagcctagacacaaacgataccacaagatagcactaggaacaactcatgcacaactctgatatatgaagttcagctcaaacataacagtattttctcttttctttctttcttctttcttcttttcttttttttctttcctttccttttctgttttttttggtgcagtttttttttcttttatttttttatgcacctttctgcctttttttctcacttttttcttgattttttttaacaaaaactgactcaaggaccttaatgtaaggttacaaggactcaaacgtaaatataaaatttacagggactcaaatgtaaaagtctaaacccaaaattcaaattatacaaaaatggaatgctgaatttatgccggttccgtttttccaaacagatctcaaaaccgataccaaacaaaaattcaccaaggtgtttgacacaacttggaaccgtgaaagggagggagggagtcggactcggccaaagggacgagtgggagtcggccaggaggtggagtggatggtagccgataattaggatttggtgtatgggataaaaatgaaactgatttttaaccaatccaatctactatatctttccaaaacaaacttgactacttccaaaatcagattggtaattcactttcctcctctcgtgcacgacacaggcacggccaaaacagaagcacggcaatcagcaaacccaagatgcaactcaacaactccaaatccaaccgatagaaacttttgaaaactacaaaaatagaatcgtggcagcaagccgattccgttttcgtaggtcccgacgataacagagacacagaggcgacgacgactctggtataaaacatgaccagaactcgaaactctaaacgaactagacgctaagaccagcaacacgacgagacgatgcaacacaaaattcaacaaagcaaaaactgaaaaaaacaatgcaatggcacaatatggctaggtaaatgatacggattttttttgtatggctattttctggttataggaagataaaaactcaccgagtaatgaaagctctgataccacctga

SEQ ID NO: 50089 - DNA, 1501 bp, Oryza sativa
cgttaacgtttctcccaaatcatagttatcacaactcaccgaaagatcgggccaacaacagccttgagtgtcgagaggaactcagggttcatcaggtggtatcagagctttcattactcggtgagtttttatcttcctataaccagaaaatagccatacaaaaaaaatccgtatcatttacctagccatattgtgccattgcattgtttttttcagtttttgctttgttgaattttgtgttgcatcgtctcgtcgtgttgctggtcttagcgtctagttcgtttagagtttcgagttctggtcatgttttataccagagtcgtcgtcgcctctgtgtctctgttatcgtcgggacctacgaaaacggaatcggcttgctgccacgattctatttttgtagttttcaaaagtttctatcggttggatttggagttgttgagttgcatcttgggtttgctgattgccgtgcttctgttttggccgtgcctgtgtcgtgcacgagaggaggaaagtgaattaccaatctgattttggaagtagtcaagtttgttttggaaagatatagtagattggattggttaaaaatcagtttcatttttatcccatacaccaaatcctaattatcggctaccatccactccacctcctggccgactcccactcgtccctttggccgagtccgactccctccctccctttcacggttccaagttgtgtcaaacaccttggtgaatttttgtttggtatcggttttgagatctgtttggaaaaacggaaccggcataaattcagcattccatttttgtataatttgaattttgggtttagacttttacatttgagtccctgtaaattttatatttacgtttgagtccttgtaaccttacattaaggtccttgagtcagtttttgttaaaaaaaatcaagaaaaaagtgagaaaaaaaggcagaaaggtgcataaaaaaataaaagaaaaaaaaactgcaccaaaaaaaacagaaaaggaaaggaaagaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcggtctctagtacgttctagcctaggaccagcacggtacttgactttgaaccattattcaactttacattctctgatttgagcatttgctatccctttgctacatatttaagcctacccagagctccacagatatgattgcagccgtacagcaagtgtttcccaaggcatcgatacatccaatctccattggggtgcttggttaagtcggtgtacatcaccattccgcttgctttggtaagaacttgtaagagcttcgttaaaagcttgagtgtgtgtgatatttgagctgccactacctagtagttgataggagcgtgcatatttttgtgtgtttcttgtttgcttctaacca

SEQ ID NO: 50090 - DNA, 1037 bp, Oryza sativa
tcatctcgcaaattagtcgcaatctatgcaaattagttattttttagcctatatttaatactttatacgggtattcaaacgttcgatgtggttcgatgtgacagagtataaaatttttgtgtgggaactaaatagggcctgtagtgagagcgtaaactggggagtgatgtgccaatacagtgacactcacaaagacgttaaaatccccaatttatccattgttcagatgtttacttgttttagatttttactggttcttcctgtacaagtgcagtattgagaaggtattttcttaaatggaattatatgtaaagagtgagctaagcaatagtgctggaaaaattctgtgcttttattttaattaattattaagacgtactttatatgaatagtttgtactttcatacttgttgtaaggtaccgaattttacaggaaatatgggaagtttgaaaccaatcaagaatagtaacctgaatagtgtcaaaccaaggaaaccagaacagaaacccaactagctatattaacctataatacatcttaagagcaagtggaaaatcagacaatctaaacaatctgaactctgaagaagactaaagaacaagattaatcaacaaataccgtgggcaagactgaagaactgccttccataggtccataggcaaaaggcgccgtcgagctccaaaactctggacagcacctccaaaagaaaaatgctgtacacaacattagtccggggctataatgaaccgaaatatggagagccgcaaaaaaagacgttagctgaataaaaacctgtattgaagctcaaggagcaaatttaccgtctcctcacttccaatttgagcattgacagcaacaggaagcacaaccatttacaactttttttctattcttctaacctgttaacaaatgaattatattttgagcgatggctgctttcgccctaacaacttagggaaacagcgatcacaggcttacacatgaatattgctgtacaagcaaaaagagatggaattaacactaaggtataaaaaga

SEQ ID NO: 50091 - DNA, 492 bp, Oryza sativa
ttcatttctgttaatcatttaactccttactgatttgtgatatttgagttgaattgtagcctcataggccctggcagatgataaatatttcaattgcataagatttgcagtagttgagaatgggtttatgatgattttggctaaactgaaatttaactgcaactatggttaaattctgttgcaaatatggcagactttctataccttttcagtttcatgtgtggtatgatctatggatctccttattcaagaggatactgatttacttgaatttggtatgagatgttacttggagttttcggttagggtgacagctgagttccaccatctctgattcaaactttttgttgtgcttttaatgttataagaataaaattggctgagttccactcaactccgagcccaattatttgttcttaaactgtatcttctgggaaccttatctcccattgcagactaaagatttgtattttttttcttttgctgttattc

SEQ ID NO: 50092 - DNA, 1118 bp, Oryza sativa
ttctcgggcggtggagatggactgttgtcagatgcatcgctggcacatgctccactgatatgctcttcgctgccactggcgttgttggattcacgggaaccattccttgtcttcaccatctggagggggataggtagaaatatgagaaaaggaagaaaacagggggcttagaaactaatctttcttataaatttacgtgcaattatcttaatcttgattaaaacactgaaaaagaggcaaacaactcctaattaaggcagacataccactgacacatgatatcgaccgccgactaacccacaagcaacaaacctaaacacggaaactagcaagcaaacacactaagaagacgataaagctaagggcggcgactctgaagcttggagcggcgcttgcgatcgaggaacaggtctgacatctaaagatggacaagggataggaaccaattcatgctcaaatccaaattaaacaaagcaacaaatgactcaaataaataaccgagcatgactgatttttatgcatagaacatttttcatgaacccagataacgacactaatgcaactgactaaacaataacttaatgcataaaacagatgcatggaaaatgatgcgcataaaaatgccccatcaaacatagacacgacctaatgcatatcacccaatagattcccgactgattgtcgaataaactccaaatatttttttctaaaaccctagactgagctaattttaaagatccgatccgaatgaacgaccaagatttttcccgcaaaccaaagaggcaaaaccccaaattttcccgaaacaaatccaagtacaaagagcatatgcagatgaaaaggggttcagagggctcttaggtttccagttggcttgttctacggtcaaggtcggctctgataccaacttgtcacgcccagaaattcacgaaccagaatttctaagctgaatgtgcatcaaatccctgtccaggaccagccagggtacacaaacgacagttgttgacatatagatccacgtcttacaaaaatagaaaagattacaaatgcagcggaaagataaaacgagctagacttggacgcttgacttctgcagcggggcgactccactccacagg

SEQ ID NO: 50093 - DNA, 1501 bp, Oryza sativa
acgatttccccctttgcagtattatggtgatacttcggggcatgtcgacatgtgtggaatcgtatcttgtgggtacagttgtacacctctggccagagtaaaactattcgaatagccgtgcccgcggttatgggcgatcacccagattcaccgtgattagtcttacccctagtttagcttaatgaactggtgtagttcaggtggttggttgggcctgttgcaacgtggtgtagcgttggacagtgattggttaatattgattaattactacaactgttttactgctttcaacttctgcttttaaatgctagctttgtgcaaatgaacccctagcctcctttggttatatcctacatcatacctcctcttccggtaagtcttgctgagtacagtgggtagtactcagccttgctctcttttcccccacaccagagttgaagttctttccagttggagctgtatcgaagaagttgatctcatcgctgccgtcaagggatgcctgtggagtggagtcgccccgctgcagaagtcaagcgtccaagtctagctcgttttatctttccgctgcatttgtaatcttttctatttttgtaagacgtggatctatatgtcaacaactgtcgtttgtgtaccctggctggtcctggacagggatttgatgcacattcagcttagaaattctggttcgtgaatttctgggcgtgacaagttggtatcagagccgaccttgaccgtagaacaagccaactggaaacctaagagccctctgaaccccttttcatctgcatatgctctttgtacttggatttgtttcgggaaaatttggggttttgcctctttggtttgcgggaaaaatcttggtcgttcattcggatcggatctttaaaattagctcagtctagggttttagaaaaaaatatttggagtttattcgacaatcagtcgggaatctattgggtgatatgcattaggtcgtgtctatgtttgatggggcatttttatgcgcatcattttccatgcatctgttttatgcattaagttattgtttagtcagttgcattagtgtcgttatctgggttcatgaaaaatgttctatgcataaaaatcagtcatgctcggttatttatttgagtcatttgttgctttgtttaatttggatttgagcatgaattggttcctatcccttgtccatctttagatgtcagacctgttcctcgatcgcaagcgccgctccaagcttcagagtcgccgcccttagctttatcgtcttcttagtgtgtttgcttgctagtttccgtgtttaggtttgttgcttgtgggttagtcggcggtcgatatcatgtgtcagtggtatgtctgccttaattaggagttgtttgcctctttttcagtgttttaatcaagattaagataattgcacgtaaatttataagaaagattagtttctaagccccctgttttcttccttttctcatatttctacctatccccctccagatgg

SEQ ID NO: 50094 - DNA, 1501 bp, Oryza sativa
acgatttccccctttgcagtattatggtgatacttcggggcatgtcgacatgtgtggaatcgtatcttgtgggtacagttgtacacctctggccagagtaaaactatttgaatagccgtgcccgcggttatgggcgatcacccagattcaccgtgattagtcttacccctagtttagcttaatgaactggtgtagttcaagtggttggttgggcctgttgcaacgtggtgtagcgttggacagtgattggttaatattgattaattactacaactgttttactgctttcaacttctgcttttaaatgctagctttgtgcaaatgaacccctagcctcctttggttatatcctacatcatacctcctcttccggtaagtcttgctgagtacagtgggtagtactcagccttgctctcttttcccccacaccagagttgaagttctttccagttggagctgtatcgaagaagttgatctcatcgctgccgtcaagggatgcctgtggagtggagtcgccccgctgcagaagtcaagcgtccaagtctagctcgttttatctttccgctgcatttgtaatcttttctatttttgtaagacgtggatctatatgtcaacaactgtcgtttgtgtaccctggctggtcctggacagggatttgatgcacattcagcttagaaattctggttcgtgaatttctgggcgtgacaagttggtatcagagccgaccttgaccgtagaacaagccaactggaaacctaagagccctctgaaccccttttcatctgcatatgctctttgtacttggatttgtttcgggaaaatttggggttttgcctctttggtttgcgggaaaaatcttggtcgttcattcggatcggatctttaaaattagctcagtctagggttttagaaaaaaatatttggagtttattcgacaatcagtcgggaatctattgggtgatatgcattaggtcgtgtctatgtttgatggggcatttttatgcgcatcattttccatgcatctgttttatgcattaagttattgtttagtcagttgcattagtgtcgttatctgggttcatgaaaaatgttctatgcataaaaatcagtcatgctcggttatttatttgagtcatttgttgctttgtttaatttggatttgagcatgaattggttcctatcccttgtccatctttagatgtcagacctgttcctcgatcgcaagcgccgctccaagcttcagagtcgccgcccttagctttatcgtcttcttagtgtgtttgcttgctagtttccgtgtttaggtttgttgcttgtgggttagtcggcggtcgatatcatgtgtcagtggtatgtctgccttaattaggagttgtttgcctctttttcagtgttttaatcaagattaagataattgcacgtaaatttataagaaagattagtttctaagccccctgttttcttccttttctcatatttctacctatccccctccagatgg

SEQ ID NO: 50095 - DNA, 1501 bp, Oryza sativa
catatgcaagcatcactttctttttaattctttttatgctatggtacactggtacttttacgctatgttaatccttttatttttgtttctttaggcggcttaatgacaacagtttaaacggtccaatcccgagggatctggcaaaaatatctagtctcaaagtgatgtaagtgctcagttaacaatgctgtttcacataatttttatgttctgtacatattaatgatgatcttttatttgtctatctattcttgcttccagagatgtctcgaacaatgatctttgcggcacgattcctactagcgggccttttgagcatatacccctgaacaagtaagatctaaaagccttgttaccaatttattttacaattatgttgacttgttttttgcttttgcacatccaatgttgtgcttctgtataaatgagaggacttgagacattagccacactattccatcagccaaaaaccaaaacacccgaagtcataaaattgattactagtgaacctcggctaagtttttctgatttgacagtgcagctcatcttttgccataatactaatttggttgttatgtagcacatatctatgtaccagataaaaagagtgctctactcattttcttgaattctttatcttctaagagctactcatttttctgtggtatgccatagatccagagtttatttttttatttcttttccatatacgctaattgctgaatcagaattaatcgacacaacaaatgactcactaagtgccatattttgttttctatgtattgtggacttccattaattgtcgtcacttggcatatgcagaactcatcgccccagtttgcattgtttctaagccattgtttttctctctgcagctttgacaaaaatccaaggttggaggggcccgagttgcaagggcttgcaacatatgacacaaactgctgaacgtgccaatcagtccctgtcgctcgtgtgatatagatcaatagcaaattagctttatcggagtacctggtaaatgtgcaagcttggttgctttgcttgtacgagatactgcaagtaaagactaggctgcagctcaacccttgtagtgtagataatatttatcgcaagcctgaggccctcttgactgataatacctggtaatgtatggttgctttgatgaactaagtcttgatatttattgccagttttgatttagttgccctattataagggactggttcaaaagttctctttacttttgcattgttgactgttgagatgccatgttgttatggtccaaaatgatatgccgaaatatgtttttaaaataaataataagcagcgctggtactactgattattctattcgtttatgcttaaattgttcacttgtagccatgcctcaattcctctttggcgcttttctttcttctgacatgcgttgcctaatataattatacaaatattgaccatagttggaaaactatacttaggaacacatgtcacacaaagtgta

SEQ ID NO: 50096 - DNA, 1501 bp, Oryza sativa
attttccataggatttttaatcctctatgtttccttcagttttttttgtatgttttaaaccgttgcatacatgtgagagagaaatagatggaaatctgaatgaagctagggcattcttagtaagccacacaaaattgtattgtggcccttatgattctggaaattatatgggtgttaattatgctatattcttttcagacctaaataaacaaattttatgccaccgatcaacaaataatttagtatggtgctgtaaaagcattctcattatctcattccaaaggaaaagcaaaagctaatcctccattccaaacataaaattccctatcgaatacaatgccttcactttaatccttttaccttgggctatccttttctcattaatggaatgatggatgaatgcacatgctttctgaacttgtgttttctttaaaaacatatgtataaatatatttcttagaaagttatttaaaatttatttttagactaaattttacaacactacaaacacttgaaccaaattatcataaaactacgagatgttgtatcataaaactacagattgaacataagatttatcaagtatcacaaaaataaaactttaatactggagttatcataaaactacaaattttacaatttaaatccctaccactactattatggtgagagttataaatgttgtagtcttgtacttaggttggtgcaaaaccgataatattattattaaatatgcagtggtgatcttccatatatgtaggtttgtgatataccatattaaatttgtagttttgtgatgtcaaaatacatgtaattttataaaatttactcttatttataactttatggagtaacagctactccctccattttatattataagtcatttgactttttttctagctaaacttctttaagtttgatcaagtttatataaaaatacagtagtattttcagcacaaaacaaacatattatcagaatatatgaactaatttaatattttaaatgttactaaatttttctataaacttgattaaacttaacaaagtttgactaggaaaaaattcaaataacttaaaatataaaacagatagagtaattcatttataaccacgggcctgtagcctggtggttacaagagcctcagtagcacctgaggtcctgggttcgactccccatgagagcgaattttccaggatttaacggcgttgtgctttcagtgataggcgaattttccaggatttaacggcgttgtgctttcagtgataggcgacgtacccctcgacagcgaggcgttgcgtgtcccatctcaccctcacaccgtcacacaacaagctcactcgcgcgtatttacgccgcagaagatccgagcgatccctcccccgactcccgaggttaaactcccctcaccacctccgcttccactaccttcactcactccgcccatttccccactcctcctcgcccgcatccggaaccctagctaagcttcgatggcga

SEQ ID NO: 50097 - DNA, 1501 bp, Oryza sativa
ttctcatgttgcccaacaaacaaattttctgatttttgaggtgtgcacatgtctgtctgaactatttacccccatacccagccgatttttgcaagtgattccccatagaattttggcaaaacttttccattttccatgaatctgcaagtgatatagaagttcccaatgcaacgcatgctatcttctagtagaaatgatagtggaatcctaatacaagaatacagtttaataatgcctagtaacagaatgaaaaaaatagaacatggtataaaccatcaattttcaaaacttgaaaaggaataaacttctttagtataaaagctacagcagaacacaagtacctttttcctcaaacgactcttccttgcagcctcgcgattttgggcgagccgacgcaatgtctacaaagtgataaggaaaatatttgttgcaacaacgataatatgaaacaaaaaggagagagctacttgcaaaattttaccttttgatcttcatgtttgtccttggatctgtcagagtcagaagcagcagcaagagcaagctgacctggttcaagctgcaggtgacaacataactatcaagctcccgatattcctattttatataataatgaattttaccttcttgattcctgatgttttacataaaaaaatgaataagactccaacttttatgaaaaagaaagatcagtttgttttgaaatgtctgtggactaaaacatattcaaaaaaatgaatttgatcacttagctttaattttgtaaaccaacaggcattagcatgtaatttttgtttatgcatcctattacttaggccacgttcttttgcacaactccaaactttagcttcctcattttccattagaacacttttcaaactgttaaatggtgcctttttttgcaaaaaaaaaatctatatataaattgttatttttcaagtttataatggtttctcgttttgcatgcactgaaaatctccgtaacacctaagggaaagaacacagccttagtatctattaaattactttctgccataacaaatttctcaatgcaaaaaagcccacatctttatcatattacgcaacttataaataggcctgttacgatttgcatttcatatttttcaataaacgtgtctatatcttttgatcatgctatataccaaaagttaaattacacaagctattggaagggataaaatatcaaacaaaatgtattcaaggaactcaagcgaattcaaggtgcataaggatccaaatcgcatgaacgaattccacaaatctcacaaaaacgtgccataggcaaactttgccagctttcttaatggggaaacccaactgtttatattgttttctggtagtccctaatttgatagacctatgtgtaggtcccatgcacagcacatatgcattgctcagtagctcaattggattattaaatgccaacatatcaaactctgcagcaaagggcattctctgataacaagattttcgtatgaaacta

SEQ ID NO: 50098 - DNA, 431 bp, Oryza sativa
ccccttgccgccctctggccgggcggcaggcctcactgcctataaaaggcctgttgcccagcccccagccctcattcttctctcctcaattccagtgaaaaaaaaaagaagagaggggaggagaagagaagaaggggcgaagccctgccggattcagacgccgatttcaggtaatattcatagatcctatatgtgactattgagttaaatagtgtgtattttttaaaaatttgtttgaataaatgcattatatttttagggttttagttgtactaatctagaagtgcgtattatagatatcggtaactacgtagatctgctagtttggaatcaatacattaccgttgcattggcttacacaagaagatattacgttgtagatgtttattgcatgaaagagtaatatgatctagttatttcgttgacagata

SEQ ID NO: 50099 - DNA, 1501 bp, Oryza sativa
gttctacttggacaaagggacatctatgggtataaatacaagcccccctatgaggagaggggacaagccacaagaccaacacaacatacacacaagccaacacacgccgccagctatcgatgtcagagataagcctagacataccccatccggtacctacagaggctggtaagagggatctagcgtcatctctgatctcgacaagttcgtgcttgaggaggaaaactacgctgtcgtcgactacgggttggttatccatgccgctaagtcgatgacagctagatgtgttatcccaaatattgtactggtgtgattataatgaataagagcaacaccggctttggccaacaggagtagggctattacctgtcagataaggggcccgaacctgtataaaaatccttgtctgcatctcttttacttcaatcttgcatataccatggtaccaacgatccccatactatgcaaataccgtagtcgcgatctcaaacgtcgacaaccccccaattcatcaaattcaaagtggtcagaagaaccggagccgagttaggctagctctattttacactttgagtttgggaaaaaccatactattaagaggggtttcatatgtgtggttctgaggatccttaagtgctcttagccatattttcttagtgaaatatttttgggagctattttttgaaaatagcccctcccaagacagagaatcctacctggaagttttggaagctttggccggaacttctgggcctaggagtggaagagaattttcctaagtgttggccgaaagttcctagcgcccaggactggaacttccaggcagtatttcatatcaaatatgtgagtaatggctagatgacgtcacctagccgttgtagatatcaaactcgaccccagctcattctttggtcatttcacttttgctttcctattccctagttgtttctagcctctcccaatgtgaatttgtttccttccaccaaatcttaagccattcttgtataattagcatttgtttcttggatcattaacttattgtgttgatgtctttcaggcagcgcgcaaaggcgcgccccaacatctagtactaagaaagctggattggggtgcctaggtcggtatcattggagttttaactttttgctaatgaaacctgatcgcacgactgtccgggggggggggggagggggagttggaaccacatgtgccacgtggcagggctttttgcacgagaaatcctctcagaattcggtatcttattatctaaagctggcggtgggctttttgcacgagaaatcctcttagaattcggtatcttatatctatactaatataaaaaggaggagttgtccccttgcaatccaactggtgaaatcaaccagccaaatccttaccatccatccatccattcaacgaatccaacggttcagattattccacgttctcccctcagcctctcctccccgttcccatccctcctcccgcagaccacggctca

SEQ ID NO: 50100 - DNA, 1047 bp, Oryza sativa
gagcgaacgaacgtgaacaagaacgagcgaacgaacgtgaacgagaacatgaatgagcgaacgaatgtgaacgagaattgaacgtgaaagaatgaacgaacgtgaatgaacgagcatgaacgaacgtcaacgaacgtgaacgtgaactaacgaacatgaacgaacgttaacgaatgtgaacgtgaatgaacgtgaacgtgaaatgcaatataggcaggtgaatgaatgtgaacgaacgaacgtacgtgaatgaaacgtgaccttaacgagaacgcgaacgtgaacgatcgtgaacgaaacgtgaacgtaaaatgcaatatatgttacttcgcgtttatcctaatacatctttttgtatcttgcagaaaagacgttgttggagtcgtccctcaagccggagtggtagctagccctcgaaggaattcgcgcagacaagtgacgtaattatatatatgattgttatatttgtaatgcaattaagactattagatttaatatacgacacttagacttagttttaatataagattattatagtttgtaattagactttagtatataatttattgactagctagggtcctataatatacgtcacctagacttagcatatatcactatttgagttttaatataagattattagatttgtaattagacttagcatataagattgtgtagggttctaatatacgacagttacacttagcatacatgactatttgagttttagtataagattatttacgttttaatataagattattatagtttgtaattatacttagtatataactattgactagctagggtcctataatatacgtcacctagacttagcatttatcactatttgagttttagtataagattatttaagttttaatataagattattagatttgtaattagacttactatataatttattgactagctagggtcctgtaatatacgtcacctagacttagcatatgattgttagcatataagattgttaaaacataaatgtctcatgacttagcagctgtttcatgtatgaacaga

SEQ ID NO: 50101 - DNA, 1501 bp, Oryza sativa
gagttggggggtttctaccgattcggaaggtttacctcgagtggttccaaacttccactccctccccggccgttggaccgccgccgcaccggttgctcgcatcgcccgcccggctcccgccgccagccggttgttcttgccgcctgcgaccctcgtctcggcggcatcgcgccgtcgccggccgcctctgcttgcgagcgtgtggcaacggagaatcgagagagggagtgagatgatggttgtggcggcccatgagaaatgggcttgacatgtattggcccatatttcggtttctatggcccatttagtttctcacaccgcagaagacaacaattaaaataccaacaataataacttttttttctctttttgataaaaaaaaccaagaataaaactagaggcaaattgaagtgagcgtagctcgactagtaaagttttctgtggtggaattagctcatccgaatttaaatcttatatttaacatggccatgctggtgcttatatttactattcccttcgtcccataatataagttattttggagagatatgatatattctagtactacgaatctgtaatttgttttgttattagtctgcgtttaatactttaaatgtgtgtccgtatatccaacgtgacacgctaaaactttacccccatatatctaaacaccccctaataaatttagagcaaagttgacaatgatcaaagcaaacaaactttctcatgcactctcttattaagtccacttttgcttccatccatgtttattatatatgtccactattctaattctaaatgcttgcttaataaactaacaactattatcaggaaattttagtggacaggagttcaaactgaggacagtaaaaaatgagtttgttggcgatcgtgggagggtatatgcaaacctacagaccaaggaggactaggtatacgagatttgctcaatgttaatcgaagtcttcttattcaatcaacttggagaattgttagtaatcccaatgatctagtttctactattatcaaagcaaaatatttgaataatacctctttctggaaagctaatgaaaacatttccaaatctgccttctggtcctctatccttaaagttagaaaatttctaaattcttcaactatttggcaactctctcaaggtcaggtattcatctggaatcaaccttgatgttcaatctgggaaaacattgataatcatttaaactctcgggctattaatatgcacttgccctctaaggttgcagaattatgggatgagaacaaaaaatgggacacaaaagctgcaacaaatttttgaccaagaagcaatccaagccattcagaatgttcagcttgttccaaatgaagacccagacaaactttgctggaagcatactccatccggaggttgcactaccaaaagtgcttacaaagaggttcataaagccactcattctcatttacaagtcatttccactttgaccattaacctgaaacggaggga

SEQ ID NO: 50102 - DNA, 1501 bp, Oryza sativa
ttccgagacgtgacgggcgagacgaaggtacagcgccttccagacttccacggatgagtgatggcacacgtgggctactaggctgggccgtattgaattctttgtttttcatttggattacgtctattttacctccctcaactcttgctcttgattgaatcgcctccctcaaccgcaataccatatataaccgccaaattgagcccctcggcggtttagctggtgctttggtcatatgtggcatccacgtggcatgttgactacgggccaacgttatagagcacgttgttgcctgccagagtagcttatcccgcggtggtggtgagcgagtgaaaggggaagatgacgtgaggctatggttgtggctcggagcggattaggggaaagcggacgctgcatgagggacggacacacctatagtggaggtgtgtcactcccgtgatcggttgattgtgccaccagaaccatcgtttaatcctcatgcctcctcctccgccgtcgacgcctacatcatcctcttgccgttgccattaggaaaaagggagataattagggatagggaaaagaagaggatgtgttaatgatatgtggggtccatcgtttttttattactccctccgtttcaggttaatggtcaaagtggaaatgacttgtaaatgagaatgagtggctttatgaacctctttgtaagcacttttggtagtgcaacctccggatggagtatgcttccagcaaagtttgtctgggtcttcatttggaacaagctgaacattctgaatggcttggattgcttcttggtcaaaaatttgttgcagcttttgtgtcccattttttgttctcatcccataattctgcaaccttagagggcaagtgcatattaatagcccgagagtttaaatgattatcaatgttttcccagattgaacatcaaggttgattccagatgaatacctgaccttgagagagttgccaaatagttgaagaatttagaaattttctaactttaaggatagaggaccagaaggcagatttggaaatgttttcattagctttccagaaagaggtattattcaaatattttgctttgataatagtagaaactagatcattgggattactaacaattctccaagttgattgaataagaagacttcgattaacattgagcaaatctcgtatacctagtcctccttggtctgtaggtttgcatataccctcccacgatcgccaacaaactcattttttactgtcctcagtttgaactcctgtccactaaaatttcctgataatagttgttagtttattaagcaagcatttagaattagaatagtggacatatataataaacatggatggaagcaaaagtggacttaataagagagtgcatgagaaagtttgtttgctttgatcattgtcaactttgctctaaatttattagggggtgtttagatatatgggggtaaagttttagcgtgtcacgttggatatacggacacacatt

SEQ ID NO: 50103 - DNA, 1501 bp, Oryza sativa
gccatctctgatctcgacgagttcatgttcgaggaggaagactacctgttgtcgactacgagttggttatctagccgctaagtcgacaacagatagataggttatcccaaatattgtatttgtgtgatacagatgaataaagagcaacaccggcttcggccaacaggatgtagggctattacctgtaagataaggggcccgaacctgtataaaaatccctgtctccatctcttttacctcaatctcgcatatactctggtaccaataatccccataccatccaaataccctagtcgtaactatcaaacgtcgacaaaaataatcctactccgtccttagaaaccgtcctttggaattcctatggaatataccatttcatgggaatttttgaggaaaactaaggttcctataattttcctttggtgttgctaaactacatttgttccctatcgaatacaatgccttcacttgttttttgggacatttatcagatcacaaatcaaatatatagtttaggtagaaacattttactttaaccatgctaaaaaaaggtgaagccacccaacctacaagagcatgccacatcatcacatacaatatatgaatggcttcatctagttgttttgatcggattttgccatccaatatatagatggaatatgctatgggtgacaaccatatcctcaatcgcccatgaactaaacaccactaaaaatgtaactgctatatcatgattgttaaaatggtacgacgtcctaaggttgtgttctttacccccatcttccaatttctatcctctcatcttttatacgcacgcttcccaaactgctaaacggtgtgtttttttaaaaaaaaaatctataggaaagttactttagaaaatcatattgatccatttttcaatctttttttgtctaatacttaattaattatgcactaatttaccactctgctttatgtgcttgaagggttagtttccaactctctataacgaacacaacttaaagcgatcccgaattggcactcccaaactaattaggtgccaagccaaaaaaaatcttatatggcagcaaatcaaggctacattttaagagcagtataacaaacatatatatctcttattcttggcaactgagtccatatagcatccaccaccttcatggaccatggtagcatctgtccccttaggaccatcaacattataaattgggcttttagattttcgggcctttcccgtgtgcaaccaatttgccttgcacatcagccattcaaatcaaatcgaacaactgtcattttgttgctgacgtggcttaaccacaaggcaaaggattcctattaactacaccaggcgtggatgaactatataggtatataagattcacatagaaaagttatttgactacaataatgaaaagactggaaaccaaaacaatgaagaggttcctcgactagcaatcataaaagcattttgattggtatcctattagattgactcagatca

SEQ ID NO: 50104 - DNA, 1189 bp, Oryza sativa
cagattgggagccagctacagcacagactctaagacgcaatgtgtgtatgataaatgggaccagatattaaaagtgtagtatatgtttatagataactattgtataaattgactataattgactatagatgatccggagctagtagttggctatactattaaacttgctcttacatggaaacctaattacatgtgatattcgtaaacctatgatttaaatcctaggttgtgttctttctcccacctttcccaactcacctctattattttccacgcacacgcttcccaaactactccacgatgcatattttgtaaaaaaaaaatctatagtaaagttgctttaaaaatcatattaatctatttttaacttattttagctaatacttaataaatcatacactaactattactccgttttacgtgttgggagcgagagggtccccaattaatccttactcccgaactcaacactaatagatgaagttatgcacccatgccacataggatttaagtaacacgaaccggtaaaaccctttctagaattcctttaaactcacaatgtgatacaccctgtgagcaataaaactaaccaaactgcctggtttgtagtttagtgaaaaggactaagatgtgatgtcgaaaatgagagaaacaagaggcgcacaagcttcctatgtgctaatgttcacaggctgcgctttctatgtgcacgaacaacgaatctcttttgtttttcctcgcaaaaataattgaaaaaacggagcaagattttggcagatatgtccaacgggtttcttcaaggttcaagtactggctaggacggagccacgtgtctggccaggaatataacatgtcgtggcaagagaaaatggggagaaaacctatatatctagtggatgacatatcacaggcatagtctaaaatgaaatatgtgcatgcatgatggaccacatttttgtaacttgtaaaatatcactggagtcagccaaaaaatctcttcggacttggcaaacgaggtgctataatccattggcaaaattggttatgagaagatcaaaagttcagttttataacatcatacaaagttacaggttagctttgtcggaaaaaaaacttaatatatatagcgattgtttatgtttttgctgcaaatcatttccatcaccttaatggccctgttcggtgcagc

SEQ ID NO: 50105 - DNA, 1220 bp, Oryza sativa
cttgccaaagcggggcaaaatcattaagctagcattgcgaggcggtcgggtaacaagacgagtggagagcgcgtctaggggtgtaagtggctaacccgcgaaacccacttataggctaaaataaaccgcgaacccgcttattttgaactataagtggattcgcggctgacccacttacagccctaagcgcgtctacgaatctatgaactatttttttttgagagagtacaacgaggatgcacacacgaactcactccacactcacacaacgcaacactacatgcacacacacacacgtgcgcgttcaacacacgcaaatgtagactttgaggacctaaatcctcacatgtgcgtttcccgcacaaatcctcacatgtgtgtttcccgcacagacccactgaacacgcacgcatgtgtgtaccctattatctacttgggaccaaccgaagtgagtcccaaaaatgagggacgagcatcgagtctgggagtcgaacgctggccggcaaggagcaagccacaggctcctgccacctgcgcgtagcgcagtcctcaatctatgaactatttgagtggcacataagaaacaagaagatatcctttcgaggtaaaagaaatcaggagctcaatttagcgactcaacttttcactacttaaacattaatcatatagttaaaagaatttacataataggtgtatctacattaatgctaaatataaatccaatcaaagagaaaccaaataaactcattcatgttggaatatattttttaaaaaagaacattaatatgcatggattgcaacaatggcctatgtcacttcaccaacatgaaacactaaattcaaatatacacatcttgcaaaaaaaaaacaagaagaaagaaacataaagaaatttggctatgagccgtgttagtactatccataattgaatttaattattttgactcactgcatgaatttgtacttgaaatttttcaagttagtctatatattatataaacgtcatcaattttttttgttgatttttctataactatttgattggtacttgaagaatgagaagcaattgcatagaggcgtataatgttagtaccaaataaggcaacaaacaatcaatttatatattcataaattgcatattgtagttccttttttttaatgaattgaagagcgacaatttgattagggatgaaaacggagcggataatttccgtccgcta

SEQ ID NO: 50106 - DNA, 1501 bp, Oryza sativa
tggaagagagccagattttctgtctggatgaatgaactgcaaccgtttgcaccgacaaacaattcgggctttcttctttgcaagatcaccgggatcatggcctgatcggtagcaaatatagatatcaagcaagaacactccgttggcacgctgccttctgaaggagcaaaagcagtcggtgtgtgctgtgaagacacttttttctcatgtgccggtactgatggtcagtataactcacatctcttgtttactttctcactttactcctagcatctttgatcacgatcagtatgatctgatcatcaccttggatcttcagccccattaaaaagcaatcatcggttgtcgatgatcgatcccactattgggttatttggatattacaatcgcattcaatatgaaagaacgaaagaaagatagagagaaaaggggcactgatcagaagaagaaagaagcaaatctgttgcaaaaaaatgtgttctggtgatgcctgagagttgagatgagagctcaactaccagaaaacgactgacactaactaaaggcaagctgatatatgtgctccatggaattcttcactcaaaagaagacagccaggtgaccaaaaacagcctgcctcagctttgtcaacaattgtcataacgcaccgacatgattagctctgattcccaatctattgacaagaattttgtgtggttaaaacaggtaacaacacagcacacactcttaactaactttgtgatcatccatcactttccttgtagtaatttattcagtactaacatctagttgcctttcagatcagcaaccacctggagatattcagatcattaaccaagaaacaatgcaattgtaggacaccaaatgcagactgctaattgctcactaactaaagcttcagaatgagatcaatgaaatgataagcctaatttaagtgcaagaggaaaaaaaaaaggcaaaggcaagcaaagcaaagcaaggcttcatctccaccaagtagagacagtgtcagaccgcacatattccattcctcgcagccaagcaatctcgtcagaaaacaatcatttgggcagaattaattttgatctcaaccagccatgtggctggtcaggtgacggcgacgacgacaacaacggcgactagcggatcaccatgagaagtttctatctgccatgctcccatggaaagagaggagctactaaagaatcatcaaaagagatagaagggtacataaagaggccagtcagagttcagatgaatctgattctgcagccatcagaaaagcaaggcagaattccagctacaaattgggccccattctgaagagtttcatatcatatcatctcctacttagaacttgcacttcagaggaattttgcacgagcaaaatatttagccatatatatatattagtaggaagggaagctagctagtgtggtgtgtgtgtccttactgcaacctgcttcactgaagctcagtgatctttgagaagttccatcca

SEQ ID NO: 50107 - DNA, 1501 bp, Oryza sativa
cttaactgcagttgctatactctgatcaaaccagattatgggataagtttttactattcgctatgatgtaagtatgaaatattagggcttgtttgaagtctttgaacatagaaatttgaatggactttgtaagaaacagtgcaaaatcccccattgacacattttactatggaaattcacttttccaaaggtatcaagttcaaattttgtggaagtagatagtctatttagaagtagactatatgttgcaagacaagcatgtttggggaaaaaaattgtttgccacaaatgaaactcccattctcatttgttccactaatttttgtggtctttgacatttgcgacattagcagtcttctaaaaaaaaggcatttttccggtttgactgtcagggggttgaaaagtaaaaatgagaaaaagacaaaactcatagcataaaaatatcataaagtacagaatattgaaggatcacatttgaaaaaaaaggctcagaaaattgatatactaagaaaaaaatctatgaaaacttctactaggtgacaatgataagtttatttatcatttatgcaacatccttaagatcttaagttttctgaaagtttacaaattctatagaaaatatcgtccttgtatttttctgttacgattttctgaactttccatgcattatgcttgaattctcttaacagttaccctgccctgtaagaaaaggaaaatgacatttttaggaggtcactgtggtagtggcaaatatgaaaatagtgaagaaaaaagtgccataaatgagaacaggacactcattagacatgaactggaaaattcatcatatatgttctgtatatttttttatatttcctggtttgagattatgtttcatgctctgttactatatccaatttgcacaagaaatcattgtaattaacaaggtgagaaacaaccttgaatgtgttattagtggaagtataatgttaaaaacaagaatagcactatagactttttatataaagttggttaggttaatagagtaatttgactgtttttttcttctgtatgctgcgtgtctcatcttatttatgatgagaagtagtggagatgtttctgcatgcatactcgatactctgttcagtttcatagggcgcacgcgaatatcaatgttcaaagtttgtatttttttcttctagaattagtccagcattatctagattttgttttaagaattggcaccattggatttatattttaaaatactttcctatggccataattttgttgtttgaacaatatggtgtaaaaaagtaacggtcaaactttcagttttggagacccaaccaaatcaaacagtgccttgtaaaaatccaatgtacagagtaacatgtttttacttggctttgtaatgattaaaagtcatgttggagtctctgagttaaaaggcctgagtttattttgaatattcttatagaagccaaccgtggttctaatattgacgtcttttgcacaaatt

SEQ ID NO: 50108 - DNA, 1501 bp, Oryza sativa
gcgtagggcggcggcggctctagcggcggcggcgcgcggccagagctcgtcggttagcggcggagcacgggctcggcgtggggagaacgggagggggcgcagggagctcggggagaatagggaaaaatggagagggaggtgctgggagtgtttttatagggctcggggatgaagatcgtggccggacgtggcggatttgaagggggaaagtgggggtagcgacgtggggtggtggcggcttggccgatgccgatttttgtgggacgagtaggggggtttggtcgaggaggtggaggggatgggcggcgtccaagcctgcatgtgagaaggcgcgaggaggctggaggaagcggcaatgtgggcggcgtggctggcggctgccggtgggtggctggaggttggggatgacaggtggggctgcgggtcccacctgtcggagagagggagggagaggggaccggaatgggaggggaggtggactttgagtgagagggggaggggaagtgagctgggccggcctgagaggaggcggtttttggcccaaagcaaaggagaaggattttaattcgttttctctttattttaattgattaaatgaactttgttctattaaaattatttcttgagctccgaaaattcgcgagaaatttcagagagtattttaggacaccgagaatattacaaaatatttttggccatgatttttaaaggaaattttaaagtccctcattatttcacttgattaaattgctttaatttttatttattttctagaaaatgcattatttaatgatttttaatcccgaatgaaaatcggggcgttacaatacccatcgggttctcttgccccatacccacacccgcgatggataaatattcccacttaaataccacacccgtcgcgggtacagaatcgtcccgtacccacacccgtgtaggtaacgggtacccatacccatataattgacttgtagaatttatagttttgtactgtaattagccatattagaactgtaaaccattaatattttctctagcaacaatgctattaagattatcattcaaaggcgagtaaaaagaaaattctacaacgcgagtaaaaagaaaattatacaacaacattacgtaatcaagaaattaaataataatttcatataactaaattggaataatgcttaatatatgaaaggagttttatgctataatttagtagttagagggacttacgttatttattgttttaggttcaatctacgagtttctttttaggttcaatctatggttttctttcaccaacggatggtgggtacatataggtataggtaaaaaacatatccatacacacttatttaataggtaagagttatttagtagatccgtagatataaaagttagaacattttttccctgatagagtaaaaacccgtcggatatcgtgtcatgtttcccattgccatctctagtcgagtatcgcgtaaaagaaaaagaaatctccccgtct

SEQ ID NO: 50109 - DNA, 1501 bp, Oryza sativa
cgccgccgcctccgagcccctttaaaaggacccccggtgtctcttctacccgccgccaccctcgccttcgcctctcgtcgccggaatcgttctagcgccgtgtgccctagcttcgccgtcgccgccgcaatctcagccgtgctccgccgtcgtttcagccgtcgccgtcgctcgggaagaccgccgttgtgctcgtcaagtcgtcgccgtcctcgtccgccccttcgcagccgtcggaacccgccggagcatcgtcgccgtcgacaacccgaaggtagccgccgcttcctcctcgtcgccgtcgtcgtccgttcctcctccgccgccgttttggtcaccggtgtgttcgccgcgttgtcctctacgtgctggtgccctccgtttgtgccgaggtgccgccgttcgccggcgaacgtgcgccgcccgagccgtctcctccgccgagccgccgccgctgtcggtgacgtcaccgctgacgtcatcggaatcgtctcccgtgagccgctgtggacccgatcgatctcagccgtccgttttgggtgggatcaatcttggccgtccgtttgcgtgaaccgtcgcccgtgcgcccggtccaccaaaccctagcccgctgacgcaataaaccctcttttccttttcaaaaataattcattattgcatcataattcaattttaaccgatttaagtgttttaatccgatttaatctttaaaaattcataactaattcatcttagctccgatttagttggttcaagtctctaaatttttctaaaattgagatctacacattaaaaatatccacatgtactgttcaagcttgtttttgtgctgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggatttaacctattgtttgatatagcccttttgttcttgattaccttattccttgataccttgggttataatttgactagttgagctttatttatttatactggttcaactagatattagatataattgcttagccctgcttagaaacattagcacattcatgggataactaatgccacactattatttcatgatagtttattgatagttcacgatggttaatcgtgattagataattaattaatgtgccaactaaaacctggtaatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggagcaccagactgagaagtggcggagataagcccacgggggttcgctggggagtccatac

SEQ ID NO: 50110 - DNA, 674 bp, Oryza sativa
tctcaatatgtggtatactgaatacaagataagtccacggttagagttatatatgcaatttctagtgaagttgcatatatctaatctgcagaattgttgtcttattaaggatgggatggtgtgaatgttttaatatatattgttgtcttgttgacctgatgtttggcatctgctttggttgtccaatcttgagatgtggattagcaggcgttttatcagtacagaccagcttaatcgaactcacggtttgttgtttgctgtttgcctggtaaagcgtttggtacaatctatgaatttacattatttgcgtgttgattaaattgtaaaacgtgctagtttagttcctgatttgtttattctgcatcaaacactggcctctttaagaatttaatgacgtgattatttggccagactgttatatgacgtgtaatcaggtcagcttcatggatttgggatgtagggaatggaatagagggaataggtagactgatggttaaatttattgatttggggcacatggactcatcagatatgtgcttatttcttttctttcaattgaaccattgattagttttgtgttacatgattgccaatggaatgaaatgcacccttttttttttccagttctctgagcttcttttccatcttagtctcactgactaacttttgtcagg

SEQ ID NO: 50111 - DNA, 1501 bp, Oryza sativa
caagccacgcagcaaatatgcaagtgcacaggataacaaaggatggcataatagggtttcatttgcaaaagcagcatttagcaaatatttcagaatttaataaaacagttaagtattaatcaatattaatccaacgctatacaacataccctgttgtataggcccaaccattctgaacaaccatcccggctgcacagttctatctccaaaccaggaatataccattccaaaccaggagctaatcaaattattaccaattatagcatcatttactaaggtgagaagggtgagactaatcacgaaagacattgttagacccgcccataaccgcgggcacggctattcgaatagttttactttgatcagaggtgtaccactgtacccacaagacacaaccccacatcatgtcaccatgtgcctcaataccaccacggtatctcggaaaggagtcgtgacaatacccctcgcataacacaatccactgcaatgcaccctcccggatcatagtcacccccttataaacaaggtatggactccccagcgaacccccgtgggcttatctccgccacttctcagtctggtgctccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacattaattaattatctaatcacgattaaccatcgtgaactatcaataaactatcatgaaataatagtgtggcattagttatcccatgaatgtgctaatgtttctaagcagggctaagcaattatatctaatatctagttgaaccagtataaataaataaagctcaactagtcaaattataacccaaggtatcaaggaataaggtaatcaagaacaaaagggctatatcaaacaataggttaaatccacccaatgacattcgaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacaaaaacaagcttgaacagtacatgtggatatttttaatgtgtagatctcaattttagaaaaatttagagacttgaaccaactaaatcggagctaagatgaattagttatgaatttttaaagattaaatcggattaaaacacttaaatcggttaaaattgaattatgatgcaataatgaattatttttgaaaaggaaaagagggtttattgcgtcagcgggctagggtttggtggaccgggcgcacgggcgacggttcacgcaaacggacggccaagattgatcccacccaaaacggacgg

SEQ ID NO: 50112 - DNA, 1501 bp, Oryza sativa
cgggttcggtacatcttaaaatttacgaattcagcacggacatcagctgaatcaggggcggatttagggcccggccaggctgggcagctgctcgggctcctcggtctgcatcagtacatcggttgctctgttttgctggcgaagctgcatgaaaatctgcacttttttttggcagcaagagcagtagcaagcacagcgtttggccgatcagcaggagcactgaagtgctaataagaattgtttttctattagtcattactttattgtgatctatatttgattaatcaatcagatttgtactggattaggatcctctgtgtttatctatatctagctctagctcaaacttaatgtcacggcgtttagttgatacaaggaaccatgatgatactttagtgaaaaatattatttgcacaatcttacatatgtgaaagattcttgtgcattaccattcattagacttgtccgggcttaaaaaaattcttggctccgccattgagctgaattagtcgtaaatgcgagcacgtgtatctaattcagaatttaaaccaagcgagctgacctaacaaattaaactacgctcacttcgcttttagtttttttattacacggaatatgttcttgtgcattaccattcattagctgcagcaacacactcacatcccattaatatgttccctaagctaagaccctaacaaatggaaaccaatggcccatccccattctcactaagatcatattaaaagtctatctacgcatgagcactaagatttaaaccatattatactactccctccattttactatactataagttgctttgatttttttctagttaaataattttaggtttaatcaaatttataaaaacatgtagtaaagtttttaacacaaaataagcatatatcattgaaatatgttcaatataaactaatttggtattgtggatgttgctaaatttttctataaatttgattaaacttaaaagtttgaaaaaataaagtgtattataatataagatggatggaggaacttgcagcttgggatggaaaaaatgctcgtttgggtttcataattttgacgttatctctgtgcatagtatagattatcagttcaatatctgcatagatgaatgcccagttggcgaatcacaagcagaatagtataatttctgaataactttgtcaaccgtgctcgccaaactaagaactctgtcttgcagcagatttagaaaagaggggcacgaatccactaccaggagaatatcttctttctatccgggtgaaataccatcatctaaaaaaaatccgggtgaaataccaccagaataatcccgtggttttccttctctctctctatctttcattttcatcctctcacctgttccctttcccgtccaattcatttgtctgctccaccagcaatttgcagagaggttcctgcatccagggcatcttaatggatttttttagagtacctctgagtgaatgcgagccgttta

SEQ ID NO: 50113 - DNA, 1501 bp, Oryza sativa
caaaataaagtttatattgaagttacagtgttagaaaactaaaattacaatgtaattatactatagttacatgtatgtaaatatggtgcaattatagtgtaacaataatataattaaaattacagtgcaattatactataattacatatgtaactatggtgtaattataatgtaacaacaatgtaattaaaattacagtgcaattataccataattacatatgtaactatggtgtaattatagtgtaacaacaatgtaattaaaattacagtgtaactataccataattacatttgtaactatggtgtaattatagtgtaacaacaatgtaactttagtagatggattggtaatatctttgtatgcactaaaaaatatctagtagatatcacactatacatgagcagatgagctctcaaggattaataattaatatggataaataaccaactaattttgattaagaaacgagagtgtgaattaacgtcggaagcccatccatactatcgattagtagatgcgggacctcagcagtgctgtacacgtgtcatccatctatcgtttatgggtttaatccaaaggtacaaattttgacaaatttatgatgaaaaatctgtcgacagatgtgtagactctccccaattcaaaaaatatcatcgataaatctaatctctttagaaatgtcatcgtacaagtgcttttgttctagagttaccatcgttgttaagttttcggttgcatccatctgttaagtgctataaaaagatcattttaccctataaattattaaaggttgattaaaaattttgctcttttcgttagtttacactcaattagtttgctctttacactaaaatattgaaaattgactgaaagagtaaaagttttaatcatttaataatttgtaggggtaaaatggttttttatagcactcaacgaatggctacaaacgaaaatctaacgacgatgatatttttagaataaaagcgcttgtacaataatatttttaggaagctgtgttcgttaatggtatttcttggattggagggctcgtgatttttctccggcaaacagtgtaccgtgttctgaccaccaccaacagactgtctgactactaccgttaacgtggtactgctactagtctactactactactgtgcagtgtactacagataccacacagctgcattagcctgcattcgccgcttcacatcgccatggccctcaaaaggtcgaccgaggtgccccatcgagccgacgagacagccaaacgtacgtgctccgacagtcagacccgcgtgaaccatcaagctccgactttcggaaccacccatcgctaccctcctcgaccccacaaagttgaactcccccgatctccctccctctccacgagtcaacttactcgacgctaccacgcctatatataagctaccgctccgctcaaatggcctccacctctagcagagaacgatcatggctcggtttggggcggtaattcacc

SEQ ID NO: 50114 - DNA, 1501 bp, Oryza sativa
gttcaaaaccgaaccacaaacagactgggattgcatttgcaataggcaggagaggagaggagtagagatctgaaggggggggggaaacggaagtgattttctcggccagatccgtgggaggaagggtatcttcgtgtactcgtctatggggatgttggcgctgaacgggctcatgtccctgcggcgcgaccgccggcggcggcggcggcatcaccggccgcaaatccgagcgcgctgtaagcctctttcctcgctgaacagctcacccgcccatctttatgttaagtttggctcggtggatgtgttcgttattgtcagctcataaaaagatagtatttctttttaatacctatctaactcgtctggattgatgtgggcctgttaccgatttttcacttgtttgacttcaaatttttcactttggtgaatacggaatagcaaagattattgattctccaccactttctccgtttgagctccttttaagttttaatttatttttttttcgcacaactaagcaacggggtatttcagatgggtgataccctgcataggttcctcaggaaaaaaaagatcaaattaattttgggagatatcaagggattgagtgcctttttctgcttttcttccgttcatgtctctgcaaccataacaatcctttttgtgtcgcagcaggtgggcttattgcctcaacgggtaaaagaaagacatcaccctgtcaacaagatgactatgatggtgattctcaagctggcaaaataatgagaaattcaatcccagaccttcctgaggtacgaggcattgaattccgatgatccagaaattttctttagcctgggcatgcttaggctgcgtttgagatgacatctatgatgagattatggtccacatgcaaaacgagacaagtgattagggtatggttaattaggtattaattatccatagattaaaaaaaaggatataacaaaacagaagagagagatagtgacctctgacaataatctatcagcatcaagagtccaataacatgttctgcttgtttgccattttttgctacctgtcttaaactagtgcacaattaaaaggctgctttggtgctcaaatagtcgtgcaggacaccatactaaactacagactgcaccatatagaagcatgacgcctggcgccgcttgttgcccaggagcgaatgccattggctagcagaggaacagcatcagagtccacagcggcaaaagactgggagcccgggcagctgcccatgctggccgggccctgaatccgccgctgcttagatttcaagcataatatcaccacgactcacccatcggactgattatcttgctgactgtgctaggctggctgtatattactccattttttttatatgaccatatggatttgcaatataaatgttgatctttacgtcctccattttttcttcacgcattctgatgtttgtgtatgcaggacatattgtttcgtatacagtcctttatgtcaa

SEQ ID NO: 50115 - DNA, 1501 bp, Oryza sativa
tcgtcttccaacaggtaatttagcaagaggcgcaccaactaaaaatggtaggtcaacttgtggccattgagttttgactgtcatcggctcaatctctcttccataagcagccctgaatctattcaccgagtagtagttatgcacaaactgttcaaggttaactccccgttggcgggttacataggccaatacatgttgacatggcttaccagtgtgctgccattcaagacatgtacaggtcctttggtgtaacttgacaatatgcctctcaacgttgctgctcttgtcccacacctctgcactccaattagaacatggtacaattttcaaatgccccaagcctctagtatttgcctttagctgatgcattatagctggaagtatcctgccttcaggtagcctgtatgcaatatttcttatggaagccagttgtctgttgtttcagaagctatgaagccataagcgagtggatacatccaattgtgaccatcaactgctacagctgcggccaagtgaccattccaccctccattaagtgttgtagcatctatgctcaaatgaggcctacaaccttctaagaaaccatcaatgcatggtttaagagcacagaaaaaacggtggaaatatacttgaccatccacctaaacgacactctcggggcaccgcttcattacctcggccttccacctaaacaacaactcaacactctcttcccatttgccataaacctcttcaagagctctttctttaccccgccatacagtgtcatatgaaatttcacacttgtgatctgtctgcaacctgttttgcaatctcttagcaccaatatttggatcatctctaaggatactcacagccttgctagctacccacttcagagttggagttgtagctatctgcctcatgctagacacacatgtatgctcatcgactacgacagttacatgcaaaacaaaaaatcaaagagattcatgttaatttacataaaaagtagaattaatgaaagaaaaaataaatttatttacctccacagtgctttggcctttttgtttggtgccatttatcctccaagtgcaagggcaatcttcatcaccggacttgcaataagccctatatctcatcttacatgacttctctactcctaaatcaaactcctccttaatggcaaattgccgcactgccaacttgaactcctccattgttgggtacattgttcctaaagccatggatgggttgttcttatcatatgaaatgagcatctcacccggtacctcatcactagtaggaatggcagcaccatcattattttgcccaagctcactatcatgcccatgttcatacattcgacaatcaaagccctgtgcaggtatatttgttgtgtcctcctctatcacacctaaaagctcacaaatctgtgactcataagtgcaatacgaccttcatcatcatgtgtctcgaccatgtgtatgttatccaatcaactctttccatattttccaca

SEQ ID NO: 50116 - DNA, 1501 bp, Oryza sativa
aagaaatcagctgcctccttgacaatatctctgaatttatcatcatcgaaccatccaaattttgtaattcgacagacaagctgaattagggatttaatcacaaacgtctgcagtttaggtcccctcatagcaagatagtttatgacataattcacttcaaacagatcacaatatattggtttaaaattagcagtagacaagggcacaaaagtacacaaaatagatttaagcattgtttatagacatgtatttttgcaatttatctacattaccgatgcataaaacaacagtgggtaaatggaaataaatatttggccattctaacatgctgcagaggcataaatgaattcaaggatagaatgcaaagaataaatatttgtttgttcaactcgagccatattaaataagcataagacatcaaaggcaacagaaataagttgagtcaaggaaggaacaacaaagatttaaatatggccacttatactaaatagcagtacaaacgagtgcttactgctttctgtggtaacttgcaatgcagaaataatcataactgaataaattggtagagacgtaaatgaaaacatgccatgcagatgcaatagaaaagcaaaaacaggtgaacaactgatttcatgataaatttttggtaaggaacattacagatatcaagacgcaattgcaatgaaagactgcggtcgttgacttggttcaacaagcttgaactggccagcatcagggcatatggtgttgaggcattgtccaatatatattggcactgtgaaatgtagtcactgttctccgagaagcacttgagggtgctttctgcatgtgctcgctcagcggagtctctagaattgtaaagcttttcacataacagctctaactgtgctaggctctccattgatgacatgaataaggagctccaattttccagtagaccaagtatccaatgttaatatccacgaatttgcatgaatgtttgtcacaagcttagagttaatgcactaggtattcggttcaacaggaaacttgaaaagtaccacaagagctttgaagctgaaatatatgattctagcacaggagaaggatagtcacaaactcaatacattcatattacaagagaaatgtttcaacaaaagagttttctcatgtacagtcttttcaatgacgcgtaatcaaagatgaagaccaaagacacaagagaaaacagctaacaagcttatatcgccaataccagccacaactcagcctgggtagagttatctgcaagagtggaaatgccaaactcagtgacagctaaagcagcacaatggcagaataatcatctaagaagaactttttgttggaattgactaagcatttctagttcataacacgcttaaatgagcactaacacaaacatatgcaacagttacagcacaggtaacggaagcattcgagagtaacaaaaagcttcgtgctacatttggtaagctgtttcatactaaagcgcgcgcaaaca

SEQ ID NO: 50117 - DNA, 1501 bp, Oryza sativa
caaatgtccccgtgttttctgaaaatcatgcacatactcctctgcattggaaggtttgcattttaaacactgtattttccagaaaatacacaattaaccctcagcattgggctatttgtttgaatggccttcataatttgcaaatatctccaaaaatcatattttcgcacaaaagggaccacaggactctggacttcgaccctcaactttgcattccaggtaccccctttattactgacttatgtgattatgaaatttatttatcgcatttacgattattgattatttatgatgtttttattacttataattaatatcgttgcggtaaaattgtatagaatagcatagaatatattggaactatttgcgggaattttgtgtaccattatattgcaacacttgtgcattttaccagcgtttaatttgcgcatattgaataatggaagatgactggcatcgcgaattaaaaattcgctaaatctagaatatctctgacatatgcactcaatgtcgaaattatagtggaccttgcagctccattacataattaaacctagcgctttatttactgattcgacgagattgatcaagcacttcaatctctcgttggtgcctccaagctactctaggaatgagtatgctaaatggataagcgtgttggtactcttttgactgcacggaagaagcaacttacaagattatggcgcaaaccctatctctcgtagagcaaggactatgaacaagagtgggtatatttcgactatggttcactgagtagatgacccagagagtacggtaatacggtgcaccgaatttgcaccgaatactgcggaaactcttgatgttctacccgaacgcgacaaaagtcacacgcatgcatcactggtgcccatacgagaagtatgcctaactagttgataatagaattgcgtatcattcggcatagtgttcgtcagaagaacattgtcttcccaaatcacctagcacagttgataataaatttaacacgagcatctagcccggtgcacttacctcaatgaaagaagaggacaagggggagtagaacacatgtcaaggtgaacaatctaggaacatgaaaaggacaatcctaatagcacactcatcatgaattgagggggagaactcctagcctatttgcatggctatgaccgtagaatctcctatgctagataggatcggccgtaagatttatgccagaatagtaaagcattgccataggtgttgagcaagaaattcgctatgaagtaaattgaatccgatgtaccggaatacttcgttgaatcaatatacttcgtcatcacgtgttgcaattttttgaattgaacattgcatcaaagaaatggtccttgcccaagtagagcacacattttctctgcaataaagaattatttttagtataaaatagcatatttaaggcatttactattttatcactcctttctggcacatagttataatgctttcaattttgtgtagcgtc

SEQ ID NO: 50118 - DNA, 1501 bp, Oryza sativa
gattcacgctgtggcccacaggtcatagaaagatcggtgacgggctgacggtgaacgtgaagcaagctgccacagcccacaaggaggagtattttggtcgtgactcgtgaggtcgtccgttaggttattacaaggattatttacacaagtataatattataattccatcccctatccatacgatcccactgaccaatggaccccacaatgagataagcactatagtacaaaaccacgagcacacacttaaactaattccagaattacaaaacgccccaacccttttcatcctgtcacgccaccgaggcacccgcctctcactgacaggtgggcccaaaaagcgtcgaggacgcagtacaatttacgcagaaaaccccgcgaaagcccgtgaatttcctcctcccaatcccttccattcccatcgaaggaaacggaatttgcttacggattaaaagggaggtcttgactcaacccgtctccttctcctcctcccctccgcctcgtcgtcttcgtctcacgccaccatcgccatcgcggggcttcgtttggtcgggatgtctcgccgccgggacgctgcgccgacggcgcgcgagggcgagagggatctcgtcgtgaaggtgaggttttcttttctttctttttttaatttattttcccggctcctcgcgggtgcggtgtttctgtgctaggaatgccgcgttcttggtttgctcgcgcatgggggttttgtcgcagggaggtggggagtgggttctgttgcccgtgctgggttgtggagcgatgcgaccgggtggtagtgttgttcttgaaaggatggattttgcatctttttgggcgcccaggattagatcgtttctgtattgtttgcgattgtgaaactgtgtagaaatatcgggtccttaacgcggcgatttttgtgaggactctttcgaaatcaagattattgcagggattgtaaaatagtgtagaaatatcagtccttaacgccggcgattattgtgaggactccttcgaaatcaagattattgcagggctttttgtttttctgattagctagacaagagtacttgctatggggatttgattgtagagtatcttgatcactttgatgtatgttcctttgtaatttgttggtatgttgaatgttccagttttgcatgctatggttgaataaatctgtttaggtttgcatgatatggctgtataaatctcttcagtgtagaagacaacccacttccctcaacatgcaacggcttaacttggcagtcgtccttaactgattaatgccatgtaattttggtacttatgtagcatcaggtgctgagatttggttccgtgaattgtgttttgacgctactgttaactgaatcaacattgatcagctgctaagataagaacagaattgagttatcatttgcttaagcatcttgcctgcaaagcaaaccacttactgttctatttaagtttacctcgtgcaattttactagattattattcttat

SEQ ID NO: 50119 - DNA, 1501 bp, Oryza sativa
agctgctaaggtgaagggctcagcttccagatttcgatacgtttgtagtactcctagaacactggatcagtgagtaaatgagctgtggagcctatggtgaattaccctgttcttttggacccttgcctagccaatcataatggagagtaatgtggcaacagtttagggaagtaagcagatccaaagtggattgcagttaaaccattaaaattttgaggcatatagccattcgctgctatagattgctctgtccatttacatttggtttcttgaaacagagcaatctatagcagaaagcagggaatgagggaatggaactcatggaaagtcaaacagagtggagatatgtcaatctttgaatttccaacaacagcattgcatgacgaatgatgtggagaccaaaagtagtactagactaagtactagttagtgtgctaccatccatgtgctcaacatttggaatcatgcaggcctaggacacatctgaattagatagctgttaattttaatcttactcctaccatttttgttgtagtaaatgcacaaggcacaaggtagtaactgtacgaagtacggtttgttaattaattatgttaacccctgttatattcatgattagttgctattaattctgttgaaccaattagtgcgtgtcactatatctagaagttcagactaagttccgtatatgtagaagaagtctttccatatctgtaacttagcacaattatactatgttaagctgattaaccttaaaatctgaactttttggtgaatgacaaggcgatagattgtccttgagataagttgggactttttgttatgatgaacatgtctcacttctgccttttactgcaggccatggattatagctggtggaaaggtaattgctacaaaaataagaaatgcaactcagcttctgagttgtaaacttggagaattggttccagaagcatggagggaatgcccaaactgcaaatgtcacattgataatagcgatgtaagttcagctacctattgtacttatgaatgcttgatttaactttttagttcagttgtctgatactctgatgatgttttgccattaaagtttcgtgtgtagaaaatcaacactagacaacattacttccaaagagcgatgctctggtgctctctactggtagtattatactatcagtctactggtagtattatactaccggtatattgggggtaaattagtaatttactaatactatgattaggagtaactattatttatgttttttttccggctaaatcgatttatgatcattcattattcactaaaaaaggtgttttgctcattactgtgctgtgtgctacactttattcctattgtcctggctcccacgtgtcacaatttcaatataaaatccacaaagcttgtggctcccttgccttgggtatgacgaggttggctttaagcagaaatatcagtagggtaagtttcacattttctatgcatttcttgttggtgcta

SEQ ID NO: 50120 - DNA, 1501 bp, Oryza sativa
aaagtttagcctacgttcaaggaaaaagaaggaataagttcaccttctatcccttcatctttacgtcgggtttaatttatatctctaaaccgcaatatcagaaatattcacccatcatattgccaaaaccgtccacgacaggtccgaaaaacctaattcacggatatccgcgcgtcggcgcccccggagcgcgaatgtccgtagctagatcacccgccggcgccacctgtgggataggttctacggccgcatcgcagagggtctcgggctcaagtttggtgccactcccggtggcgctaccgtcggcgtcagccggaggggcgatcactagttcacccagccaaaccagggggcgcgttgccctacacagtcgcgtggctgccgtggtgtccttctgcttcgttgcatgctttgaaggcatccttcacttgcactgctttgttctctctttgctcgatccccatggacggcgccaatgttggaataaaatccaaaggggttcaagcacaagggaagaagggatgtggtttttatctattatttcatttgcccccctctccccctcccccccggggggggcgtattacatctttatgtagtcttacattggtaagggaaattacagagatagaccttctgggcttaactcaaggatggaggttgacaagtggcccccgctcaagggcggtctggtaactctccaagggacatcgtatgggactgcgcccattaagccagcattcccgggggaccccatgtttcccggggtgcactgctcgaggctgaggcgtgataacgatgtaccttggccttcacctagggtgttgagccaacagtatcaaaggtagttggccgcctaaaatgcgagattaaggctctctgcgatgttatcctggctgttgcctccggggtcccccttcggggtcacgttccccgaagcctgacgaagcctctgaagcgcccccttccccttggggcggcttccgagggccctgcggtggctcctcggagcctccgcttgtgagctcatcgagagcaagattggtgggagaaaatgggagcctttgtcctctccgggcaaggtcaaagctactccccccaacatagatagtcttatgactttgatcgcgaagaagaagcggcatatggaagcaagagtcggaaacaaatatgcaaatattgctagtctttttgcacggcctcagaaaagccaaagttgcatacaaataatagtaaatgtatgccataatgagaatcaaacaatcatatttaaggacctccaagaactaagggaggaggaaatctggaaatctaggtaacagatcaaaggggagaaagaagaacaaataaagaaaccagtggaagaaagaacactcgaagcggtcaccacgtccgtgtcctcctacttctccttgccgcagcggcggagcttcaacggagccatggcgagggggtgtgatgcagcagcgtcctcgccacacctgccaccaccgtgcgttgt

SEQ ID NO: 50121 - DNA, 1501 bp, Oryza sativa
cgttggtgttatccattgcaagcctgcacctgttgcccttccgacaggggatcttggacgcagcttgcgagcgccaggaatttctcctgatatgccgccacggtccccgtctgggaaagacgtttgagttctccgagcggattgtggcggaagaactgctcgcaatgttgcagccagttgagaggatcttctttgccgtcgaatgggaaactcgagcttgtagaaacggggaacgctgccgcctccggtgcccgttcccgcgcctgtccccgtgcccgccgccagctctgccgcgccaacgttcagattgggttgggacgggttgggcaacatgcccgcgccgccgagccgccgaggcgaggttgaagcggagttgttgaagacgaggccacccctggttgctgttccagggacgtgagacgcgatgtcacgacggccaccgaacgacgaaggtcagcaagatcgcttttggacgccaacaaccccaagccggtgagcacgtcggacatggtgtcctgcagcttggcaacggcatccgtcggctcgagcagcggctgcttatcgctggatgtgtcgtcctgaaccacagtctctgataacaagttgttatgcgccaatagtgaacggatgggatatgtgtgagttgtgggtggacgaggtttgggtagtttgcgcgaacggcgatccgtcgtggatcgccggagagaacacgggatgagaagagagaaacaggagatgagatgaagattaatctattgcatatccaaaaagggagtacctatacgtctttcgaaagatttttatgatcgtatcacacagatttttaatctttagattaaaatccgatagatataataaaaagcaaaaagcaattaagaaacaccataatggacactaaattaccatatcctcaataaaaagaccaaatccaatacaaaatttaaaatttacatgcgaagattcaaaaattacagtgtaacttacaaaagttacaagttacagtgtaagtttcataaattacaatgtaacttacaagaaaatggactgtaaatttaagtgagaaaatcgagtgagagataagaaaaaatctttcgagtgagatatagtaaaaatggatccaaaatatccgaatggatgccctcttataggcttactcttgtaactaacaatttactgatttaaaggaaactaactcccctgtcacgctaacggaaacgctgatctgcgcggtactgttcacggttcggcacaatcacagctgtgcgccatctccttccccttctttttcctgcgttgatacacaattccgaccatggcatagagattgagataggttctcctagttcagcaagccatggtatttgtacaattggccctacagcacttattgaaattctttacattgcaaaagaattataggcaagaatctgaaatttgaagttattcgagttgtctgaaatctgaaaagaatcagatggtgccttgaggctgcgcgtgtaac

SEQ ID NO: 50122 - DNA, 1501 bp, Oryza sativa
attgtcgtcttccacttcatcttcttccatttcaaccccttgctctccgtgggatgtccaacagttatagcttggcatgaaccccaactcaaacaagtggaaattaatagtcctggatgcagaatactccttctgatttttacacttattgcatggacaacaaataaaacccttttgcctgttagcttcggccactctcaaaaaaataatgcacgccgtcaataaactctttggaccgccggccatcgtacatccattgacgatccatctacatgagtcgaaaaaaaatcgtacataaataattattcttacaataatgacagtcatacaataattataagataattacaaactctttcaacagtcatacaataatgacatatctttattcatacaaaaatcataaaatattacactaaataattcttatttactatttctaaagttttaaacaaattttaatgtgttttgcttcttttaattttcattttagtttgttttctattatttaagactaactttcactatattttccttctcaactattttataaaaccttctttaccaaatcaactaaatttctatatgttctttcttcccccacacaaattttctctctcatcaacttacaactaaattttggagacaaaaaagtgtgcaaaacatagctccaaatgtaatatgacaaagaaaaacattggaggatgaagttgcaaaccttttaggcacctcctatttgtatgtaatcaccaaaataaattcactagaaattttggcatgacctcccttcttttttgaagaaattttgaagcttgctcgggcagctggaggaggaaaaagacatatatataggggtgggactttagtcccagttggtatttccaaccggggctaaagatccccgagatctttagtcccggttggtaagttacgatctttagtcccggttggtaccaaccgggactaaagatccgggggggcctgacaggccctaacagcatttgaaccgggactaaatatcatctttagtcccgattggtgttaccaaccaggattaaaaatcaaatatgccagttaccctttttaaccgggactaaagatcatctttagctccggtttttattgcatccgggactattatggaattcggccgaccgacgaaagatggtttctccaccagtgaccgtttgtttgcgtatactgtcatgctataattctccgaaggtattatacaaacataaaaccaagtacacattgaatgatatttttcaatatatgatatttacatagattttattagtattaaagtaattactctaaaaagaatacatgtgccctatgggaaaaaatcacaggatagattatccagcgcgcaagccggactgggtgtctgggtcggtatcattggtggagtttaacattttgctaataaaacctgatcgtacgactgtcggaggggggggggggggaagttggaaccacgcggtgccatgtggcgggg

SEQ ID NO: 50123 - DNA, 1501 bp, Oryza sativa
ctgcctgttggttgacaacttcttcccctaaaccaccagcacaagctcaagctctgcttgtttgctttgttgatgatctttcctgtccgatgatggttaatgcttttcaagactcttgggagtgtggactcggggatgttaagaacaatgcctctgccaggccggaggactgcataattcaattggttttaacatctgttattccaaaggaaaatggtagtccagtttgagatggttcaattgcttttgctactgcttgattacacggtaaggatatgcatggttcatggcaggaggttgcaacgattgagctgggttctgtgattttgtgaaagactgcctcaaaatatgtggtggttatatgttaccagtgcccccaaacctggtattttgtgaaatttacaccccctccccacaaaaaaaatagaaaaaaagaaacttattacttaccctgacatcatctccgcatggaggtctaacaagtgctgctgaggttaatattgtaccaatgctggtactatcgttccaccgtatcacaaatcctgagcaaacccgtatcctttttcgacctgaattacataacaaagttagtggaggtctaagatgtatgttatgaagaggtttgtttctagaaacaaaaatacctgcaaaggaagataaactgacaattgactgtgaaacacccaaagcaacctttcgagcaacttggcttttagcactaccatcatcaatatcacaaaatgtatcctccagagtgagaattggaccctcagcctgaactccaactagaataaaacattattaccgttagttactcagacagaattagaatatcaatagctttacttgcatataattttcatgcacaaattgcattccagtagaaacatgagttcaattgtgcctccctctatacataaaaatatgcatatgcttccatggtacttgaaatcatgaaaagcttcaaaggcactgcaagtaatacatacagaaatgatcttccatgtctagcatataagcaagaaaatcctagcaatatattcatcgataagctgaaaatcctgaattagagaacatatagaacaataagaggagcaagctggttaatctgtctagccgatactccattatatgaagagtaaattaatttgacaaggcacattcatatgccccggtatttgtgcaagcaatgatttccctataggctttgttcatcaaaatccaaatttcttgggcattttatcacagtttttagtgatgactatatatctggagttcgacgacaaatcctaataacatttaaaagtagagcaggataggcagagatgtcatacatacttcgttcagcgattcggccccttctctctgcctcgacagcaagcatacggcgaatgtttatggccagctgagccctggcctccgccccagcggcggtggcggcgggctcctctgcagtggcgggggtggcggggggagggcgcggtctggtctccggctcgga

SEQ ID NO: 50124 - DNA, 1501 bp, Oryza sativa
agatgcaacggatagaccagatgaagccaacggtaaaatttgcctttagcctcaaaggcagttaggcagacgatgcagacccaccccgacctcccaagcgcacgcctccgatcctctcgccttagacctagccgccgccgccgccgccgcctccgccggaaagtgagccctccccccgtcgcgcacacacaccccctcccgattccggtgggcgcgcgcgggggagacaaccaaggtatacttgggctggcctcctccccccctcccgatcgctcccttcgggaaggtttggggtgggggaggccgacgccgtcatccgttccgggcgttggttgccgctggcgattcgccggcgggcggcgttgatcgggccccgggcgggggctccgggcgccttcgctgtgggggttttaggatcggaataccgtggaattgtcgtggattggttgctcgtggatggtgtgtgtgtgtgtgtgtggggtgggggggggggggttagggggatcttgcggtggcgctctgctcgtcggatctctcgacggtgttgggtttggtttgtggggcgctttggtggtgggtagacggtagcttggtttggttcgcgggttgttgttggatcttgtgcttgctgcctgatgtgcgtttgcgtgcctacatccttggaggggtggttgcgatagggcgatttcgctgtacggatgcttttgctgcgcaatcggattggtgattaggggtttggaactccgtgtgatgcttctgctgatgtgcatgcatgcggatagcatgtttatgttgtttttgcggtaggattgcgtgacaaatgtggcatgtattttcttcttacatgattgtcctttttcatcttgtcttcgcgtgctacacttccggcccagatgtaatataggtgcatgtttgcgcgcgctttagtatgaaacagcttaccaaatgtagcacgaagctttttgttactctcgaatgcttccgttacctgtgctgtaactgttgcatatgtttgtgttagtgctcatttaagcgtgttatgaactagaaatgcttagtcaattccaacaaaaagttcttcttagatgattattctgccattgtgctgctttagctgtcactgagtttggcatttccactcttgcagataactctacccaggctgagttgtggctggtattggcgatataagcttgttagctgttttctcttgtgtctttggtcttcatctttgattacgcgtcattgaaaagactgtacatgagaaaactcttttgttgaaacatttctcttgtaatatgaatgtattgagtttgtgactatccttctcctgtgctagaatcatatatttcagcttcaaagctcttgtggtacttttcaagtttcctgttgaaccgaatacctagtgcattaactctaagcttgtgacaaacattcatgcaaattcgtggatattaacattggatacttggtctactggaaaattggagctccttattca

SEQ ID NO: 50125 - DNA, 1501 bp, Oryza sativa
aaaaaaatttcctactcattaagtatggtaatgtttaactacataatctgctaattaatttgattacttgtatgccaattaatctatagccattgatttagtttggatggtctggattcaagaatgtcacaccgtgacattagtgtgtaatgtcagaggatacggttccgggctcgactagataataaaattcatcatcgtcaacctgtttgaagtattcagcatttgatcaaggtaaaggaatcctcttaatcatcatatagcaaaagaacatactcttatagccattaatgcgtctcatgcaccatatgttgttaatcatttggcctctctttcagagtttatctgttagcatgtacaatatgatgatcgatgtgcgttgtgaaagcaattgacatacatattgtgttccttgtattatattgccgtcgttctttcgccttttccctatccctctctcaatgtgaatgcccatatatttgacatacatactgatttggtttttcatattttccagcgaagaagctggagagctaaaccaaacactgcttgagaacgaggacgagagccgcacaatcagtgagatgggtgatttgctataccacgcgatggtgctgcttagggtcaagggcgtgaggatggaacaggtcttggaggtcctcaggaagcgattctcgcagtctggtattgaggagaaggccagtcgcaacaaatcttaggatattactcacagagtggatgggtttaccagtttgcttatgtcgtatcggcattggtgccaagtgtgtaccattgagtagtttggtcttcttaattagaccgaaggttgtgaattgtgattatgctttaattgttctccaataagacactgagcaaatacatgtctggaatttgcagtgctgttcttgctgtcgccaataaaataataaaatcagctcataagtaaagcatcttcctgatttgatgatctttttttagctatgttgtgaaaccgctgctcttatttcaacgccgtgcaaagttcaatctcaacaggaatctggggaaaatgctacacatacaagtcgttagtatactacacttttattaactgtattagttaagcagggttcacaaatttgttcgaattttgtcatccgaaatctgaagctctcctaagcagatcggtttgcgctgaatttcatttgaaattcaacgaatttgttacatcgcctctgagatgttcacagccaagtagtagcaaattaaaggaaaaggacaaaaataaaaaacagcgtgcaaacaaattccctgcaatagattaaaaaaaaaatcgagcagtcagttccataagaaagaaaatgcccgtaaatttgagaaatttcgcgcgaatttacacaaacgcgtgagccgcccgaaaataccccgagaactctgaccccggtcggactcccgactccgagacgagacagagaaatccccaaatccccacgtctcctcctcctccgccgccgccgccgca

SEQ ID NO: 50126 - DNA, 1501 bp, Oryza sativa
ccatcgcgcacgacatcgcccccgtcaccctctctgcgctgctgctgctgcttccgatggcggcgcctccgcttccccgcgcccccgtctcctcctccgccgccgccgcgtcgccggggggccgcgctctcctcctcctccgcgtcggcggaggaggttccggaagatgcgctggcgtggcggcggcggcggcaccgggttggcggcggccgttcccggctgcctccgtcgcggcgcgctcggctggtaccacgccgggagaggtcgccgtcgatcctaaggttggtctctgcaccactatccctatcggttctcggcgagaggttgccggaagcgtttcagggtggatgtgcctctcctttggtgctctaaagacagacgagaatgacaaccgccacatgttcgtcggaattcctagatgagggttcacctctgtagtgctgtgtagcgtgaggcttttattgttgttcatgtagagatagaagagtatgctggatttcttgtgccgcagagttggggatttcttgctttgagctaagcttattttgttgctgcaaatctttgcagatggtagtacatcacgctagttattgatagaacgatgctgttagtataagacccgtgggcaagctgattagaggcacaatggcagttcatttttggagtgatgcgtagctacgttgatttatgcactaacaagtattcagccactgaagggcatgcaattcatcatcctgggcccgtttatcaacttgtagatatgaaacatcgaatggccctgtcatgtcacctactgtcctacccattctatcagaatctcaattaactgttttttagcagggattattctaaaatgcacaattatcagatgactacttcagtaccttctatgtgttaaatatacttttgtattttgggggaatatgatgacgtgtttcttagtttgcagtgcatgtttgttctgtattttaatattaatacaccctagtttcttaactatgttcttatacatatcttggttgctcttgatgggaggcatttactttagtaaagcaaatatttgccatggtctcatgaatttaaactagcttctaaatgaattgacatagatgcagtgttttccattccgtgactgtttgatgactattgggtattttagcagatttgccttccatagactttcgctgaactataactttcacagtgctatggagctagtttgttctaggttctagaggaactaagacagaatatgagactgccagtttttgcatggatctgaagaaacatttttcacaaataaactttcttaagatgcaatacaattttaatcatcatgtactgtatgtgactggtttgcttagttatatcatatcttacctaaattttattttcattctggacgaattttaggtcgaagcaatactagacagtgtgaagtgggacagtaaaggcttggctgttgctattgcccaaaatgtggatactggagccattctca

SEQ ID NO: 50127 - DNA, 1501 bp, Oryza sativa
ccatagttggcaatctttcctgctgccatgacaaaaagatatagacggcatatggactaaaaggatgagggagagaggatagagaggaatgaaaaaaatgattatatttactgtaactgacatgcaggtcctacttttttttcctacttattatgtcaagtaggcgtcacgtagacgtcatgtcaaatgaaaaccaaatcaaacatcacgtggatgtcacgtcagctaaaaatcaccgtctaaagcatcttggaactatatttgtactggttttgaaagataaaagatactcctatattggctttgttcggacggcttagctacagcagcattgtggctacgctgcagccaaccagccagtagctacaggagttataactatccagcagcaagcaacaacttcctgtaactatgtgtttgtgtagccgaacggctacgttgtacaacacaacttaaaacgctacagcaaagtcttaccgaacatgctaattgtatccagttttgcggttgagagatatgatttaaactcaacctataatgaggaaccaaatttgaactttctccacccgtaaacccacgtagggcatatgccatttaggtgggccttccccaaatccatgatgagcccagtagttggctgggccttcaatatgcatcatcagcccatcggtgcagttaggaacaaggtcactgtgtaaaaggatgtttggtttgctcccaaagtttaccaaagattgccaacttgccacacctcatgttagtcaagtttgaccaagttagtctattgtttagttcatagccacacttgtggcaagattccttctcatctgtttgggtcccacatgtcatcaactcaccaaagcgtggcacaatccaattttgctagctaagttgtggctcactttttgtaagccacaatttaggcaagtgtggcataaaaaatatggtgaatggtggcaaacttagtatagcatccaaacaacccctaagtacccctggttttgactggcctatcttttcgcttattcttatcagccaaaatttaaaattttaaacttaaattcaaagttgattttaagattttgttttcatttgcaaatatgttgtttcgcttatgcttaaaaacaaccaaccaatggatccggacatctttgtgtttgaggaaaagggaaaagagaagaatggagaggtatacaaaataaggtgagtcattagtgcatgattaaattagtattaacaattttaaattttaaaaaaatatttatatgattttttaaagcaattttcctatatttttttaagaaaaacaccgtttaatagttcgggaagcgtgcgcatgaaaaacgagataaatcttcaatctttcacctgctgaggaacgcagtcatattgagattcatatataaaagtagacttactttgagatgaaatggagggtgtatttttttgttgaaaaaaaagttaaatagcatccctttgcatgcccttgacaatttttgag

SEQ ID NO: 50128 - DNA, 1501 bp, Oryza sativa
aaaggggccctgaatgtagctatgcagggcaatggtcttctgaatattgtattggctagaacttcaggtcaatacataggggaaagtttcaggcaaattttcattaccacggcccattattttgtgacaacatcagaagagaaaaggagtattctgtaggtcagtgcaaaatcgaagtactgataccatgcaaaaagaaaaaagaaaaagaaaggaaacaaaaacagagttctcgggactaattaagtagaagaacttttagattttgatgatgaatatactcccctttttttataagagaactgatgatgaatgtacctgaactggagtattcaaacttttcctccacatttttggaccacagttgatttccttattgttttgtttacaaagaagcactgcagcaaaggctccccaaatttattaaaccgcactcagtccactcaaccttggcccagctccgcaattagttggactggattgcacaactgtcaaatcaatgggctataatgaatttgttatgcacccacacacacaaaaatatgaaaagaatatcgccatttctgaacctgcacctgataaaaacatctttacatagttccagcttggtttatgtagtccatcacaagtccatttcacataaatattccggaaaaatctgtgttttctaaaagataatgagaatcccgccatttcagcctttcactcaacaggagctagaacctattattatttatcacattacatcgtatgtcgacaaaatccacaaaataacaagataaccaaacatttcaactcaaggaaagagataacataatccggaaaatctctcgttcacaagttgaatcgactaggactgaaaccccactcagtgacaggtaatatcttctaccgaatgctgcacaaaagagccaagtaaacggagtggattctaaactcgaaggagatgaaacaatattgttttaaaaaaaatctacaagataaatttatatgtgttaaatcactccataaacatgaaagctcaaatttaacttatgctcccttagattaagtttttttagaacggatgaaatacaagttaaaaaaaaatctaactgcgaaattcagcaaatttttactgaattttgctctcctcttctcacctctcacttgtcatccctaaaactctcctggtccccgcctcccgcaccacgccgtctccgatcaagattcttccctgatccccttgctgctgctgccatcaaatccttggacatttccagttgcaaatttagactcttcccccgcgattcccagcactcccaagtcccatccttcccgctgccccatcccatcccactatctccctaaccactgtgatttaaccaccgaggaggcggcaagaatcgtgtccagctccgcaccgttgttaggcgggagtggagtggactggttatcgtccacgcaagacgacgacgacgacgacgacggccggagctcgccggagcatcggtgtcagaga

SEQ ID NO: 50129 - DNA, 1501 bp, Oryza sativa
attcaaaggggccctaaaatcgtagaaatacgaaagtttccaccgttttttcttttctcgttcctacgaatcagaggcataaatagtgtatgatttcaatttctttgttttttcttcatttttcctcaattcaaaggggcagtagtattttctatatagtttataatgaaggtaatatctcgctgcagtaaatgaacagaggaaggctcctacggccagagcaaaatccaacggcgagaagtcccacaggtgatccaacggagtagtagtacggggacatgccctgatgcactgttctgatgattggacgtccgggctctccaacgacgagcccgtacattccgccgcgtactgatacagtgtcgtctccaccgcccatggccggaaatcgcgagaccaaatgatggcgtagcctgcgatgagatctcgtcgacttgacgggttgacgagacgacgagaagatggcacgcaacgctatcgcccaccgccgatccctcgagcggtgtccgggtttccgacaggcgcaaacgactcacgacaccacggccagtcgcgagtcaggtcaagggtcaggtcaagggcctcgcatgctgatcaatcgatcggttttgattggactgattctgatatgcgagattactcaaatttgctgctcggcacatcgattcgtcgcaagctcccaacattcgcaattcatcggaggatttttcgaaggaattctatgaaaaaataaattaatttatgtgaaaaatctctgtaaagttcccgtgctcgaaggaaacctgatatgtggcctcaagccctcaactgtgtttcctggtcagtggactctcggcgggtctaccaaaaagggaaaggaagaacagcgacaaataaccattttgtggctggccaacggaaaaaacaactggctacacgagtagtagtagtatccatctcaaacctcttgttgatttgaggcaaccagagcacaatagaacaccgatttgctataccaagtacggagtaccaataatagggtagtgatcagagaatgtttcactgaccgcttcgcccaactgcccaagtcctccaagcctatctatagttctatacgcaatataccttgcccaccgataatagaagcatccacctgtcgatccagccaggccgggcctgcagacagcgagctgtttgaacctagcaattcactaccaaccagctgctaaaccacttggagaacaggtcaagagacggtagattagacgcacaagaaggaataacttagctcaacttgggcattgggttgtgtacttgtgtgtgatattgcctcggattgaccacaggacacataccagacaagcgctcaagtcaatgatggatgaagaaacagaagaagtgctcacgcaatcatgcggcaatttccaacgacggagcaacggaagccagagtttttggtcaaccagaaattggatgcagccatcaaagaaaggaacagaacaccaacgcgaaaaagaaagag

SEQ ID NO: 50130 - DNA, 1501 bp, Oryza sativa
ggtttctttatttgttcttctttctcccctttgatctgttacctagatttccagatttcctcctcccttagttcttggaggtccttaaatatgattgtttgattctcattatggcatacatttactattatttgtatgcaactttggcttttctgaggccgtgcaaaaagactagcaatatttgcatatttgtttccgactcttgcttccatatgccgcttcttcttcgcgatcaaagtcataagactatctatgttggggggagtagctttgaccttgcccggagaggacaaaggctcccattttctcccaccaatcttgctctcgatgagctcacaagcggaggctccgaggagccaccgcagggccctcggaagccgccccaaggggaagggggcgcttcagaggcttcgtcaggcttcggggaacgtgaccccgaagggggaccccggaggcaacagccaggataacatcgcagagagccttaatctcgcattttaggcggccaactacctttgatactgttggctcaacaccctaggtgaaggccaaggtacatcgttatcacgcctcagcctcgagcagtgcaccccgggaaacatggggtcccccgggaatgctggcttaatgggcgcagtcccatacgatgtcccttggagagttaccagaccgcccttgagcgggggccacttgtcaacctccatccttgagttaagcccagaaggtctatctctgtaatttcccttaccaatgtaagactacataaagatgtaatacgccccccccgggggggagggggagaggggggcaaatgaaataatagataaaaaccacatcccttcttcccttgtgcttgaacccctttggattttattccaacattggcgccgtccatggggatcgagcaaagagagaacaaagcagtgcaagtgaaggatgccttcaaagcatgcaacgaagcagaaggacaccacggcagccacgcgactgtgtagggcaacgcgccccctggtttggctgggtgaactagtgatcgcccctccggctgacgccgacggtagcgccaccgggagtggcaccaaacttgagcccgagaccctctgcgatgcggccgtagaacctatcccacaggtggcgccggcgggtgatctagctacggacattcgcgctccgggggcgccgacgcgcggatatccgtgaattaggtttttcggacctgtcgtggacggttttggcaatatgatgggtgaatatttctgatattgcggtttagagatataaattaaacccgacgtaaagatgaagggatagaaggtgaacttattccttctttttccttgaacgtaggctaaactttttgattttttattgcctaggcgcctagcccctgttctctccggattgggccgaaagccagcccactatccctactcccgcaggcctgtaatcctcaatttgggccgcattcttgttagcaaagacccgacccaagtatagaatc

SEQ ID NO: 50131 - DNA, 1501 bp, Oryza sativa
tggtaccaaccgggactaaagatcgtaacttaccaaccgggactaaagatctcggggatctttagccccggttggaaataccaactgggactaaagtcccacccctatatatatgtctttttcctcctccagctgcccgagcaagcttcaaaatttcttcaaaaaagaagggaggtcatgccaaaatttctagtgaatttattttggtgattacatacaaataggaggtgcctaaaaggtttgcaacttcatcctccaatgtttttctttgtcatattacatttggagctatgttttgcacacttttttgtctccaaaatttagttgtaagttgatgagagagaaaatttgtgtgggggaagaaagaacatatagaaatttagttgatttggtaaagaaggttttataaaatagttgagaaggaaaatatagtgaaagttagtcttaaataatagaaaacaaactaaaatgaaaattaaaagaagcaaaacacattaaaatttgtttaaaactttagaaatagtaaataagaattatttagtgtaatattttatgatttttgtatgaataaagatatgtcattattgtatgactgttgaaagagtttgtaattatcttataattattgtatgactgtcattattgtaagaataattatttatgtacgattttttttcgactcatgtagatggatcgtcaatggatgtacgatggccggcggtccaaagagtttattgacggcgtgcattatttttttgagagtggccgaagctaacaggcaaaagggttttatttgttgtccatgcaataagtgtaaaaatcagaaggagtattctgcatccaggactattaatttccacttgtttgagttggggttcatgccaagctataactgttggacatcccacggagagcaaggggttgaaatggaagaagatgaagtggaagacgacaatattccagactttgatcagtacagtggatttgaaggaaatcaaacgggcgagaagaaaatggatgctgatggtaacgacgttgcagatgatcttggtcagatgttgcaggacgccaaggaggactgcgaaagtgaaaagggggcccataaattggacaagatgttagaggaccacagaacgtcgttgtacccaggttgcgagcaggggcacaaaaagttggataccactctggagttcttgcaatggaaggcaaaaaatagtgttagtgacaaggcatttggcgatttattgactcgtcaagaacattcttccggagggaaacaaattgcccgagacaacgtacgaggctaagaagatagtctgccctttaggactggaagttcagaagattcacgcatgtccgaatgattgtatcctatatcgtggtgaggagtacaagaacctagaagcatgccctgtttgcaaagcactatggtacaagattagacgagatgatccaggagaagttgacgggcaattaacaaagaagagaattcctgctaagg

SEQ ID NO: 50132 - DNA, 1079 bp, Oryza sativa
ccatctaagcaaccaatctagagggttaagcacagcaattctattcttatacccaactacacattttaggccataccggttgaatttttgaaatatcgggagaggaaagtacaaaatcccaccaaattcatttttggttcaaagataacatagggagatggaattccaatattgtctagcaagttttaagttttatcgactcattttcaaaacccatttactaggggctatgtttaacccgatattttagaaatccgtgctaatacataggagtagtttgcaaatggatttcaaaacttttcaaaacactatgttactgttttgctgtgattattaagtgatttcaaataaaattcaacaaaaatagtatttccaaaatgtttcggtcctatagagcaagataagagttttaaaatcaaaacatgagacataaagtaaaataatctctaaagaaggatgagatataagattgaacatgatttttgcaaataatttgtaactgagagcatagcactcaaaataatttttaagaagcaattctaagtgacaacttaaggggctcctgtagtcggtatttgctctgataccatgctgtcataggctctccagaccttccattatatttgagagatgaagtgaataattcaagtcatcaaacaagcataatgaaacatccgacgcctcgagagaggaatattggagacattgctgggcccttagcctgccagtcaacttcagcctgagatgtgcccgtcaaaccactcgaaggcggcgaccagatgtgttacacattcaggagacttgacaaaaatggctaaagatctgcaacctcccaaatattcctaactcatactcatgtgaatctagttcccaggatgtgcactagattcacactttcatcttaagcatgattatacatagcaaacacaactaagatgaaagaaacttaagacttacaacaacttaataattacataggccaaccggccaaatagacttattagagaacagcggaagcttgactacccaaacacaagcacaccgactaggggtataccccattaagttctcatcctaga

SEQ ID NO: 50133 - DNA, 1501 bp, Oryza sativa; identical to SEQ ID NO: 28164

SEQ ID NO: 50134 - DNA, 1501 bp, Oryza sativa
acggattaattaggcttaatagatttatctcgcagtttaatttacaggcggaatatgtaatttgttttgttattagtctacgtttaatattttaaatatgtgtctatatacattaattttttttaccaaaatagctaaacacggcctatatggaatggatggacacagaaaaaaggtttcttacgtctccttcacttttcttacctcgatcttgggaacttattactccgcacctataaaaaaattactgtgttcggttgtactacttgggaacttatttctccgcacctataaaaaaaataagtagctcattagcatataattattaataattagcttagatgatatagaaataaattaatatgacttttaaagcaacttttatatagttttttttaaaaaaaagggtatcgtttaatagtttgggaagcatgcctatacttttattcttctatttgtgtcaaaagttttagttttttaagcaagcagcatattattgtctctcttgtgctttaacaaatccgattaaatctgaatagtgcaagccgcataatatgtatatggagcatgcatgagatgaaatgaaggcccacctgccaccataaaaaaccatagaaaaggacaatgccttgagccgggtgctcgatgaatgatctaaaaatcgggcgtccacctcgcctcccccatacactactatccatgcacacgcatgttatatcatggctataaatgcatgtccacgcaagtttttatatctcatttgcacatttttgtgtcttcttcaaatgtattttcttctaaaataattgttcattctacaattcgattacatctttatattccttataattaaacctttataacaagatatcacacgattatattttgataaaaaattgaacgttgtttcaccccttgaaaaaaattgttttagtttaccgcataaagtgtttcagagaaatggtattaaaaaataccaactacaacaccagtaaccacctagtatatgaaaacactaagtcccaacaagcaaaacaagaaaagtcatatgaaagatacaatatatttgaaaaaacatgatattgttaaaatatttttatatcacatatgaatattaagttgtaactatcgaaacactacaaaatacttggtgaaacattccaagaatatcatgtgtaacatttgcaaataaactagtaaaacatcatacaatactagttgagactgtcacatctataaaacatgtgcaacatttaaaaaatccatgaaaaaaatctaaatattctttttatcgaaatataaccatgtagtcgtgtcctaaagatttaattgcaacgaatttagcgatgcaatcggatagattggagaagtaatttaagtggaaaaatagtttaaaaattgctaaagaaaaacttatagcaacccaaatactaaaacttatactgacttgtttctagtaggctctgtaggatgcatctatgccaagtctctgacggagtga

SEQ ID NO: 50135 - DNA, 1501 bp, Oryza sativa
tgctgggagtatgggcctactaggccgcatgttaggtgtgtggcatggtggtgggccccacgttcgattagagcaagtataagagcaactataatagtgagctataagcttactataagcttatatggaggagagagataacaaaaaaaatcaaggatattagttctcacgcaagagctagcttaacacaagctcctaggtaaatacattaattatataggtgagagatagagagaggaggagaaaattatagccaaccttatagctaatccattatatatgttggctttaagatgggctaatagtaagaagtgagctctactattatccttgctctaatagtgagctataagcctactataaacttaggtggaggagagaggtagtgaaaaatcaagggtgttggttctcatgtaagagctagcttatcacaaaatctaagacaaatacattaaatgtataagtgagagatacagagagaagatgaaaattatagccaaccatataactaatctattatatatgttggctttaaaataagctaatagtaggaagtgagttatactattattctcttagtttgctgacgcgaagtacgtactggatgtgccatatatgccactggatgtgctccacgtgtcactatgcccatggctgccttccgatgatcccgtagatgtattgtgaagtttcatggttaggattgaatttctatgagacgaacgggtacagtactactccctccattccaaattaatttacatatttcatatgtacaccaagactaaaaaaaactaataactctctcatactatatttactctagcaataaactcgatgcatgcatcatccctactatttcctactccctctgggtctatattaattgacgttttggacaaggttgacgttaaacttttataaccttgaccatcgataactttaaaagtatttagtttaaagaaactataaaaaaatttatagatttgtctttcaaaacactataataaaagtaaacatacatttatttatttattgtatatattataatagagaaataaggtcaaaggtatatctagtaaagcgtgtcattgtccaaagcgtcaattaaaataaaaccggagggagtagccaatagcaaatcaagatattgcatatgggtataaatacttgtgtgcatggatgcatgcatcaatatccatttactccaatgcacaaataacgaatagacttaatgatgaacacagatatgtaaatcaattagaaataacataaaaaaaatatatgtagattaatttggaatgtagagagtactacctagcacatatatatacagattcaatttttccatatggttaaaagcgaattttacatacggacaggtggctcacatgcatccaaaggtatacgaaaatcagatttttatatttagctagcgcaaccgcatgtgaagaaaataacacgaaaaaaataaaaatttcaaaaattgaataactgaaac

SEQ ID NO: 50136 - DNA, 1501 bp, Oryza sativa
tcctgcaactaacaaggatgatagaaagaaatgaaccaattaaccgatactgatatagtgtggaagatgcaggtccgatggttaaagcatacatcgtcaggtatgttttcatgcaatgtttcattggagctcataataataataactcattggttagaactccaatgaaattttgcatgaaacatatcagcttactagaatttaacttattatagcaacaatctaatagatcggacctaacgagacaatataagattgaagacaataagaaaaacctatttagccgatagatctacacaaacgtaatggatatatcgatcaatctaaaacaacattatgattagaaatataccacttagttagaatatcaaatctaaccgagaaagtcctaactaagccgacacgactctaagcaacgatgcaatgcttgcatcaacttgaatagaatattggccgatggtggggccattggaactaggcttgacggtgtagctggcggaggatacaatgaaggtctatggtggcggagatgagccaaggaaatgacgctgtccacgaagatccacacggcgggcggagggttgggggaaggtgcttggagtgccttgatgctaggcggtagggacacgtgggcacgccggaggtggtcggtgaccgagctaacatggtggccagtgatggcaagcaacgcgtcaacgatgacgacggtggtgtgcgaggtggaaaacggagagacgagaaagagtgtccacaaagcaaacgcgcccactaaagaactgtaccgaattttattgttaacagttagccacttgggagctgtgaaaggaatgaaatgctggagtatactacgcaattagaacaaataataaccttaatcatcgcctgcatcggtgaagaggcatggacatgcatatggtgaaagcaataaattagagtgataaataccgggagagtgtgcatgccctatttttaacataaccccaacgcaaccactcttctctactacaatcgttactcgcttttaaatcaaaatcatcaatttctgctttattaacccaacatgaaaaatcaatcaacctaaaaaaacacaacatgaaaaatcccctgagaaatccaaacatttgcctgttttttcgtgaaaaaaaagggagagagagagcatcctattattcaggtgtattccgtctccgtcttaaaatccctaacttcccaggggcttatacgcaaaagtcgccccctcccttcgtcctctcctctcttctctctccgcatccgcctccgcaactgcaaaccgctgcggtctcggaaaccctagctctcgccccctcccctccctctccgcccgtcgccgcgcgggtcgcctcctcctctccgccgccaccgccgccgctgacatgggctccggtaatccccgatatcccgattcgcgccctcgctcgattgtcgtttccgcacccccttctctcatccccgtgatcggttccttttccagatgcggaca

SEQ ID NO: 50137 - DNA, 1347 bp, Oryza sativa
  unsure (1)..(1347): unsure at all n locations
agccagctgtagcacggactccaagacgcagtgtgtgtatgacaggtggaaccagatattaatagtgtagtatgtaactattgtatgaattggctattaaattgattgtatgtgatatggagctagtagttggctatactattaacttgctcttagagcaaggtcaatagtgtagctagcagtaggctctaaaattttgtcatgtctcaggtagagctaacttaaagagcaatttatataataaactaactacaagttagttataagctacattggttcaaacgaattaacaagcggtaggacccacaaacgaattttttttattgtatctcctagccgatacagcgtgaggcgctgtgcaagcaccggcttctttctcaatatgtgattttctttccttaatctcgttttaggatgattgataagttttagagccttcctaatagcactattgtacttgctcttatctccttaaaatatatttatagctgacttatagcttgctattgtatacctactgtaataaggtaataaggttgttcannnnnnnnnnnnnnnnnnnnnnnnnnaactacaagtgtgccacagttagccaaattccttgaagacacccacacttgaacaagttacatggatgcagcgcagcgaacagtcctagtatatgctgtttgcgcaacttgccaacttctcaagattttgatatagggtgcgctcgttcccacggacaaacgcccccaccacctcgtttttcacgcgcacgcttcccaagctgttaaacggtgtgtttttttgttaaaagtttatatataaaagttgcttaaaaaattagataatacttaattaatcacgtgctaatggcctgctccgttttccgtgccagaggggttattcccccaccctcactctcgatcgggcccatagtctctccatagatgagctttgaagaattgctatccaattgctatatgctcaaaaagaaaacagtaagattttctcctaaacaaagaaaaaaaaggggcaaaaagagcattctcaaaaaaaccagcaaacacaacaacttgttttgcccagaaaaacaataaacactattccaacttgtaaaagaaaccaaaagaaataatattttaaatggaggcaataataataatgaaaagggaaggagatgagctagcggttagattgcactctgttacacatggcgagcccccattagatagccgtagattacacctcatctctcgccaccttatctcatccatccgtcccaccatgtatatacccgcccaccacctcccctcccccaaaactcttcttccccctcccgccccggccaggtgtttgacgaaa

SEQ ID NO: 50138 - DNA, 1501 bp, Oryza sativa
acgaaagaagaggatttagtctttatgaccatttctgttgtgtcaaacatgaattcacttggtgtggattcaacggttccataaaaaagtattatcgttgctgttccataagaaaaaggatcaaatctttatgaccattgatgttccaatggttcttcgtaaaaaggaagctcatcaattcagtttgtattttaacgactgctgagacagttaaaccagcaagatagcaactaccaaaataaattagagtagctattgttggtaccagccagatctggtactatacatagattttgagcaaggtgacgggaagaacaaaatgccatgtattgggtcaaaatctgtcaaataacgcaccctgatgttggagactcatgtcattccacacactacttttttgcagcagttctgtgtattctactgctggaagtattttagtatttgaaatgtaacagcattttagagtttgagatgttagctcatgttgacaactctgtactgcagtgtactgctgactggagcagcttttcttgatggaagtattttagaaatctggaagatgaataattctggggtaagtatacaccttgttagcttatcattttatttggagcaccctgcataacgtttcttcaatacttctttttttccttgcatctatgtgaattatttcgcagctcattcaattgaccctctacacttttgaacttagtgatgtattgatcaaacacccactggctattgaattgagtggctactttgcacattgttgtccataaggatgtgataggctgatagcagatttttaggcatgcaattagtttgttcatttcatcggtaattatgaaatttgagctgaataaaagcaagtaaggagggagttaattggaaactttcactagtgtactctgaaaggtctagaaaaaaatggagataaatgtgtttaccaagtaaaagcggcatcacttcgatgacttgttcatatataaaatttcaaacagcagaaacagctttgctttttcccctattggttgtttactattgaaccttgcaacttgcaaggagccaaggactgaatgattaggacacttaattaaaatctatggcatttagatttgatttctaaaacctttcattgtaattgtgtaccatcgaacactatggaagagtttagggtgtcagcatgtgattttcatttgttttatagaaagagcaaaagttttctttcaggaaattaaaccatccatgtatttaacttaacaatgctggagagaagatagtatatgtttctttattgtcattgtttttgttttgtatgttgaaaagtatctaatctgcatatataatgtttgatttcacatggattacaaactgtattgtttttctcatatagcgcctactatgagagtcagagagtgtgtgtactttcttgtattgtgtgttagtagaaagtaaagggtgacccttgtatagtagattcaggttattctcacatcctatg

SEQ ID NO: 50139 - DNA, 1501 bp, Oryza sativa; identical to SEQ ID NO: 28195

SEQ ID NO: 50140 - DNA, 1501 bp, Oryza sativa
aaactctagattgattaaacaatgcgagatgaaccgcttcatcaactgtatcttgaagtatttcaactatcggcttggggaattgagtcttctgaattggcccttcttgtgtcatgatgaaacattgaagacaacgcatttgaaaatcagctacaaactgctccatctattgcctctgttcctccattaaattctccactgtgaccatgatattggcattgacttcttaagacatgtaggtataaaattcgtggttctaccgggcgtaccaaaaagcgtgttgatgtgaaaaacacacactggcctgggagatctacttagctctagtgcagatccaaaatattgatgagatacgggcgtgccagtcagtttgatcctgcaaactgacaagatatgtaaacagcagatcaatgagccgatcggctgacaagccgatggagtaattccagtcgatgccgataccagtcgatagcaatagagttttgagctatcggctataattccgatgtagattctgacgcttgatgtaaataacaatgtcgaggcaatcgactgatgataatataatataacaataatataatccagtatagaccaatcggctaacaatgatatgataaaataagtattgatccgaaggttaaagcagacatcgactggaggtccgatgtcataaaatccacaagattagataaatcaatgaaatctttgttgtcatcggctaaatcaatgaaaccagagcgatccaagagatcgaagcgatgcagccgtgaacaacagcaatgtagccgatagattcaccaggtccagcggaacgtagtacttaccccttcgccggagatcaaactgaaccgatgcagccctctgtcaggtgtcaagttccaccggatgataagtaaaaacctcggtaaagagggtggcgatgcaccgagagtagttgtattgatcgagagatagtttacaatgacccatggggagatactaaacataaagtcattatttgacactaaacacactttcctaaagataaaaggaaactaacaaactcttcctaattaatagataacttgccatgccgcatcgtccttgaactcggtaacttctggataagcttcctttaatagattaatttccttaaccgaatatagcaggaatccaactattggcgatgtgataattctcttaagggcttaccaaatttcactgttaacataagcgtagtcgtgaatgacaacgtgaactcatttaagttgaagtcggggctactgtcatggttacggataaggcatatctcctatcctatgacttatgtaatatgcggatacggtacaccatcgaagatatgatctatttccgtatacgataaaggaaatcacaagataatatggaaaatatccttataggcaagtgactaatgacgtcttacttggaaagggttgggtttcttctatatcgcgtgtagtccgatgtccccgagttctacttggagactaagttgatc

SEQ ID NO: 50141 - DNA, 1501 bp, Oryza sativa
cattttgatgcaattcgataagagaaaaagtgagatttttttagataatggaataaaacatcctgacttttgctctaatagctacaaccaattattacaaggttcaaacaataaaaaccaaacaaggtaaagatcccacaactacagaattctattggtgaatctctatccaaagttggcaaagagctgcatgatcgtcgactcaagtttatgatacgcatcttttattagcttgatatgatcatcatgcctttgtagttgaggtgatctatcaaaaaccatttcatttctactaagccagagagcccaacaaacagtggaaggtccaacaaggataagttccttgatttttttaattaacaccaacaagccaattcccaaacatatgagatataatatgtggagggtataatccaaacgagaattgcataaatctccaaagaaatctagcaaaatggcaatgtaggaaaagatggtaaatcgattcatttttcatacaaaaccaacatctcaaactaccattccaattcctcctagccaaattgtcttctgttaaaacgatctcccggagatgatgcaagtgctcacaaatcttcacgaagtcaacaagaagcacccacacaatcttgaatccacaactctcacacacgcaccaaatccgaatcaaacccgcatggagagatggaaacaagaaagcatgaatctcaaatgatccaatcagtccagcagcactcccaaatggagagagtggactatttatagctacacctccagatctgcccattaaagcgcaaatcactcgaagtaaactaaaaagggagaatcgttctagcaaggactatacaaacccaatgtgtttacaagttcgaaattaaaagcgcaagataagttactcttcataaaaagggaggatggtctccgacacctccgacatcacgtccttgctcgtgtcgtctgcccccttggtcaagaccatgttgaggtcgatattagggtaggcaagcttgacgcaggcaagaatgtgacatgcgcctgtgcgcagtccggtgcaggtgtcctcggccaccttggcggcgtgcttcccagggatcttctccatcgccttgatgaggtcatacagagaagacaccagcatcgtctcgtcggagtgttttgggatgtcggcttcgatgccgagttcccccgcgagatgatgaaggagagtgaagttcttgtggacggcatcccgaattggctccaggtggtcccctaggtccaacatctgctgctccagcccgtgccgctgtgactcgttcccaacaacgagttccttcatcttctgaaggtcctcgtgtgctatgttgtcacaccctaaaaatcctaaatatataaattgttgtttaattggaattattagaatttattttaaaagcctagaagagaagatctaattttaattaataaattccaatatacaatggggccagataaaattttattaaatactttgcttaactctata

SEQ ID NO: 50142 - DNA, 462 bp, Oryza sativa
tagccagttgtataaatgggcttcgatgaaggaggtggctcatagaattcgccccgaggagcagacatctcaaaacgaggttgctccatggtcgagaagagtttgacaggaatacttctctaggatagcaggggtgaaggtagactaaaaaagtaaaaaggatacaaggatgaactgggttcggaaatgatcagcaaccgttccccggcaacggcactaggaatgcttgttggtatttaatacgggtacagataaaatctgcaaccgcacggatataccgaggtagcacttcccctacggagtattccaagggtatcgaatccaaatgaacgtgtatggtcagatcttcctccggttcatccaaggacacaaagtaaatgataggccaggatagagaggatttactagtgagagacagtatctagggaaagcttaactttaatcctaatgcaatacttcagg

SEQ ID NO: 50143 - DNA, 1501 bp, Oryza sativa
accatcataatgatgttgacatgaaatcataaatactttctagttaaatttccattcaactagaattaaattaaatggcttaaagaaataataatcttaataatattgacatgaaaccatattaacgttggtcaaatataatatcatatcattaatttctttctgaacgaccaaataattgatcataattttccagcaattttaaatggctaaaataatgccaaattgaattgtgtaattttgaaattaattaaataggtgcttagtgaattaaattgatttcggccaacttcttccaatgccggcccaaaatcgggccggcccgtctacgcgtgagctcgcaagcttgagcggcgcggctcagcatctttttttgcggcccagaggccgtgcggcccatcggcggaggcggcccatcggcgaagatggcctaacgcggggtcggtctgaaccgtccgatctaatggacggctctgattcgctccacgccgaaaaagtcgccgacggggagggtgagaaccctaaccctagctcattcttccccaatcctcatctatcttaatgctggccgaaaccataattctgaccgaggccataacttattttcttgagacaattaacttaattaaactgaagcttaagcattacagaagaagatcataaattaacttaatctaataaacataatcttgaaataaaatttgcatcaacaaaacatggacagattgtagatgcggctaattgtcaagttcaaggccctaaagaaggatcatgcttctttggaggtcttgtatgaggagctaaagacttctcatgagagactcaccatttctcatgagaagcttaaggaagctcatgacaacctcctttccactactcaacatgaagctctcattgatgttggcatatcttgtgatttgcttgatgatagtgctacttgccatattgctcatgttgcatcatctagcatttctacctcttgtgatgatcttgtggatatgtctagctctagctctaactcttgtgtttctatttgtgatgcctcacttgttgttaaaaacaatgagcttaaggagcaagtggctaagctcaataagagcttggagaggtgcttcaagggtaagaacactcttgacaagattttgagtgagcaacggtgcatccttaacaaggagggacttggattcattccaaagaagggtaagaaaccttctcaccgtgccactcgttttgtcaagagtaatggtaagtattgctccaagtgtcgtgaggttgggcatttggtgaatgattgccccggtggtaagcctcctaagacatgcatgtttgattctcattatatgcttaggaaggctcatgatggtagcattgttgatagatatgtgggttcccctatactcggtggtaaaaagaatgccatttgggtgcccaaagctttggtctgtaacctccaatgacccaaacaagtttgggtacctaaaagagcttgatcttcttttgt

SEQ ID NO: 50144 - DNA, 1501 bp, Oryza sativa
tggagtactattttggaggaactaaacagggcctaaatatactaatataactagagaaaagaacatttttttttcagttttagctcatttatttgaacaaatagagtgggtcaacggtatattagtgacccatgctaatccccaacctcatatttgttggtaggaaaattctgttctagaaaattctgttctatcctttcttgatttcttggcaacatttggggtaagattctgggagtttgattggcttatcttagctttctttgtgcaaagaaccatctttcgataaccatatgcagaacctagaatagatggtactaagtctgtttgtcctgaaacctgatagactggatagtccgtgcctttgaaccaaattgcttatcaggacttgatttcagtgcacttgcactctagtatgggttaacttttgttgccaaaggtactttttacgtactagtatatgagttattccagcaagcaattctggaaaaaaagaaaaaaaaaacagactctaaatgctaaattggagtctggaaaagtagtgttatactatgtactatgatagtggaactgagccttagttttcaaacagtagttgtacgtacctctgaaaaccgtattggtttgcaatttggtttcaaaacactggagaagggactctgatcagctctctgcaagaaggaactgaaaatgtgtcatatatcgtacatgtcgattgctatttgctacagagcaaatttgccatacatcaaacaattttgcatgtcaaactgactccaaagatgattttactaccagccttaaaaataaaatgcccactcattacttatttacatatgcacattgtattgttgctatgtaacaggtttgatactgagtagctctggtactaacatgtgaagtattgagctatgaaactgaagtaatgttttgctcgaagtgctgctttatgcttaaactcaagtgcgccagaaaacagttgcatagccacacagtgataacttgaaatgttaacatatggtatttttagcaaccccaagtatgaactagagttttacaagtgcaagtgaatactgagtataatagagaaaagatcccaacggggagaaattcttagtaacattaggcaataacttatcgcacaaacatggcgactctgattattcagggataacataaaatgatttatatttaactgaaggacattgaaactgcaacagaacattgtaatggcgatgtatcagttgtgccatcaggtagtttccgtgaccccacatgattcagctgaagctgaagaaagactttcatgaaaatttaggccagtagcacctgcatcattttgaatataacatggcttatatgcctcataataattgaatacttgacactatcacactatcacagttttaacattttgctatacttttagctaaatgatccaaaatctctgcttgatattttattattttcttacctcttatgtataatccatttcaggtca

SEQ ID NO: 50145 - DNA, 601 bp, Oryza sativa
ttaaaaaagtcagcggcgtcaaatattttgagatggagggagtatgtggcaccttactaaattgtgttggggtagtgttggtagcattcctttttacctgcttggagctgtgatgcacatttcagcctttttactgtcccacctttctgttagcctgtcacttctttttatgccttccttctttgtcttaactttttctggtatagtttcttgaatatgattgtgtgtcactgtatttcttgtaatgttgagtttcattttatttaacatgaaataacacagattgcttgcttagtacaagaaagggttctagttctacaaatatcttctatgaactgtttctctttttttccggtaacaattctttcaatgaatagttgatttggaccattaagctttctcagtatgtacttggcttcatactttttgcatgctgtcttctgcttatgaattatatagtgttcgttaatatcttcaattctgattgggttatgtacttatgttgttgcttatatcttttcaatatagtttatactgctgtgcccatttttatccactcttgttcaatttcctttgtcaggtggactgtaatgtgtttagc

SEQ ID NO: 50146 - DNA, 1501 bp, Oryza sativa
caaacacattgatatcttcactttgtgttggttcgaacgcattgatttacatgccggtgtcaaccaatctaagcccttcatttgtgaaccatcataatactataaatctggataggtagccaacataagtttcatatgtacgaatccaatgatcatagtacaaatccggactagaactaacacttgttatgaatccaacgattacactgcactatatatattatttagtgagtcgtgactttcgctatttactagttacatgcccatgcattataattagatctatagataaaaatataatttggttcatttctatatattttttatgatgtgttgtggatttttaacatttatttagatatatttttagaggatagtttttataacggtgaggaatcaactttttaggtaggaggacgaaagagcattataatttttttaaagtttttttaggggaaggaggatgaaagaaattgttaagagtaaaaagataatttttttttggaaatgtgaagagactgtgcttttaaaataattaatataaatatatatatttttatgttatcttatatagcttatatctaaatacaatatgtgagtaattatattttatttaatttattagttgagttcccgtacgatgtatcgggaaaaaaatatttggttattttccttcaattatttaatatatgatttaatcgcaatatcttttcaacttctaataaagataaaaaaactatcatatttttaagtatttgactataatccatttataattattgattgaaatagagtactacttgaagggtatttcggtcatgagaattagatagtgtaccatctcttactctcactgtaaagggattgagcagggtaggtacaattcaacaatatctaaatgtgcatgctgtgagatccacacaagcaattgagcagggtaggtacaattcaacaatatctaaatgtgcatgctttgcatgctttgagatccacacaagcatatggatggtccagattgctggtgcatatgcacctaggttcatattatccagctcctctatatatatgtatgtatatatatatatatatatatatgtgtgtgtatatatatatatatatatatatatgtatgtatatgtatatatatatatatattctacacccggccaaggcgccatcccgactggccgcccccaccatcccgtgatccgcccccgcaccccaccggcccaccccaaaatagcgaaaagagaaaaaaaaggaacgcgaaaaaagagagaaaaaaaactcccgcatccgccgccgagaggagggagtcgcgcgctgccctcagctacgccaacctcgggcgccgccgcacggaggctccctccggccggcctccttccccatccctctcctccctccgtccccctccctctcctttcctccgtctttctcctccctcctttcctccatctctcgcaacaactctcataccttccacagcgtcgtgccgtca

SEQ ID NO: 50147 - DNA, 1501 bp, Oryza sativa
cattatatatgcagattagatacttttcaacatacaaaacaaaaacaatgacaataaagaaacatatactatcttctctccagcattgttaagttaaatacatggatggtttaatttcctgaaagaaaacttttgctctttctataaaacaaatgaaaatcacatgctgacaccctaaactcttccatagtgttcgatggtacacaattacaatgaaaggttttagaaatcaaatctaaatgccatagattttaattaagtgtcctaatcattcagtccttggctccttgcaagttgcaaggttcaatagtaaacaaccaataggggaaaaagcaaagctgtttctgctgtttgaaattttatatatgaacaagtcatcgaagtgatgccgcttttacttggtaaacacatttatctccatttttttctagacctttcagagtacactagtgaaagtttccaattaactccctccttacttgcttttattcagctcaaatttcataattaccgatgaaatgaacaaactaattgcatgcctaaaaatctgctatcagcctatcacatccttatggacaacaatgtgcaaagtagccactcaattcaatagccagtgggtgtttgatcaatacatcactaagttcaaaagtgtagagggtcaattgaatgagctgcgaaataattcacatagatgcaaggaaaaaaagaagtattgaagaaacgttatgcagggtgctccaaataaaatgataagctaacaaggtgtatacttaccccagaattattcatcttccagatttctaaaatacttccatcaagaaaagctgctccagtcagcagtacactgcagtacagagttgtcaacatgagctaacatctcaaactctaaaatgctgttacatttcaaatactaaaatacttccagcagtagaatacacagaactgctgcaaaaaagtagtgtgtggaatgacatgagtctccaacatcagggtgcgttatttgacagattttgacccaatacatggcattttgttcttcccgtcaccttgctcaaaatctatgtatagtaccagatctggctggtaccaacaatagctactctaatttattttggtagttgctatcttgctggtttaactgtctcagcagtcgttaaaatacaaactgaattgatgagcttcctttttacgaagaaccattggaacatcaatggtcataaagatttgatcctttttcttatggaacagcaacgataatacttttttatggaaccgttgaatccacaccaagtgaattcatgtttgacacaacagaaatggtcataaagactaaatcctcttctttcgtaggtcataaatgggcatgcaatttcaacggtattcattttatctgtactcggcaacatttgcaggtttggttctattttgatctcggtcagacatacatgaacatcctatgctgtcctattatttatgaacttggcaattgctttttccacaa

SEQ ID NO: 50148 - DNA, 1501 bp, Oryza sativa
tctatgtccacaaacataatcattatgaccatttaaaatggcaaattttgttataggacatcaaaaatctgttgctgatagatattgtgaaaatgttccatggctaaaaggcactctaaaaaactagtcattttctagaggttatattttgggcttgattagagagataaattctgaagaaagacgagaatgcccctaggaccacatgcttcaaacatggcgttagagtgaaaaatctagaaattatgcaactctaaatttgccatcaccccaagtgcatcactagcatacatcatatttcatcttcactttagcctaagctaaaaatcttttaacactatgtgcttttcatctttttgaaaaatttctttctccaattgagacaaaagtgtccttcagcaaattacctatttttaggttaatttttcggtcatgacacttttttttatgtctacaagtaaattatataaatttttagtgtcctgtaataaattttgctatttaaaacttatcagtatttttacatgtcccatcaatggtacctatttaaaatttctttttgtcttaccccaccttgtaaattgggtgggatgggccaacatgttacctactccctctgtcccaaaatataagagattttagttagatgagtcatatcctctatccagattcatagtaatattatatgtcgagtaaattgtacccacggtacaatatcttggcaagtgggtacgatagagtgtaaaaacttgagaattaaatgtccgagtgtaataacttgacaaatgggtgcgttctagtacaagaacttaacaatttagtattttggtgtatcaacttggctaagcatatgctaggtgagttttttcatgatttcaatatgccattacataataatcatacggatattatcttataatattgaattcaatctttaagaattatactggcacatagtagtacaatttacatccaattacctttaagaatttttttgttttcttcaccttctcaaatatcaaccaaaatataataatttctacatccagtttaattgactttcagttattatttattaggataaaaatataatacacttatacaaatccgcgctagtatattgtcaaaataagtacttaaaacttgattttatattaaaaaatgctccaaataattgagttgttgcaaatttattgtatcaaaatcgtacctagcttgcaagttgttgcattcatacgatcacttataaagttcttatactaaattacacctacatatcaagttgttgcactagaacgctcatttctcaagttattgcatcaaattgtatccacctgccaagttgatgcaccttgaatgcaatttacttttcgtagtaatattatatgtcttatcctatcaaaatctcttatattttagaatgaagggagtacaaaactatactcactgttttatttggggtggcctatcaaagttactgtggataagatttttgatcgag

SEQ ID NO: 50149 - DNA, 1501 bp, Oryza sativa
acaatttataaaaatgcatttgcttatacataatttgctccctcctgatttattactcccacttcgatctcccacagtcaaattaaatatatgtcagaaaaaagtaactaattctccctctatttcatattataaaatattttaagcttttttaatcaaattttattaagtttgacaaagattataaaaaaaataaagcaacatttagaaaactaatttgatatcgtaaatatttgctaagtttctaaaacaaaattttgacttcaaaaaagttaaaacatattacaatataaaaacggagatatcgaaattaactacgagctgatcagcttaagtataattacctgccggttacgagcgaaaagaacaagattacgggcagcttcatcgacggcggctgaggccgagagaagcagcggccgtagctgctacccgaggcggcggcgccgccgctcccgcggctcgtgggcggcgaggtggcggtgcgagggaggtggtcgtaggcggcgcgggtggcgtcgctgtggaggacggtgtaggcgtcgtacacccggcggaagcggccgccggcggcggcgcgggcggcggcgtcggaggccgcgtggcggtcggggtggtgcagcggcgcgaggcggtagaacgcggccttcacctcggccttgctggcgccgcgctcgatccccagcgtccggtagtagtcgccgtcgccgccgggcgccattgatcgatgtcgacgacgaagacgaagctgcaagaggtgtcgggctagctagcttctcttcgcgcgcgatgcagtaatttaggatccaaaaaactgtatacgaagcgattcaatttagatcacaattaatagggcgcttgtagccttttgatttcgcctgcgagtccgaatagaaactgagtctgagttcgagtaatacatttcgatagaattcgatcggatttgtgtttataggtcagtcaaatccgactctcttttgccggaagaagcccctatttttacacgcgcgtaattcaaacgttcgatcaacttcttgatcgactctaattaggaggtgtttcgctctatcaactccttcaccagttattaatctattcatttcccagccgtttttttcacattttgatcagcttctttaacaactgattttttacaatttgtccctttctaaaagcttatttacaaatacacctaaaaacttatttgtgcctacgtctaaaccccacgttggcgtacggcctggatttctctgtcgcgtgtgagattcacgagagttcatatagtggaatccaatttctggatttgaatttttttttacttaggtcaaatctattaccgagtttgaattttaattaattaaactcttactgtttgctgacaattaattgaacatgctctcggccttgatcagtattcgttacggtagatacagatctgatcaaacttcaaaagtcgcaaacaaagttgaaaaggaaacaaacactttggaagtaataatct

SEQ ID NO: 50150 - DNA, 1501 bp, Oryza sativa
atctctgaaatccaatcacaaaacggaacagcaaacggctgagcagtagggggacgggaagaatggtcgctttttttttttcgcatagtggacctcctgcaagaacctattatttccgtgcgttggtagagacattgacataatggctatataatcatgttcttcgtgttgaaaattttggaaggcaaatagtttaatgagttgattttgtgattgggactacctatatttattccgtcgtatttttcataaaatatagttaacacgtacatacatcgtaagtccctaagttatatatgtaattttaatgtatttacaatgtaagttaagttgacgtaaatagatgtaaatagaaaatgctagtgcaaatttaatggaaaacttataactagccattagatcttgactataatcagtcataaaatgtgatgataacattttagcaaacactttgtgatttatatttgtttaaaattttattatatgacatgcagatggtagacttcagccggctattatagagagaacaaagagtgatatgtattattgaacttaccttgtaggacgctgatttcttattgttgttataggaatttgaattttttgaaactcgtggatatttccatgtaatttggagatatgttctttttcgcaaatttttcgtcttttacagagtataaaaccaatattttcaggagcaccgatgccctcgtacggagttgctacgaaaatcaatgtgacgtcgctggcatagaaaactcgacactagtaggacttaactgcaaaacgtaaataaaaaaaaacatagctaaggtaagcaaataattccgtttactactacttccctcctaaggcaccgttttccaatacatgaaaatttcatcctgagatatctaaattaattcattcacttacttttctctaaaaaaacatgacctaaattttcgaacggcgattgtaattggtagggcctattcagaatcatgttattttataccataccattatttagtaaaattgataaatatatgatattatttagtttgttactaaatatttatcatacctagagaattgatcatcatatttaaccagtccttaaaaccttgatagcgttagcaacttaccaaatatttttggtaataccaaattctggaaaaattaaaaatgaatataaagtgaacaggtccgttgttcgtaaaagccacacgaattcaaaagacagtagtcttccatcggctgaccaaacttcgcagtaaaccccctgtactctccagaaatcacaatccaacccctaacccctttcctctcctctcctctcctctgcttcgcttcttcttcttcttccccaaaaaattccaaaccgaaacctctcgattcttcctctccaagctgcctcgccgtcgccggcgacctcccgcccaaatccgacgccaccgcgcgccgccatgcctccggtggtggcccactagccctgctcgctccggcttccccgactcca

SEQ ID NO: 50151 - DNA, 1501 bp, Oryza sativa
ctctatttatatctaagtcatcttttatgtactttaccttgataacatggcttagatgaaaatgcaaagctagcaacttcttcctagggatagctgagcatgagtaagaattttgagcaattgagatattgtagagcttaagcaatttgagtcaagtctcctgggatgtgtaacacatttgggctgcgctcaggaaccttgcctctctacatgaaaaacaaagcacgcgattatagtgagattaattaagtattagcctaaaaaacttaaaaaaatggattaatatgattttttaaagcaagtttcatatagaaaagttttacaaaaaatacaccgtttagtagtttgaaaagcgtgcgcgcagaaaacgagggaagttggaaaagtgaggaaaagaacacagtcttggtcgctgccatcgtgtggtttgactgaggctaaagttgactggcatgctaagtctaggcaatatctcctttgctcattattcggcattacggattttatattgaatggtattaagttgtgatcatgaacatattgaggtttgagtggctatttatgcgtatacgtatcctactcatccaaaatcatgtggtggtcacaaatggcataaaaaggtttaaataattattacgtatcctactcatccaaaatcatgctcacagaggtcataggttttttatcagaggcttaatctgtgcgcattaacgtttgtttcgacctactaatcttttcgtgtcatgtatcacctaactttctctcgtgagaaatggcatcctcatttgccagcacagctgttgaaaagtttagcatcaaggcccaaattgtattttgctaattgtaaggtcaatagtcaccgagtgtttttactcatggtatgatcgatgtgatttacattgtcctatttttgtagaaggctgcttatttaattactcatttttccacttccttgatattacatctgctttgcctcacatgttggttaaattacatcagaactttacaaaacctactgccttgcaaatatgaatgctaggtgattgattgccttacctgaatgtgtaatatacgatagtacatatgtatttgtacctatttagattagtggatatctgtaaacttaaggcaagctaaattcattagtacatgcttgctagttgatcttgccttttgttgtactattggaagttaatacatgtgccaaacaatttgctaatctgatagatggagttaactgattttacatgcacatgtcagacctgctgctatttatgaaattgtacaaccaatctgcaagttcttctgtctagggcttatgaaataatggcagaaaactcattttatgagtacatataactgcacacatcatctgtgattgattttttttttctgcccagtgcactggctatgtctactgcttgtatttatgacatttctgcatgccctgtttgtatttcttcccttcatattgaaagagtaattgttttgttcttgttgc

SEQ ID NO: 50152 - DNA, 1501 bp, Oryza sativa
ttctgccatttgctggtgcggctggtgcagtggatggaacacacattccttgcattgtggtagtggatgattccattcaacataggaactgtcaccacattacttctaggaatgttctttttgttgttggatgggacgaccgtgtcatttttgcagatgctggatggccagggtctgtgcatgaccaaagagtactgacagaagcagtacggagctatccctttgctttcccaaggctaccatggggtaagttttaaatttaatcttacacaaatgcaaagctgactatctattttcacaaaaaaaaatgagtttgcttattttttggtgcagggaaatattttcttgtggactcaggatatgcaagccggtatggattcctaccatcatacccacattttttgtaccacttggatgaatttgggggtaatacagaagcagccttgccgcatggaagggaagagactttcaactacatgcacaattcactgtgtaacacagtggaaagggcatttggagtcatcaaaagccaatagagaatcctgagggaattaccttacttccctaggagtgacgatcataccaagattatacattctgccttcgctctccataacttcaggattgacagctccgacactcatttccttacacaaaacccattgtacaatgggtacccaatcatttcagacgctccacctctacgcggctggtacgatgcacccaacagtgcggaagtaatgaatacagtccgcgacgctattgccgatgaagtttacaactagttggtttttagggcgcaccgtttaaaataaataacatagccatggctgttgtggatatgttatgtagcagtctgtgtgtttctatgatctgtctgttcctgcatgtgttaagtcagtgtgtttgtagtactgttttatttgtctaattttcctgtacgagactattatgattaatgcgaccacctttgtgttaatctctccatttgatttcgtatcttgcataaattagcttttagcatccttcattactgccgtgattcccaccagcagtgcgtcggcctcagaacagctgctaagcagcctcagcaacatctccaccgacggcctaacgtccatccaacggcgcctcctcgctccgttcctgctctgttggctcacgacagtactttgcttcccagctgccgtcaatcgtactgtagtgcataaagtagagatgaccattaaatttctttggatgaagccgttggaccaaacgaacgagcccgttgtcgtagaacttaaatgttgatatgtcaaatggcaccctaataattatttaattgatggtcccttgcccattaatctaatgttattaaaagctgttcaatcacataaaaaggttgcatcttgccacaaacactgctaatcggtattagagcgagtacaatagggtgatatacataggttgtacaagttaccacatcatatttgtgcttatgtggatgagacaggagatg

SEQ ID NO: 50153 - DNA, 1501 bp, Oryza sativa
atacaaactgtgcaattagtttttctttttatgtatatttaatgctccatgcatgtgttcaaagattcgattatgacgttttttgagaaaaaaattttgggaattaaacaaggcctaaaggtgaaagttttttgctactaagaacatacacaatagcaggctataagccagctacaaatatattttaaagagataaataaggagagagaagaacaacgggctacagatttatagccagctgtagcacggactccaagatgcactgtgtgtatgttaagtggggccagatattaatagtatagtatataactattgtatgaatgagctattagattggttatagatgaattgaagctagcagttggttatactattaaacttgctctaatacttatttcatcatgggcaatatttgtgcactgaatgactctttaggttgctttctttggaatggttccaactccctcttgtcgtttttcgtgtgcacgcttttcaaactatcaaacggtgtattttgcaaaaaaaaaaatataggaaagttgctttaaaaaattatattaggccctgtttggttccacacacaaattttacaccccgtcacatgaaacgtttaaacacatgcataaagtattaaatataggctaaaaaataattaattacacagattgcgactaatttgcaagaagaatcttataagcctaaatgcttcatgatttgacaatgtggtgctacagtaaatatttactaatgacagattaattaggcttaataaattcatctcgctgttactgacagattctgtaattagtttttttattagtgtccgaatatcctatataatacccgacgtgacacgtcaaaactttacgccctgatctaaacacccccttaatctattttttaagttagttttaattaatcatatgttaatgtgcttttccgtttcccttgctgaaacggaaggttccaattagcacaaaagaacaaagcctagagtggcttcaattatcacaacacatcaatttactgccccgtgcatataaacagccatgcgccgccttctttttccttcacttacttctccgcccacttgcttacttcttctctcttgggttctagtactagtctggatgaggataccaaattcatgtgctttggacactcgcctggagtatttaaccaggccaaatccatttcataatgtcacatcgatatcgatcaatcagcatggccatcaacttaatttgatgcatttggaagaaaaatttctctacgttaagcaaaattataccaagattacgagaatgtatttaaacttttacgagtagtagaaaagcaagtcatatgtcttgccaaacatgtatcaaagagtactggagtcaattttggataaataaatggcctaaaaccactacaaggtagggatcttttggttttggtagttgagcgaaagaatgaacagtactgcagcaaaccaggtaatgccgcttctcggggtgaa

SEQ ID NO: 50154 - DNA, 1501 bp, Oryza sativa
agtttatagaaaaatttagcaacaatataagtttgacgtagaaaatagcaagtcctgataaatagacaaaaacacccaatgagatgatataagtagattagatcatgcaatgagtagaaatgcataattacatactactatactagcaatatacatccttgttcttattcccccatatatagtagtatgtaaaccatattattgatataacgtacggcatccaactatacctttcatacttttttgcattcattgaacaaactgcaggcagttgatttcgatgcctagtcgaagaaaatgtacaacaatgctcacgcaaagtcaactatgtgaacacgaatcagatcgtagactcgaacattttgcttcgatgctttgacaattatggatcaatgtgtttcatccttttacaggagatattactctctccgtccaaaaaaaactcaacttctggagtttgaattttgtcccaaaagaaaccaatttctatcatcctacctacccttagcatataaaacgagaagttttatctctcgaaaaccctgtacccacctatcaccattactaattttttcgataatgaggagcattttgatcatctttactcctcactaaatttgtattggaatgctctttttggacggagggagtaggtacaaagcagacgcagaacaagtccactgcagaattatataaaatcgaatcactggcctttcaatcgctagactggactgtgtccaatattacttattctaaaccatattattgatactacgtaccggtcgtactagcactgcaagtcgcaccagctgctacaaccataaatctaccacatgaatacatatactacctctgtccgtatcattttaaatgcagttatgggtttccatgtttaacgttccgttttatttgaaaaaatatataaaaaatttagtcaaatagaaagtactatttatgtttgatcatttaataacaacaaaaaaaatactactccctctgtttcacaatataagtcattctaacattttccacattcatgttaatgttaatgaatctagacatcaacatgaatatataaaatgctagaatgacttacattgtgaaacggaggaagtaataaaaaaactgttcaaataagacggacgattaaacgttggacataaatagtgtaaaactatattctttatagatcggaggtactccctccgtcccataatataagggattttgagtttttacttgtaacgtttgaccacttgtcttattcaaaattttttgaaattattatttattttatttgtgacttgctttattatctacggtattttaagtacaacttttcgttttttatatttacaaaaaaaaattaaataaaacgagtggtcaaacgttgcaagcaaaaaaaactcaaaatctcttatattgtgggacggatgaagtagtatatcttcgtgttggaatacaggaataccaagctagccattttccttccattcctcaa

SEQ ID NO: 50155 - DNA, 1501 bp, Oryza sativa
gctacgcgataagatcaccacataatgcgctacttctctcgattcacggaagaaactacaacgccgattggcacaaccatagctttgcgcatctggtccatatccaccagcagcggtgtgaacagagcatttatagatcgacgagtttcctgggtgaacagattgaagacgaatgacggagcagaaaataactgagtaccagcccagttccgtacacgtatgacctgatccattgtcagcactattgaggggagatacccgtagaccggataaatagggtattggggtacattggtacgaggatctatgcgatatggcatctagcaaacaagaagacaaggattataataaggattgtgctagttcaggccccttatcaggtatagccctagtacagtttatataatattgatatggaaaactatatagtacaataagagtagatgaatccgatgataccggcgagatcgtagtcgtgggattagacaagatctcccggcaagttggcttcacgtgctccggcttcgtagactatggtgggtatgctgccggtgagattcgatgccttgaaccctccagggggtacgccttttataccgtggatcaacttagtctccaagtagaactcggggacatcggactacacgcgatatagaagaaacccaaccctttccaagtaagacgtcattagtcacttgcctataaggatattttccatattatcttgtgatttcctttatcgtatacggaaatagatcatatcttcgatggtgtaccgtatccgcatattacataagtcataggataggagatatgccttatccgtaaccatgacagtagccccgacttcaacttaaatgagttcacgttgtcattcacgactacgcttatgttaacagtgaaatttggtaagcccttaagagaattatcacatcgccaatagttggattcctgctatattcggttaaggaaattaatctattaaaggaagcttatccagaagttaccgagttcaaggacgatgcggcatggcaagttatctattaattaggaagagtttgttagtttccttttatctttaggaaagtgtgtttagtgtcaaataatgactttatgtttagtatctccccatgggtcattgtaaactatctctcgatcaatacaactactctcggtgcatcgccaccctctttaccgaggtttttacttatcatccggtggaacttgacacctgacagagggctgcatcggttcagtttgatctccggcgaaggggtaagtactacgttccgctggacctggtgaatctatcggctacattgctgttgttcacggctgcatcgcttcgatctcttggatcgctctggtttcattgatttagccgatgacaacaaagatttcattgatttatctaatcttgtggattttatgacatcggacctccagtcgatgtctgctttaaccttcggatcaatacttattttatcatatcattgttagc

SEQ ID NO: 50156 - DNA, 1501 bp, Oryza sativa
ggacttagacctaaggaacagatccatgtgtatcggctgccatatcttgagtggtttgatagggttccattgtgttgatgcgaaaaacacacaccggcctgggagatctgcttagctccagtgcaggtccaaaggttattgagatgcgggcgtgccagtcagtttgatcctgcaactgacaagatatgtaaacatcagatcaataagccgatcggctgtcaagccgatggaatgattccagcagatgccgataccagccgatagagatagggttttaagctatcggctatgtgtttgatgtagaatctgatacttgatataaataacaaaggcaatcggctgatgataatgcaagaaagcaataatataatccagtagaaaccaatcggctaacaatgatatgatagaataagcactgatccgaaggttaaataatatatcgactggagatccgatgtcataaaatccacaagattagattaaacagtaaaatcattgttgcaatcggctaaatccaacttatatgcaatccttataagccaatgcaatgtccaaataactcatcggctgaaacctcgatgaaacccttattggcagtcaaaaagcaggctaggggttatggttctaaacacgacttagtagatcaaacttaactgatgcaacactaagtatgaaaagaaacataatatctagacaatcaaggcgttgactgattttttaggctgctgaagaaagtcgcgagcaagtaagcggaatgtcctgactctatgttctcggttttcgtgttgtcgtgacttggtctttctgataacttgtatatttgtcttcatagggcttctccggcgtcctccgcacacagagaggacaatgtcgcaacaagcgtggcgccagtggtcgtcgcagcccgcgcccctccacctgtcacccttccgccttcgcctcctccagcgctggctgccccacagacaggcgccgagatgttggctgagggccggcgtctccttgaagctgacgcttgagagctgcaactcgagcaggaactcgacatatgtcacgcccggaatttctatccaaaattccaaacgtttacatgtgtgtgaaccctcgtccaggaatcagctgaggcacacaataacaaattgataatagagtacaattattactctaattaataagcgaataaaatgtcattacagaggtagatagttcctctcaatcaataaagatctaagcagcggaaaaataagataaacggcgcagacgactccactccacaggcagcttgaccagggctacacctaatcctctacaccatcagcatcactgtagaactcttcctctgattaatgattgcaaggtgagtatatgacatactcagcaagccacgcagcaaatatgcaagtgcacaggataacaaaggatggcatagtagggtttcatttgcataaacagcatttaataaacatttcagaatttaataaaacagttaagtaataattaa

SEQ ID NO: 50157 - DNA, 1501 bp, Oryza sativa
  unsure (1)..(1501): unsure at all n locations
tgagcatttgctattcctttgctacatatttaagcctacctagagctccacagatttgattgtagccatacagcaagtgtttgccaaggcatcgatacatccaaactccattggggtgcttggttgagtcagtgtacgtcaccattccacttgctttggtaagaacttgtaagagcttggtgaaaagcttgagtgtgtgtgatatttcagctgccactacctagtagttgataggagtgtgcatattcttgtgtatgttttttgtttgctactaaccatggcaggattgtgcaaggggaaacaagatggtcatgctcaacatcaacatcttcaccatcaacgagatatagcgacttcttcacgcatcacatatgaggtacatgataatgatcttgcaagggtagaatctaaattgccagtttttgatgctaagtatgatccgcttatgttaattgggagctagcagtagacaaacaatttgatgagtatgatttctctaatgctcaaatgattaaggctgctagtaataaatgtaccggttctgcatcattttggtagtacacagttggcaataagcttgaaacttgggatgaatgcaaaacaatgatgaggaaaaagtctgtgtttgcatattataaacgtactctacttgagaaattagaacatttaaaacaagggtgacaaacctgtgcnggagtactttcatactttttaaatttggtatcacttatagtggtttaaaagaaagcaatgagaacacaatgactagtttttttttagagggcttaattctgatattcaggctgggcttattaatgtgacatataatcatataggccacttgttcatgctggcttgcagtgttgagagcaatgttttaaagaacccaaaggagaaacaagctatgcttgtgcctcctattaatgacattttgcagggagctcagaacattcaccatgaggagaagagcaatatgctcgggatgtcatctccatcgctcacgaaggaagaagagaagactgatgcacctacaatatctgaagagggcataaaaggtaaattaaatggtgctgatattactcaatgtgagtgtgcttctgatgagtcacatttgtccactatccatgctaatctagagcaaattttggtggaaactacttctgatttgcctttgtcacaagttgatttacttgctgttccttgtgataaagaagagttgttgataatgcttcacttatatccctaccacaactagtgaatgaaaatgctatttctagtgtttcattgtgtgctgattttaagcatgttgttcacattgctaatgatgttgaggaacgtaaattgataacttctttaaatacttttggctatgttcagttcgatggtttttgtgagctcaataatttggaggagaaattatttgctaagtttgatttgccatgtccaacaaatgctatttttcatatctttggcgaatataatgatagaggtgatgtgacta

SEQ ID NO: 50158 - DNA, 1501 bp, Oryza sativa
acactgaagatgtgggatacaaagttactactatggcaagacggtgaaggacaagcaatgctcggtcacgatggaccatgcggcggtgaagggcaagcaaggggcttggtgccaaagaaccaaatccggtggtgaagggtgagtgacggctttgtcatgatggaccgtgcgaggccatttgaagctacaagtaatcgcatcaatcatttgaggaatatatggtgaaacggttttggcattggtatcccttaagacaataaaagaaagatgaaaagaaggcattcctgttgacataattatcttcctatttatatttgagtttaggaatgccgtactattaagagggatacaacgtcgaggtgtatatgccaccggtttcaccccctaacttgaataagccattataaatatgcaaactgcaaatttgccgctgaaattagtttgcattgcttccgtttgacattaccatctaaactggtatgattaaaagggcaaaaacaaggagcatgaaaagaccatctttcccctagccggaatagatctcgcacccctctctcttgcgggtgtgcaggaggaggatgtggaggcggccaggtgggcagatggcgtgtggacgggcggtgtgttggagcatgacgccatgacgggataatgtgtggaccgcggcgtgtggccaggcagacggcggcagggcggcggctagtgtgcgcgtaggtggcggtcggagtcctcaccatgacggcatcggagtaatatttttgaggtaatcttgcgggaagtgcgagtcgacggcagccgccgcgatagcagctgcaacaggagcagcaatgcttgcggctgtagcacaagcatgcgacaacagccgtgcttgtggcggccccagcagcattgtgtggcatcagctcactataggcatgtcgttggagcagcagcagcaggtccctgcgacagcagcaagccagcaagctggtagagctacagcaagagcagcaacaatggcggacaaaggcagcagcagctgtagcagggacaggggcatccttgtcctatttgttttgtgaaaacccatagtctaacgatgatattccgagccgtgtatccaatatgtacgtgggttccaaccgttttcgatggcaggcatgcaattacgttttttatagtggtaaattcacaataccgattcaaaccagtgctaaatatgcaattggcccaaaatgagttgagtagtcctctgagtgagctttacatagagtccaagatcatcaaaaaggactcccgagcgaaaagttatggtcgttttactctgtgctttccggaaattccgaaaaattatcggaaactccgaaaatttttgaaaaactccgaaaattttcgaaaattccaaaaatggctgcgaatctgagattggcttctgtaaatttttggacttatctgaaaatgcatttcggaacttccgaaaatcacattcttggcctccaacggctagtttttgaggggctcg

SEQ ID NO: 50159 - DNA, 1501 bp, Oryza sativa
acctgttacatagcaacaatacaatgtgcatatgtaaataagtaatgagtgggcattttatttttaaggctggtagtaaaatcatctttggagtcagtttgacatgcaaaattgtttgatgtatggcaaatttgctctgtagcaaatagcaatcgacatgtacgatatatgacacattttcagttccttcttgcagagagctgatcagagtcccttctccagtgttttgaaaccaaattgcaaaccaatacggttttcagaggtacgtacaactactgtttgaaaactaaggctcagttccactatcatagtacatagtataacactacttttccagactccaatttagcatttagagtctgttttttttttctttttttccagaattgcttgctggaataactcatatactagtacgtaaaaagtacctttggcaacaaaagttaacccatactagagtgcaagtgcactgaaatcaagtcctgataagcaatttggttcaaaggcacggactatccagtctatcaggtttcaggacaaacagacttagtaccatctattctaggttctgcatatggttatcgaaagatggttctttgcacaaagaaagctaagataagccaatcaaactcccagaatcttaccccaaatgttgccaagaaatcaagaaaggatagaacagaattttctagaacagaattttcctaccaacaaatatgaggttggggattagcatgggtcactaatataccgttgacccactctatttgttcaaataaatgagctaaaactgaaaaaaaaatgttcttttctctagttatattagtatatttaggccctgtttagttcctccaaaatagtactccatccgtcccaaaataagtgcagtcatggttttccgcgcccaactttaacaactcgtcttatttgaaaattttttgaaaagaattaaaaacataattcacgagtaaattagtatttatgttttatcatcttataactacaaaattgctaattataaaaaaatttaaaataagacggatgatcaaagtagggcgctgaaactcatggctgcacttattttgggacgggggtagtaaaagttttgctgttttggagtactttttacaaaatggatctaagcaaaagttgtcaatttagtatttgccaaaaagtgtattgagagccgtgcatcgaacaccatggcggtatttgaattctttggagagagaaaaaacaagaagaatgtgcttgagaatttgcatcgaacaccatggcggcaaagaattaatcccttttttaaactcatttctcaatctcctaattagccgacacgaactagaagagcaaacccaaagcatcgataccccaaaaagcagccaggaaaagagagaaagagagagagaaagcgaggcgcgtcgcatctcgtccaaagcggggagggagttagataaagattcctctctccgactacttccctattggcattggatgaaatcga

SEQ ID NO: 50160 - DNA, 1501 bp, Oryza sativa
caatcagcatcacaatatccttccacatttagatgcccattcttcataaaccacaatccctttccaggagtcccttttagatatctgagaatcttatgaacaacatccaagtgaccagttcgaggatcatgcatatacctactcacaacactaaccgcataggaaatatcaggtcttgtatggcaaagatagatcaagcgtcccaccagtctttggtatgcttccttatcaacgggatcacctgattgagcacacaattggtgattcctatcaataggcgtagtacttgcacgacacccaagcattcctgtatctgtcaacagatccaaaacatacttcctctgagagagaacaatcccctttgatgaacgagcaatttcaattccaaggaagtagcgaagaggaccaagatccttcacctcaaatgcctttcccagcctttcctttagacacctgatttcttctacatcatcaccagtgatcactatatcatcaacatacacagccaagatggtgatgtgtgtccccctatgtttgtaaaagacagtgtgatctccattacactgagaataccccatatcacacactgcatgcctgaacctatcaaaccatacacgtggagactgcttcacactactacaaatccgggcttcagtgacgggtcatctgtgacgggccaacgcaactcgtcaaagataagtcatctctgacgggccgaaaaaatatcctcttcaatatatggctaccagggaggacccgtcacagatgtgaagtcatctgtgacggcttgcacttgtaacccgtcacagatcgtctgtgacgggtcacaaccatggctcgtcacagatgacatgtcatctgtgacgggtgtagtattatgaaccatcacaaaagagaccactcatctctgacgggtctttaactaacacacgtcacagataacgttatctctgacgggtggtagttatgacccgtcagtgatgagtgaaaattcaaatttttaaattttgcaaaaaacctcggattgaaacatgtcctatataaaagttgtagctctcaatgatatccacaactttataactaacaacatttctattagagatcgtttacatccccgaacatgcattacaagtgatcagatctacttttaaaaacaaaattttgagttttttttttcaaatgacatggatggatacatgccccgtatcaaagtcatagaactcaatcagatctacaacattataattgaaaatattttcatttcacaaaatttacatgttataaagtgagatatattttgaaaaatgaaattttgaattcttcaaacaacatcggatgaagatattttctatgtaaaagttataaaacacgatgagatctataactatttagttgataatattttcatttgaagttatttagggtgttaaatatatgttaaatgattcagacaagcatagacaaaataataacattgggttagtagtcaatatgtgttaag

SEQ ID NO: 50161 - DNA, 1091 bp, Oryza sativa
gtcacctttcattttttcataccctctcacattatctctctccccactcatttttctctcctctcccacttcatcctccactggcgggcgggtggtgtgccggcggtgggtaggaggtgcggcagcagcgggcgggaggctcattagctcctcctcctccaccgcctggcaagaacgcggcgggcgggagcattggtggagaagccatctttcgtcgatcggccgaattccacaacagtcccggatgcaataaaaaccggggctaaagatgatctttagtcccggttaaaaaaggtaacgggcatatttgatctttagtcccggttggtaaagatcatctttagtcccggttcaaatgctgtcagggcctgtcaggccctccgggatctttagtcccggttagactaaagatcgtaactttagtcccggttggtataaagatcgtaactttagtcccggttgggatctcggggatctttagcccaccgggctaaagtcccacccctatatatatatatgtcttcttcctcctccagctgcccgagcaagcttcaaaatttcttcaaaaaagaggggaggtcatgccaaaatttctagtaaatttattttggtaattacatacaaatcggaggtgcctaaaaggtttgcaacttcatccttcaatgtttttttgtcatattacatttgcagctatgttttgcacacttttttgtctccaaaatttagttgtaagttgatgagggagaaaatttgtgtggggaagaaagaatatatagaaatttagttgatttgctaaagaaggttttataaaatagttgagaaggaaaactatagtgaaagttaatcttgaatactagaaaacaaactaaaattaaaattaaaagaagtaaaacacattaaaattagtttaaaactttagaaatagtaaataagaattatttggtgtaatattttatgatttttgtatgaataaagatatgtcattattgtatgactgttgaaacagtttataattatcttataattattgtatgactgtcattattgtaagaataattatttttgtacgattttttttcgactcatgtaga

SEQ ID NO: 50162 - DNA, 1501 bp, Oryza sativa
tccaagttccaacaacaaaatagttatgtaatgatttttttcaatagaagtattcatatgtgactatatataatcttggcaagggatgttccaaagatttatgtaactcatgcactcatgaactgatggaccatctcatatagctatccacgcagctatttcatcaaacacctagcgtgcagccgtgcaggctcaacctcaagactttaagagaagaatatcatcttattttcacgaacagcaatagaaaaacatcacgaccgcaatcctcatataccaggcaacaacgaggtagtctcagaactgtagcgtgattggattctgaacggctttttcagatttgaacaacctatacagcgatccgaagcacttaccacaacttcacaagcacttcgaccaatcgaatgtggccacagctgaaaactctctgagatttctcaacggagagcctgaaaacagcgacatttcctcgatccacgtagccttcgcggatttggcaggaaaaatcaggggagaggatgataaaagagactgaacaatttaaaacgggagaattggacggcagcaaatttagcaaatatccccttgtacatattcacaaaagggactacatttgttaaatattaaactaaggtcctttgtcatttccaataaactctttgacagcctcaacccattgcagccatggtttttcacgtcaaactttaactgtctgccttatttaaaaaaaaatttaaaacataaatcacgagtaaaatactatttatattttatcatctcataataacaaaaatactaattataaaattttttaaataagacggacaattaaaattaggcgaaaaacttatggttgcacttgaaatgagacggagagagtattaagtaagggtaaagggtccgtacaattggttatttttttctaatatttactttgttgttcttatttcttattaggagtattttttttttccaaactactaaacgatatgttttatataaaaatattcatagaaaagttataaaaatcatatttacctatacaaaaattaaaattaaaacttaattaattatatcctggtgaatcatttcattttgcaaattaaacttgcaccgccgtatttttttagttttgagccattgatgatggttgatagactaattaattactggcatgtactaatgttcttcgtgtcgattaccaatgctaaattgcgattaatcagcattaattcgcaaaaatctactatactattttatttaatcaaatcgctccttatccgagtcagagggggaaaatcagggtgtgattattacctttacgatttacccctcgctccatctctatatttgcgtagagctcctcccgcacttgattcccttctcgcatcgtcgccctcgtctcgaagccaactcgcgacacccaaaaccgaaaaaaaaaccaaaccctcgtcacttcccacctcttcggcggcggcggcggaggcggccatggcagcgg

SEQ ID NO: 50163 - DNA, 1501 bp, Oryza sativa
cagtgagccggacagtgttggcacttgggcgcagcatgcagcagctcataaacctcatggaaaagataccacatcttcgaggtgcccatacaacatcagcatcacatcaccccgagtacggctaatggagccaagaaacctcccagagaatcacagagcatcacaacttccttcctctccttccagcacgtgctgttgcaatgaagcacgcaacaaagaacgataaacagtcaacaagaaggagaagaatcactccgattatcggtagatcaacctgaagaatcctgtaccttcggagcctgaaacacctcgaggagaagaacacgatgagaaggtgctcctttgcgtagcagctccaccaggtgtcgagctaagcacgcgattccacaatggcgtcgtcgccttcctctgatccaccagaaatccattggagtggacaagagaaccacacacacgacagaccgtacgcgcggcggagcactcgcgaatttgcgatagcgatggctgatgaactgtaaaagcaatcggatcatggagattgttgggcttgggcctacagcctcctccctgctgggcctgacccaatcaaggccacatcatgtcttgactcttgactccttttttttcatcagatttctcaagataaagaatgaaatatgtgatactaattcatagtactattcaagagcacattttctcatatatcaaagataactagataaggtattctattctaagtaggcaattgcgtcagaaaaaaagggaaattacagggcacaaggtggctgtccacatcatctgcatccatgctgactggaaggatgatcactcattctgtttcaccttctcctgttcttgataccaacctttatccttatccaaccttcttgtgtttttcaccccaactgctgggattctgggagcatattagtagaatattacctaaccaatttgcacacactagctgccaaagatgccatccctaggaagccatgttggaacagaccacttgaagcatcggtgctcacacgacaaaaccataaaactccagcagctgtttcttttcttgttgtcattgccagacatgggagagacggcagaaggtgttgaagcaggcgagaaatatgtgagcataccacagttggctggagttggaactcttctctccaatggaggaaaggtgagactgatcatagtatttgatagccctgatcttcagcttagcttgtgttctgttgttctgaataaatattctctaattttcttgtggatatactatttggcatccaagcatgatttaaatatagcaaataaacatcaatacatagaagtactccagggattggctgttctgtttcatgatcaaatctgagatctctgcttaagtataaaactgctaacatggcatagtttttccaaattagtatcagtattaaaacttcacactatgcagtactgcaaaaatatgtttgcttttggtttcagaaagagaagaattagt

SEQ ID NO: 50164 - DNA, 204 bp, Oryza sativa
tgaagaaatcactatcagcaaaatcgattttggggataaatggcatctaaaattgctattctccaatcaaccctaacaaaaaaataaagaaaaaacgaaaagaaataagagagagaagagaaggtcgagattttacagcatcagaacagcagcgtcgtacaaaatctcagtcctgggctaattttaattttgaccagaaaacca

SEQ ID NO: 50165 - DNA, 467 bp, Oryza sativa
cttacattgtgaaacggaggaagtagcaacaaatacctgatgttactaaaatactaataaaagctttacatacgcgtatataatttttatggtaatatactaatgtctataagcaattttctcatcttttgaaagtgcccgtaggggaaagatatgtgtacgtgtattcataggggtgagtgtgcgtaagttgtgagcgtatgcgctgtagtatgtttcaaaaaatgtatttttagaagcatctcaaaatataatatttttggacggaggtagtggaacagcccgacaggtaggtcccacatgtcatgccattacgggctggaccggttcacttcccttcaaaagcccaaaagcccacttatttgtttctaaggcccatggacaagtaggcctgacctgccatcccaaaccccaaaccccgcatttctctttctccggcggcaagcactcgacctcgtcggcggcga

SEQ ID NO: 50166 - DNA, 1501 bp, Oryza sativa
ttgttgccaccatagtgactgtgagtgaaaatgcattccaatgaggcctgcctggagggaggagcgatggggcgtgaggctctcacctaccacccggcggaccaccactccggtgcccgccggccaccatccaagccgcagttcggctcgtggcgcgacgtcgtgaagaaagataggggccttgccgccgctgaggaggcagcttggacggaggtccggcggaaggggagcacggagcattcactgcgggcaggtgacccaacctccaacaaacaggacagagcattcaagccgaggaaggagttcagcaaccatgacagggcattcaattcggagaaggagatccctcgctggcttctggggcgctgcttcaagtgcctaggattgggtcatcgcaagcttgactgcaagggagagacaaggtgtttccattgctggtacccgggtcacctagcgtgggcgtgtccggagaggaaggcggtctctgggggcaatccggggcggcagtgcgtctgggcgcagagaggtggccgtctgggagaagagaacaacaggggaaggtgaagcaggtggtggtaagggaggtgccgccggcgaagtcgaagatcgtcaagccggccccacaggcgacagaaaagggcgcggtgatagccatggcgggtgctaacctgggcgggtaccagatctgtgcggccacgccgccgcagttcgtggaaaagtaccgcatcggcgagcccgactcgtggctagaaagggggcgggtggtgctgtcctggacctccgggatggagcgccatgagaggtacctccaggaactctccctgatggcgtcggtgctcaagggacggccgcccgtctcgccggcagagcttgcggagacaatcgagctgcacacaggcgtgcagcagcgttacttcagggtggaggtcacgcgcccggaggatttcctgatctcgtttcggaaccagagggagaaggaggcggtcctgcggtgttcgaaggcgctgttctgtaatgaggtgcctgtttcgttcaagccgtggaacagatgctgctgggcggaggcctcggctttccagttcttcaccaagatctccctcgacggccttcccccgcacgcctgggaggaggaagccatgcacaagctggtcaacagcttggacggtcagcttgccgagctgatcccggcggcggacgcgcgctgcctcggtctcttcgcttggttcaagaatccgtccgaccttccccaccatctggacgtggaaatcccggaacgcccggccgcagggcgatggcgggaggggacgagcgcgacaccaccttccccgccgcgggagaagccggccctcacctatccggtcatcatccacgtagaagaagtcattgaccctacgccgttgcatactccgccgacctccttcgacgacaactccgatgatgaagacgtcacccggcggaacactttctcctgctgggcaggtcgctacgatggcgctggtcc

SEQ ID NO: 50167 - DNA, 1501 bp, Oryza sativa
gttagctgcaattgtattatttgtatagataagaaatcaaaaatatatatagttccaatcaactatatatattggtaaaaaaaagtgaaggaaatcaagcaatcactggaacggataccctcatctcaaacgggcagtaagccccatctcaatcgggcacggcgtccatcacaggctagaagtcactgatgtgaaaagtaatctcaattgggcaaacggccgtcactgataaacctatctcaatcgggccctaattaaagcctgtcaccgatagctttgacccagactaccagtcaaactatagcccgtcacagatgacctatctcaatcgggccacaaatagagcccgtcacagatgactactaacctcaatcgggcctaaactagagcacgtcacagataatactaatctcaatcgggcctaaactatagcccgtcacagatgactgtcatctcaattgggcattagctacagcccgtcacagatgaccatcatctcaatcgggcattaagttatggcccgtcacagatgagtataatccacaaaaaaaaattgttttttggctagccttaggcctttgctagccatgcccgctgcaaaaatgacagaaacacagcgcttctcaaaaatcttattaccgccttttcccagtgcagaatgtcaaaggcgaaggttatagagacctgctctcccgatcgccagtgcacgctagcgagcgggatggtgtagactacgagcgacgacatagtatagagggggcaaaccctaaatttgatttcgcatgtgttgtgtggaggcggcggctcgacttatatagagataatttgatgcgtatgttgtgcacacgcgccgccaggccagtccaggcgtgtaagagcgtgcgtgtgttcccctttttctgtcaacctcacatgcctcagtgtctaagagagtatcctttcttatagggaggtctccttctcctagaatagacaaggtgtactaaactcgccatgtatgccatcttatgatgtaggcttttatgatttttcaaagaaaaaaatcttcgaatgggttgagacccattcattaattccaacatattgatgcatagaccaaaacttacttctccataatctaaaagaaaggtacagatgggtaatcgaaaccttaatgttggcatgttaatacccatttggtaacaacatactattcagatatgaattttaaaatttgaaataattgtgcaataattcgttttgtttcttttatgaaatacaatacatacagcggtgctcatatatacgtgcacactcatatttatgaatgaataaacgaacacccagttcgcaaccctagtgtttgtgataggttaggatgaattatcatttgttgtggaacattatattattatttcttagtgttgactatgctattaccacagtttatgactgtctattgtgtattattatatattaattagttgcacgtactagtacgcatgactacattttatcattt

SEQ ID NO: 50168 - DNA, 1501 bp, Oryza sativa
ttgaactaatctagcacacgaagccctcgccgccgccgcgatgtaacggtttccctcgttgtcgtcgtcactgccgccgccaccgtcgctgcgccgctatcgccagcaccgcagccgcctctcaattaggaacatgtcaagaaagatggaaggagatatgcatacgtttgttctgtttgtcgagttaaaaaggaaatgtgattggaacaaaaaaaaaaagctatttggggttttctataaaatgagataggtctttcatatcaaagctgatgtggcaattttgctaaggtggaatagcaacgttacaattttttttacatggctacttttgcaccatgagcgcacccacctagccaagttattgtaccgctatgcttgattttcaagtttttacacctaatcgcacccacctgccaagttcttgtaccgccaacgcaatttactcaaaaaagattataggccgatagaaattaatagatagcaagtggtgtatacataatttctgttgcacgaaagacgattaaagtgtatggtccgatccaccaaccgtagatcatacatatctttttcacattggacatgctccacgacaggcccaactagagcaacaactctaggttctaggcttacataaacaaaatactagttgatgaatgtccctcccttttaaattgtgctcgcccaacatcaattatcgatgtgtcacacatcagacctagcaatctccctgtcacatcaacccatgtgacctcgaagactggttaaccaggtcttcttctccatcaaaaccttggctttcatacaacttgtgaaaatgttcaacccggctaaccaaccatgggctactcatatcacattgggtctattccaacacaggctcaaccggagtcaccactttaggtcctattcttaaacaacccaaaggactagtcttatgggtgagaattgccttcaccttttaagctaagctcttctatcatcaattatggatgtgagtctaaacccaacaaaaacaatctgctgctattggttgcttaaaaggcatataactattcacatatggatgccatactgccatcccagtcctagacaacgatttcttaacatcataattaaaatagagttttctgtcacaatactattaggacgactatgtcaatttcagtcactaattgacaacattgatggaatgaacatttattcagcaaattgtcgcctgagttacagaggcgaggtggtccagttgtcgtcttacactcccgcgcatgatcaacttatttagcccgtcgtctgagcttcgctcgtagtcactcgcttctcagttctctcacgctggccatcatgcaccacgccgtcgtcaatgttccggtggcggtcgccgctgccatgctctacgccctcctcgttgcctcccacctagctccaggaattggccgcctcctcgccctcaccccggtgcttgcccttctcctcaatatcacgttcgctatcccctgcttta

SEQ ID NO: 50169 - DNA, 1501 bp, Oryza sativa
gcacatcgggcactcgtgttatattgagcgctgccatgcttcttctctctcacacaccttgctgtgggccatggacgacctttgcctcgaaccatgccaccaaccgccggaacagaatgtcgccgggcatcggcctcaattatgcaccaggccagtagcttctttctctccatcaccacatcatttctggtcccgcacctcgtcttcgtccgctggtttccctccgcatggggcctgctgtggccggagccggggctgggtgaggcagccgggggttggggattgaggccattcttgcccaacctgtcccgtcgtaaactctatatgttctagtgagtacatactgaataatgcctttccaatggcaattggcaaagtagtgatgcgtctggcggtgaactgttcgtttaaatttgtctaattcagctttaagaaagtaccactacaatttggaacgggtctacacggccgggctactagcacattccttttaatgaatcatgactacgatttgttacgagtaattaagctataacacgtccaagtcggctttaaactatgtagtgactatatatccaggagtagaattacatgactcatatttaattaatcaagttgcataagagacgataaccacacccagtctacctgataaggcgaagaaaacacgatgacacgagcactgggcggccattggggcaacttgatgtaaagaagtcgcttgtcagctttcgtcgtcgcgtctctgtctagatttcaccaatatataatatttctcataacctattgtcaacaggaaactttaattacatagtatatagtactgactaaatacaaagtaacaacgtttccagcttgttgtcttctgtcggtacagtctgtacagatctaactagaatttgaccttgattgcacttcaagtttcaacttatttgcaagatttgtgagcacattgaaatatgagcgggtgctgatcgattttgaataccggcttagggaattttttttatcggtatcaccatatatcacacctacagttcgaatccaaaatgttgaattgaaggaaagggatcctctgacttaactgctgtgcagttgagtcactgacatgtgggccatagtaaagtgggacccacatgtttgcatgtgcattttaagttagaggatctgcttcttgaattgaaaagccggtcgatcgatggcctgaatttttaattttgtcgtggctaaagtgtagttttttatttgatctgacgactataaaatattaatacatcgtatatatattataaatgataaaatgtagtcatgcgtactagtacgtgcaactaattaatatataataatacacaatagacagtcataaactgtggtaatagcatagtcaacactaagaaataataatataatgttccacaacaaatgataattcatcctaacctatcacaaacactagggttgcgaactgggtgttcgtttattcattcataaatatgagtgt

SEQ ID NO: 50170 - DNA, 1501 bp, Oryza sativa
cggcaaaataataccagccgcacaaataacaaacttcattcgcaagaataatgtaggtttcggcaggagcatcggtcgaaagggggcgccgcataccataccacatggtttgcacggtctcggccgaagctccaatctcacccttgcccgtgaggggcttgttggcggatggcatgaggcccttcgaccaaatctgccgaaacccatggcgaagactatggagcaagaatggcgtgaggcgaagagtcgtgcgagtgccttgccaggccagaggcgtctcaggcgaagggtgcaaggcgaagactatctgccgaaggaagacgacttcgccttggcaagttcgcccccgcgagggccgaagaagcctttccggcccatcaagcctaggggcaatagggccggcgatcgccagatggcccatcaagggcccatgagcccctatatcatcatgtacccttgtaaatgtccctttcataagggtaatcatgtaaattcccctgtataatctaaaccctagtagtaagaacctgtaatggggctataaaatgttggaattaatgaatgggccttagccactcgaagattaattctttggaaaatcacaaaagcccacctcatgggatggcatgcatgtggagtttagtaccaccttgcttattctaggagagggggacctccttaaaagggaggatgccctcctagtcgcttgaagcatgtgtggtggagagaagagggaaaacacacgcgcgctcgctcgcctcgccgggccaggccggcggcgcgcgtgcacgacgtacgcgtcgaatggtccgaaaaattggctccacacccttgcgcagatgcagcctccttttgcagttttgttttgttgcaaattcggattcgtttttgttttggaaacgttccgaaagatccggtgcgtgcaaacggcgtggagtccggataagttacgcgcgacttatccggttcggttacgcgcagtagagatcgtgcgggcgccctgatcaagcgacatacaaaaaaatcaatcttgggtttgcttcctactctgtactgcgccgtcgctcgtagactactctatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatatctataatctcaacaatccaaaaaacttattataggcactgtgattttacta

SEQ ID NO: 50171 - DNA, 1501 bp, Oryza sativa
gcggcccactcgatatagttggttttggtgagggtaggccaccaaccgccgggaccaaagtccctgaccaccgtctggacgccgtggtggccatggcgccggtcaggggagggagagccgcgctgcctgcgagggccacgctctctgtcgaaccagccacctccactcggagcgccgccgccgcgcgcgcgctccgggctgccgccggcacacccgtgcccgtctgggttcccatcggcgggcgcgcggtcccttgggccgccgccgccgtgggggtgggcagcacgctctgcccgctcccgcgccctccctcttgctagctcctcaagctccctgtcggcggtgatgtcgccgatggagccgttgatgttgctgcgcaaggtctcaacctctacctccgccgcacgtgccgcatcttccgccgcctctgcttccgcctctgccctggctgctgccaactccactgccgccagtctggccgccctcgctgctgctgcagcggtctgagccgttgctcgcctgtgctcttctgctgcggcgagcttggcgtcctgcttacgccgagtgctcgaggcgaccgaacgccgagaccgaacatcggacatggcgcgcctccggggggctgctgcgtggagagggggaagggaaaggggaaggaagagcagccggtgctgctgctgctgctggctgagagctcaaccgagcttgggaaggggtggaacagtagatgtttagcctacaggaaagtgtggctctgataccagatgttagaatttcaatggttactctcattgataagaggatggcactcaagatggggcaatttttctagttttcttccattcgcaaactcaaagccataccaacccgagggaggttggatacatatatatagccatagctggctgcaagcctattgctgcaccctcctagtctaaaattcaaaatttgaatgggatgctgtcctagagggcatccaaacttaataaagcataaaggagatataaaggagatgctaactgctgctgtcctactaactgcagctgtcctagcaactgaaaatatgcttaaggagtgatgctgtcctgaaaaaggtgaaactacccaaaagcaaaataaagaaccatgaccaaggaccacaaagacttatccatcaaaatggaacctaaggtttgttctagttccagtactgatgatccttgatggccactcccacatcctgtttcgacagtgatgagcatgtgatatcttgagattacttgtgtggtcatctctctactgccttcaagagtttgctgccatctgcttgcttatattctgatggttgggtttggattattgggtaacatcattgcacctgtttttcttggatcattggatagaccagtaatatgaaccatgcaaatcaatggtcatggcctgcctgttacataactaaaatccaaacatttccgaatccaacaaagtttaaatggtgtctatggatactccagctccaatc

SEQ ID NO: 50172 - DNA, 441 bp, Oryza sativa
gacatcggacctccagccgatgtatgctttaaccttcgaatcgatgcttatttatcatatcattatttgtcagttagtttatattagattatattgttatttcattacatcgttatcagccgattgccttcatatcattatctacattggacatatagccgattgcttaaaccctatcgctatcggctggtatcgacatcgactattatcggctatcggctggaactactccatcggcttgtcagccgatcgactgttttgatctactatttgcatatcttgtcagttgcaggaacaaactgactggcacactcgcatctcatcaagatttggacctgcacaggagctaagcagatctcccaggccagtgtgtgttttttgcatcaacacaaattggcatgcccgatgggacacattagaagtcagcaagcggtttcttca

SEQ ID NO: 50173 - DNA, 1501 bp, Oryza sativa
ccgacaaccctatcctgagtggtttgagagggttcctttgcccaatcggtttaaggtaccggacttttcgaaattttcagggcaagatagtacatcgacttgtgagcacattagccgatttttagcccagtgtggtgaagcatcggctgtggatgccttgaaggttaggttgttccagttatctttgtctggatcggcctttacttggttttcttctttaccatatggatcaattaacagttgggccgatttagaaaaacagtttcacaactatttttatagtttggttcatgagatgaaagtgtccgatctgacatcgatcaagcaaagacataatgagcctgtgcatgagtacattcagagattcagagagatgaggaataagtgctacagcttaagtttgactgatgcccagttagccgatttggcttttcagggtatgattgctccaatcagggagaaattctcatctgaggattttgacagcttgtcccatctcgcacaaaaggtgaccttgcatgaacaaaggtctgtccttatatgtatgggtcggatgatgaggatgatgattctgagatagctgtggccgaatgggtaaggagcaaaaaggttataccgtgccaatgggtaaagaacacaggaaaagaggagaggtatgactttgatatcaccaaggctgacaagatttttgacttactactccgggagaagcaaattcaacttcctactggtcacacaattccatcggctgaggaattgggcaagaaaaggtattgcaagtggcataattctgggtctcatacgactaatgattacaaggtcttcaggcaacaaatccaagaggctattgaaggaggcaaaatcaaatttgatgacactaagaggccgatgaaggttgatggcaatcattttcctgttaatatggtgcatacagctggccgaacagccgatgggggccgtgtaagaggttttcaggtaaattcgactaagattatcaacaaatatcaaaggaagtacgacaagcaacaggaaaagcattgtgaagaagatgatgatggctttaatcctcattagggctgtgagttctttagattttgttggaatgaaggcatgaggctgccatctattgaggactgtcctgggtgcagtgatgttggagagagctcgagccgatcatatagtaggggcaatcggctaaggcagatgagaattcctattcatcaaagattgggtccagtaaaccaagatcgtggataagaggacaatgaaaacatgaagactcaatggtgtccttctggtatctttatgaagaatcaaaagaaaagggttcaaagattgaggaacagagagcgcttttaggaagtcgagcaggaaatcaaccatcggatgaagaaaacaaagccgaggcaggagtggcgtgctaagaatcaagttctggtggccgatgaagccacagccgatgaagcaaaaaggttggctaaaggaaacagcgttgtaactg

SEQ ID NO: 50174 - DNA, 1501 bp, Oryza sativa
agccgccgccgccgcccgaaaccctagccgagccgcgccgccgccgctttccaattcggccgcgcctttccttctccggccgaatagattgaggggaaataatctcctcgatctcctcttccttttctcttatagaaactccggtcaatttcctttggaaataggcggattcgagtttgattctgattcgtttttccccgacctttccttctcgtcgccggcagccgtgggccttcgccgtcgcctccgagcccccttaaaaggacccccgagctctcctctacccatcgccaccctcgccttcgcctctcgtcgtccgtagagctctagcgccgtgtagcttttgcgcaaccgtcgtcgccgccgctccagccgtccttcgccattgctccagtcgtcgccatcgctcgggaagaccgccatcgtggtcgccaagtcgtcgccgtcctcgtccgccgcttcaccatcgccgaagaccgccggagaaccgtcgccgccgtagacccgatctatgccgccgcttcttcctcgtcgccggcgctgtccgttgttcctccgccgcttctttggtcaccggtgagttcgccgcgtcgccctctacccgttggtgcccttcgttcgcgtccttgtgccgtcgttcgccggtgagcttgcgccgtccgagctgccgagccgccgtcggtgctgacgtcatcgctgatgtcacccctgacgtcatcgtcgtcgtccgtccgtgagccgcggtggatccgttcgatctcggccgtccgttttggatagggttgatctcggccgtccgttcccgtgaaccgttgccgtgcacacggttcactgtgaaaccctagccgctgacgcaataatcctccttttccttttaaaaaataattcattattgcgtcataattcaattaaaatccatataagtgttttaatccgatttaatctttaaaaattcataactaattcattgtaactcagtttaatgtggttcaagttgcaaaaattatataaaataaagatctacatattaaaattatccataaattgaattaaatttatttagttctttttaaatgggctttaaatagatttaatcttgtaaaattcataataaattcatttgaagtcagaatgaggccgttcaagtctcataattcatctaaaaatatgatctacatgtttgtttactttttatgtattgtttatttggtttttattagtctttttcttcgttttgcgtgttagcttgtcgtttccgtcgttgtgaaggttcgcgagtgcgtcggaagtgttcaagaagattaattgaagaccgaatattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttaatccttgataccttgagttattat

SEQ ID NO: 50175 - DNA, 1501 bp, Oryza sativa; identical to SEQ ID NO: 50169

SEQ ID NO: 50176 - DNA, 1501 bp, Oryza sativa
aaaactacttgcgaaaagctaaggcttcttttggtttctttattttcaatagtttgttgctaaaatggttagtgatcttttctccctctttcaaaattgtagatggcagtgaacgccagcttcagttcccacggttttggtgagggtcaccacgtcgctcagcttcgtgacctcgcccgcttccttggcttctcgtgtcccgagtacatggggtactccgtggacgtgttccccctcgctgtgagctctctgtgtacctttaccctcgcggaggtatacacggagctggccttcgcccacaccacttcactgtggctaggcccaccctccagatcgcgtaccaggacctctcctggactgcgcttcgtcgcttggcccacgactacagccaccgtctcgggggctctgccttccggcagctcccacgtcttccttctggctacgcagatgccaggtacccttgtccgtacagcgagtcttagccagtgctgactcgcatggttgagctttcggaggctcaggccactcagcacgacctactccttcaggcttaccgctcccttgcccgccgctacgctactctggaggcccgtctggccgaggagggtgtcacctcagttgacactgtctcttgggactcaggccgcctctgccacgccagccacctgtcctcccacagctcccgcggctctgctcgcactcctagtggcccgcgctcccccagctcgcgtgcgccgtactcaccagtgtactccccctacccacacccagttagcccctcctacacccccggacacaccccagttgcttcctcccgccgtggcgcacgctttatccgcactgtgcggaagcgtgttgttggttcttccaccgtgttccgcttcgactacccagctcccccaccgccagcggcccgtgctgctgccggccctcgacaggttccgccggtcccttcgcgtcagccgatcgacgtttcttcgactgatgagccgactacagcaggcagccaggcaggcgaggagtagaggaggcagtcttcagcagccgtccgtgtgttaggcccttttgttccaccgccaactcttttggagtcgtggcgaggtagtgcgtgcgtgtgttgacgtgggtgttgtttggtagtctggttctcctaggtggtgtgcgtacagtcaagctcggcgtagctctgtgacttgtccacacccgttgtatcaggtgtttttatgatttgagaaaaaaatccagtttatgcctagtgcgtgctatctgagttgttatttactttgctccttgcccttctaagtgcttatctgattcttacctcgccctcttctaggagtttagatgcctagccgcccccgccgtgctgctcatgcaccagcccgcttcagttttgaggaaggtagagttgagccagaagcaaatcatgagtcagctaatgagcagtctcaccacagcatccgttcgcaccatactgcttcccgcaatgcagaagttgagc

SEQ ID NO: 50177 - DNA, 1501 bp, Oryza sativa
ggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattgccgccttctcccggtgcagaacgtcgaaggcagaggttccggagacctgctctcccgatcgccggtgcacgccggcgagcgggatagagtagtctacgagcgacggcgcagtacagagtaggaagcaaacccaagattgatttttttgtatgtcgcttgatcagggcgcccgcacgatctctactgcgcgtaaccgaaccggataagtcgcgcgtaacttatccggactccacgccgtttgcacgcaccggatctttcggaacgtttccaaaacaaaaacgaatccgaatttgcaacaaaacaaaactgcaaaaggaggctgcatctgcgcaagggtgtggagccaatttttcggaccattcgacgcgtacgtcgtgcacgcgcgccgccggcctggcccggcgaggcgagcgagcgcgcgtgtgttttccctcttctctccaccacacatgcttcaagcgactaggagggcatcctcccttttaaggaggtccccctctcctagaataagcaaggtggtactaaactccacatgcatgccatcccatgaggtgggcttttgtgattttccaaagaattaatcttcgagtggctaaggcccattcattaattccaacattttatagccccattacaggttcttactactagggtttagattatacaggggaatttacatgattacccttatgaaagggacatttacaagggtacatgatgatataggggctcatgggcccttgatgggccatctggcgatcgccggccctattgcccctaggcttgatgggccggaaaggcttcttcggccctcgcgggggcgaacttgccaaggcgaagtcgtcttccttcggcagatagtcttcgccttgcacccttcgcctgagacgcctctggcctggcaaggcactcgcacgactcttcgcctcacgccattcttgctccatagtcttcgccatgggtttcggcagatttggtcgaagggcctcatgccatccgccaacaagcccctcacgggcaagggtgagattggagcttcggccgagaccgtgcaaaccatgtggtatggtatgcggcgccccctttcgaccgatgctcctgccgaaacctacattattcttgcgaatgaagtttgttatttgtgcggctggtattattttgccgtgcttcttctcctgcgtttggttgcatattcatatatatattatacacatttttttatatattttcttttctcgggccgaaaggaacagtattgggctttcccttcgtgggctttttactgtgccgctcggacggtgggaagttaccgttttgcctacccttgcgacacgtggcgctttattactggtgggtaggcgaacggtcgcccgggt

SEQ ID NO: 50178 - DNA, 1501 bp, Oryza sativa
ttaactgggatcgatctcaacaccgagttggttgggctcgaatcgatcgtgccacactaacccatcagctcctccacattgcatcgccgcgccagcctgggcacccatatgatattttgatggacatatttcaacggctgcagctgtgcgctgcagcttggaccaccagcaaagggcgcggttgacagctcaatgcaagcacgactgaacatgggtttagattgatcctgcttagttcagcatagccccaagggcattttggtccctttactacgtgagaaagggaaaaaaacactaataggaatttgagaatggcattctagtgcgcatcctctatttgagaatggcatttttgcaaagcttaattgaggtctggaattttggcgaaacctgttttcgatgattgaataatttgaaaattttcccttgagggtaatagccctatgtcatgctcagtttgtatatacttgaacatatataatacaatatttggatggggagctcttgtctagacctaatagactatcttgctggggtcaacaatcagggtgttttcgtaaagctctcatggtcattaacgaaataaaattatatattcaaccgaaggacttcaacttctatgcaacacttgtccaacatgaatatcaaagaagacaacttctcttctctaatctgctttcttcttcatctgcttgattgctcggcaagggcgcaaggcataactagagcctaaccagcttggtcccgtggtgagcagcatcattctcatggacggatgccgggagagtgtgaggttgagactgtgctaagctgctgctattgattattgattatcagtaagggagattgaaagtaacagaagcaataactaaccattctaacagttcaccattagtcaccatctaattgtatcctagcaggcgttcctggaagtggcctgacattggcaggtgccaccacatccacggtggtcatgtctagctctgtcttgccgagcggaggaagaatatattgggggattagagagaagagagaggttgcctactttgatattcgtattggtcacatgtagcacaggggggcaaagcccttcagatgaaggaaggacttcagtcatgtataattttctattgtcattaactcaagttcttgtgagttgtttggcttgattggcttgactcacatggccttgtggcctctctatatttctatcattgtgcttccccatatttgttttgtttcataaattaatttgttcacgtcacattatatacagttgtatagcattacattttcccatagtagtgctgtcaaagttacgcgatttccctgtatccaccaatagacttcacagataacaatctaaaacaggttgtcaatactagtaccaccaaaataagcacgaaataaatatattttgataagtggaaataaatccagcaaaatgccaggttgtactttgtttctactatagctcctagtgggaacgcgttcgtccaac

SEQ ID NO: 50179 - DNA, 1501 bp, Oryza sativa
cgatagagacgccaccaattcttgagtcgatgttcctcatagccgcaccaccggcagtgaagtgcttacggctttttggcgtcaacatctatgtgttgcctgtgtcctctagtggccagccaaaacaagaatccagcccataataccaggcaccataattatggacaccccattgaagaggatcagagcgtgttggaggcgacaaatgttcctcaattgtatcgtttggttctacatcattcttagatcattgtggtttcaattattgtaattcttagtttgttatgattggttttctattggcaattattgtctttttggcagttattttagcataagaaattattttgtaccatcttcatttattaatttcttttgtttcattcccatcatgtttggggtatttgaatactttaacttccctactatccattttcttaatatataaaaagtaatcctatcattaatcatagtaattaagcaatatcgggccaattactgtattccttttttggcataatattcaacaaaatgtatggttgcttttcatatttctacattattgcaaattggatcaattcatcattgctccttatgatttaatgttgtttgatatttgtgcacacagatacaaagtgtatgactacatggtggtggcttccccaaactagataacaatatataaatctatttgaactccaacttcttgtcccgtggtacccttgcctatcccaccaagcgatgccgcttaactctttctagtaatcacgcactttctaactactacaagaacagaaccatgggtcactaccacaaaacatctaaggtttccattttacaccacctataaacatacttataaacataaaaggaaatcaactgtttataattaggggtacaacctatcgtccaaataaagaatagtcaagcgttttggtcggttccctaagaactatttcatcaatggaaaaatgaagtgtgaggtgattcaatatcaggtgaactgctggtcaagaggagtggaatgacatgtgggatcacaaatatggaatgaggcaacaacgctggatggtatggtgtgttcgccatacaaaaacgatgtctaaactgtattatatgacaaaaaaaaaacttggtctttaagaattatcataccgttgggttcattccattcaatgtcaaatggaaaattactcaatagctcatatggtttaatgccaaaaaaaaattggcaggctgttggtatttcttacgatcacagataaatccgcaagcgcacgaaacaccgttgtagtacttccccttagagtattccaaccgtatcgaacacgaggaacatgtgtgtattatctactgccaagattcgattgaaggacaacaacccaagataaattagctagagaggattcctatgtcttttagttagttacttaagttacttaaaggtaagactctaacaaatattcgggaaccggccctcccctggtctactaggataagt

SEQ ID NO: 50180 - DNA, 1501 bp, Oryza sativa
agggagattcaagtgttgaaatatttttgggagctatttttggaaatagcccttcctcgggcagagaaggctggccgaaagttccggtccttggacccagaagttctggacctttgagaggtgaaatttttcctaagtgttgtccggaacttccagtggtcaggaagttccggacccttcccagttcaaaaatgtgagtaacggctagatgacgtcacctagccgttatatatatctagatcgtccccagctcaccctttggccatttcagttttgcttttccactccatagctgttgctagcctctcccatgagcttctttgcttcctccacccaatcttgagccattcttgtaagagagtgagattttgagggtgaaggagaagagttggagaaggtttgaaggctaagattggtgtgagcacttagggtatctcgtgggctgtcatctcggtgcttattactcttggagatcttctcctagacggttaggtgtcgcccgcgagcttccttgcaattgtggatgtcccgggaaagtttgtgaaggtattcctcacctccgtaagaaaatgaggtaagtgagtaaagaaccttgtgctgaagtcctagaggttttcctagtagagctactcacacttgtggtgttttctagaaggaggttgagttggatcttggtggtcactcaattctagaaaacaacctataggtgttggggttgaaggctgtggatttcctctaaggattttgcacaagtgaggcaaggggttaatcgagctccggctctttggagcacctcaacggagagtaggattgcaagattcgaacttcgggaaaaaaaatcatctttgtccactctgtgatgtttctgtgcatgtgcatgtgattgtgctactgcagttatcctgtgattcatctcgtgaattttagctttagtccctgttagtttttcccaggtttttctattgcctggaagttccggtacaagaacaccggaagttccggattgtctgagcagaccggaaattccggtgttctacaccaggaggttccgggcctgttaaattttaccgctgcgatttgtttgtgattttcaggaaagcctattcaccctgaaagtgcatctaggacccctcatttattttggtgttaataacaacacaattagaggttcactaatgctctttgttgagatggatgcaaggataaaaaggagtggaacttgaatttacaagctttgcggcatcttttgtggtaattatcttctattccatgtatatcttgtgttcttgagtattaggatgccgtactattaagagggctaccacatgcatataattggtagaacactagtgctcaaaatcctttatttggactgttcctattttattcctgtcggactatccgatcctgataagactatccgatgctcagactatccgaaatttcttagaacttttccctctgtctttggtctgagtgttggctaaaaaatatcggacaa

SEQ ID NO: 50181 - DNA, 163 bp, Oryza sativa
agcgccctgggcatgttggatgcccccggcatgcactatgtcctgaaaacaccatagtccctggcacacccccttgatttgggcatgccacaagccctgggctcatcaccgagggctttgcctcctgccctgggctcgccctgggtttctctgtatacctagg

SEQ ID NO: 50182 - DNA, 1501 bp, Oryza sativa
cattcaagatttctagcattgtattttctatttttaggacctttcatctaggagaaatgacaaaagcagcagaatatttatggcatgacattatctctggacactagttcaaagattgttcatatatgctgcaagattctttttttttttcaaaaagaaatataagatgttagcttgacttagatgctcctttcctaatcattggctgcatcaatgactacaaggaagattcaaatgtacgaaccgtctgcaactcatagcaggcatttcgattgaaggggaataaaatctatactaatgatagatgtacaaatagacatcaagttcaagcctctgaaacaatgtcattaaactcaaacaaaagccctcctgccgaactttctgatagaaaaccatttacctccagaataatttaggtgaagacttcataaaacttctcaaccacgagcaatcctgagtcaattgattcaagtgggtccttccgaagccgatgcctcaagcagttggggataacagtggcaatgtcctctacagtgacagtgtccctgcctttgagtgctgccaacgccttggcagccctgttagtcacaatgtcccctcttaatccatcaacattcaactctgcacacactttagaaatcttaacacgaagatcatggtcaatctgcacagcaccaaggttactccgagcagatgaaatctgctgctggagcttgtcttgttcctccaagtaggactcacggaacgcctttggatccctgtcgaaccgagctctctcttcaacaattttcaccctgagttcagcatccctgacagtaccaacctgcgcgtgcatgccaaaccggtcaagcagctgtggccggagctccccttcctcggggttaccagacccaatgaggatgaaccgagcagggtgggagatggagataccctctctcttcacggtgttccatcctgacgcagcagaatccagaagcacatctactagatggtcatccaacaaattgacctcatccacataaagaatccccctgttggccttggcaagcaaaccaggctcgaacgccttgacaccatcggtgagcgccttctcaatatcaatggtgccacagactctatcctcagtggcaccaaggggaagatctaccatggtgatcttggccgtgacaacaggaagcttctcaccctccagcacgcgttcccggacctcagggcccatgacctcgggatcgtcagggtcggaattgaaagggtcgccaacaacgacggggatatccgggagcaggtcgacgagcgagcggacggtggtggatttgccggtgccacggtctcccatgatcatgacaccgccgatcttagggtcgatgacgttgagcagcaggcacagcttcatctcgtcctgccccacgatcgccgcgaacggatacaccggccgttggctctccttcgcgcccgccgccttagcctcctacgcgcatttcaccaagatgctggacatgag

SEQ ID NO: 50183 - DNA, 1501 bp, Oryza sativa
tctcttaagtctgtctaactggtacattgctcaatcaaggggcctgatgaaagatccaaaattgcagtcacactttgatgcatgaatattactacctttgtttttaaatatataatgttattgacttgtaggacatgatgcttgactgataattttattaaaaagtcctagcttttgattatatactactatgaatttgattttcgaatgaatgtaagtttaatgtatgtcatgacgtgcattggacgtgcacaattaaaaaaaaggatcgccttaaaaaagttactattgttctaccttcgtacatagattgccaaaacgtgccttgcacgtgcacgattactagtgtagagtataagtaacagtcttcagcaaaactacagttcaagtaattagcgtgtggacaaacttgaacatttgtccatagttcaaagttgtgaattttggtactacattcttatacaacttgatttagtaaattgctcgttatgctacttgtgttctgcagtacctataccctcatgaaagcagcatccgcactatgcatgtaactaactgatctaattactcaacacaaaaaggaactgtttctcgagtttattgttgggtgagataaataaacctacaatatccaggagtccttttcattaacatatttgtaaagagtttctcaagttgctgaagtttgttactatattttttaggcattacaggtgaccaataatttgataaatcaaaatgaatgcgtgcttttttttatgcatgtagaatgtcagagagacctgaactcaccttcttttcatagtttggaatgtcaagaatttctttagtaccatcaattgtcacaattacagattattttataatcttactcgatcagttatcatttgagataataatatatcattttggagaataacatttcgttgtcatgtatttttgtacaaagaaaatatgtacaagaaaaaggaaaatatgctcccatggactgatgcaccctttatcttatacccttatgtttgcacaagacgtgtttaatgttttaccaatattaaaaacatgtaagcacatagttaaagtgacattcaattcatttttctattcaatcacaacacctgggcattcagctattcttattatatgccactaagaaattgcaaaactcctcattgacccaatgacaagtgagtccaggacctccattgtacattgtttcattgaaacagtgagtaaaaatgatgatgaaaacttctagtagcacagaatgtaattccctaaaataccaacagataattactattgaagcttacttgggcaaaagatccattcaagatttctagcattgtattttctatttttaggacctttcatctaggagaaatgacaaaagcagcagaatatttatggcatgacattatctctggacactagttcaaagattgttcatatatgctgcaagattctttttttttttcaaaaagaaatataagatgttagcttg

SEQ ID NO: 50184 - DNA, 1501 bp, Oryza sativa
tttgctacacaaaggtgacactcaaaaatgagctgtacaagcatgaatgaagacatagtttcagtcaaacaaacagagcaacaaacacatacaatccctataaatcaatcctaagaccagtttgagacggacgtaaggtaccaaggcagttgttgcttccacatgaacgattccaattatttcaaaagggggaaaggaaatacatcaccattttatgtttaagtcttctgcttatctaagttttacgttcaagttatttaaatgtatgaaactatcttaaaatatgatagaatcacaacagttgctccataaagcaacacaaaatctgtttcaaaatattgaaatataaaactatgaccttgcattactatggtatatgtaaataagtacagtatatgaggcaaaaaaaaaatttaccggtgcatctaaaatggtaaatcttgtagtttctgtctcaaagtgtgctctcccaacttcaactgtcttcccctgaatagattcaaaataacacattgtaagtacaataagtgatatttgacagaattattcaagccacgacaaaaatcaaatttcatgaattagaagtatgatgacctagaagcaggattggagctggagtatccatagacaccatttaaactttgttggattcggaaatgtttggattttagttatgtaacaggcaggccatgaccattgatttgcatggttcatattactggtctatccaatgatccaagaaaaacaggtgcaatgatgttacccaataatccaaacccaaccatcagaatataagcaagcagatggcagcaaactcttgaaggcagtagagagatgaccacacaagtaatctcaagatatcacatgctcatcactgtcgaaacaggatgtgggagtggccatcaaggatcatcagtactggaactagaacaaaccttaggttccattttgatggataagtctttgtggtccttggtcatggttctttattttgcttttgggtagtttcacctttttcaggacagcatcactccttaagcatattttcagttgctaggacagctgcagttagtaggacagcagcagttagcatctcctttatatctcctttatgctttattaagtttggatgccctctaggacagcatcccattcaaattttgaattttagactaggagggtgcagcaataggcttgcagccagctatggctatatatatgtatccaacctccctcgggttggtatggctttgagtttgcgaatggaagaaaactagaaaaattgccccatcttgagtgccatcctcttatcaatgagagtaaccattgaaattctaacatctggtatcagagccacactttcctgtaggctaaacatctactgttccaccccttcccaagctcggttgagctctcagccagcagcagcagcagcaccggctgctcttccttcccctttcccttccccctctccacgcagcagccccccggaggcgcgcca

SEQ ID NO: 50185 - DNA, 1501 bp, Oryza sativa
tgtgaaccacattcatgggaccacatgtcacctaagtgattgatgaatgagagattgcctgataataagaacctcactcttactgttggaaacttgggagttttataacaagaacaaaaataactttacatacttattgatgttttccttcctaccaacatcatatgtcagatcacattgataaaccttatacatataccacttgccatcattttgagttttgttagattcctttcatattttcacgaccaaagtcctgtgtacttatccaccaaaatatattgctctccctctatactggaggacttgcaacatatgccatccacctaccagatgctaaacttctacaccggaagtcggcatccaccatatctatccaccaaataaagacttcacatgactatgtttctccatcctcctatccatgctaaatgagacatgagctaaaaaaatgatcagtttttagaaaatcaaaatgctcaaaagagaattggccaatattctcgagcatgatgaaaaaaagaggatatagaaaatagccatgttctccaaataaagtatacacaggagaatcatataaaatgagtcataattccatttcacatcatccatctccctattccattccatccacatataagtgcataactttggtcatgttcatatgattggttatcttcttggatcctcaatttgactttataatatatctaatgcaagtctgtcatttcttactccctacccttagctccacagaagcctttagaaggtaggataagaaaaggcaatgtgaattccttggttaggaataaaaactttgagtgatttgagagaatcaattggggagtatagtacaagttatgtttttatgaacttcaaagaaaactacaatgtaatttatcggaaggagtaaaggccattccattcttcaatcagccaagatgacatagtagacacatcatgttcacaagtacagcttggaataacctatatgttgtgtcattaagcagaagtcattaccacattgatccatgagctttactcagggacgattaaagcataagcgtgggggtgttgttgacagtcgttaagtataaactttaaccgtcaactcatacataaaagatatcaaatataacatcaaaatttagtggtagggtttcactactaaccttttcaactagtcttggtaaaaatatttatgcaggtaattttgagagaaaataaacctgccatgcgacaaaatgaacctctggccaatcacacgcgagtaaaaggattggagggcccacgtgacaatggaaacaaacctaaagtggggccaaacgaacctctaccaccataggggcccacatgttagtccgaaagacggtcgagagaggcagtgccaagggttcggtcgaacctcaaacggtgcccctcatctccaccctccacgtgtggctttctagttggctcccaatgacggttgcgggagttaccgacctccccaaccatcata

SEQ ID NO: 50186 - DNA, 1501 bp, Oryza sativa
gcaaaatctccaacacatgcagttaaaaaaaatcaatatccagcgggtcaaaaaattaagcatgagcccatagcagcattggtcaaagtgtctagaggacatatgtcagtcaagaatgtgatctcataattgaaaaggttaattctaggtaaatggaaatgggaggtagaagattatggtgataactcttttcgcactattttttcttctactgctgaattaaaacgcatggtagaattgggtatagtgcatactaaggtgggagagactaaaatgtagattgtggaaagaggggttgagaatgaggttaagtatgttattccaaaagtgcctctacttcacgggcctcatctccaccgttaactacttgtgcatcgcttgcactgatttgttcgccgccgccgactggtgatctcacctctatacggaccacatcattcttctccaacgagcaactatgactgcaacagaaggacaagcaaaatgctctaagcttaccagctcaagcacgtggatcataccttcaatctggacttgttttggataaacgcaagtaatcaatcgagaagccttcgcatcgaagattgaagcactcagtagtcagtataggttatgaatcacggagaagactgcaactcgattatcaaggtctcaggggctactgtggaggagaagactgcaactcgattatcaaggtctcaggggctactgtggagaatatggatactaggtactcatacaacctccatattcgattagagataggtgataggccagatccatgtattatatagagtaggactcggttgcaatgttaccatgtgttctatggcaggacctagagtaccgagtgaggattatcatataatagattagcaaactaataccaaatccgattaggtttttcgattctctttgtaaccctatcccctacctatataaggtggatagggagccctccaagaacatatagcgagataagcactatcaaatcgttagatcaatatacaaccgatggatactatcggacttcctcaatcatgagtaaggtattacctctcatcgaaagtgtttggatctgattaaattattgtctttacatccatttaattttaggtctgccgatttccaaaatctataataataattgtgactgctgcactatacggaggctactgagatgggaaagtgttagtcacattgcctgcctatgtcgaataggatagtcatatttatacatttttttgccattcaagaatcatttgatttttcttactaatccattgtcatcagatgttgaacgggggcatagcctcaacttgcaattttttgaaaagaaaaaagaaacagcaagctttactggaagtgaagtgcaaacctttggaaaaaaaaaagctgcaactttcctgttttaaattgtgatatattttgctatcgccgcctactgtatgaatctaagggagtggcgttctgtcgaccgtctgcgagcgaatggccacgg

SEQ ID NO: 50187 - DNA, 1501 bp, Oryza sativa
aagacaacgtgatagggagaggtatgcttccctcactgtatttattcatatcgtgcctagagttcagttcacaggaggtataaataatggaaaaagaaggttgaccgatctgattgaagttgatgcttgattctaaatgggatatgtttactgtgctctccagttcctcacaatttttaagcagcaatatgatagtatgctgtcatttctatttaagtaaaaaaaattgattactacctcgaaccacttgctttctagccttaatatggaccattatatctgcagtatatattagtgttagtttgacacctcaatcatattatggcctatggaacctgatttttggacttattgtgaatgtctcttgtggagatgacatatttcacaatctgtaataggtacagatatgtactgcaaaacttccataaaagcatcttcccaaatcccaacatatctttttctctgcagaacaatttagggcctgttttgatcccctagcaaaatttttcaccctgtaacatcaaatgtttggaaacatgcatggagtattaaatataggcaaagaaaataattacacaaatcacgtgtaaattgcgagacaaatcgtttagaccatggaactttaattttagttgttacctgaaaacttaattggtagtgtttacatcattacagaaatttgggttcaaaaatcttttgtgaattattgtttctttccaatgttacagtaagaataattattccatttgatatatgtcgacgtggcttgcacctacacactaaatagtttatgtacttattttaattattttcctcaaggaaaagtagtaagccactgacagctgtggtcggggtcaactattgacagccacggtggccagcgggcccacacatcagcgacacaaatcctaaacatggtttatttgctattcttaattacttaggacccacatgtcagtgtaatagtcttaatgaattgattaacttaattaccttcattagtcgctaatcaaggaggaccacatgccatacaaaggagagggatagggatttatgtcacgacacctgacatgcctggagatacataacaggaggtcgagccgaacatgcatatgaatgctaatccatcgatgctgcgcaagtctactcgggagagtaggcctaatagtaggtattattcaagtgaatggacccagtcgaaatgggttgggccatgtgtgagggagtgaggtccatggcgcgatgctataagagaccgatagggagttgagacagaatcgaacattgtagaaacatattctgaatactgaattcaaatctctccctgttctatgttgttcttccccaaatcccaaattccttgctacttctaccctcaattctgttcaattcttccttgttgcgacattgcaaatccagtgtcgtgacaaattggtatcagagcagtcaatcctggagaagccgcgctacacttcacggttgcaattgcaagtagtagcaa

SEQ ID NO: 50188 - DNA, 790 bp, Oryza sativa
ataaagttttctccccttatgttcaagcactaaatctaccatttttctgcaggcatgtatgatctccttgccaacaatgttgggctcaagtaggtgggaactttttctcactctcaatactgaactgcttccagtaggaaccgtactcttgagtgtcaaaaatactctgtccttcgaaatgttttctatcttcctgttgagacttctaatcttcacagcaacctcatgacgtgcctgaacattagaaaagcaagtggaaattgacaggccagtgcaagcaattgacttccttgatgacgatgaaggatgatcagttagtagaatgctccccttaaatctagccaagtcaataatatcatcaacatcataatatcatatagaacttctcttagctgaccaagccaattgtcaactgctgactcttccatcctccttgcctcagcatcacagccatcactaatacaacaatgtatgagttcagtcttccgctgcaactctgcgagctcttcttgtatccctagaataagtatcacctcttcagtaataatctctttcaacttattggcacatgatccaaccaaagaatctaatatggttgccataggaaaaatcagcaagggagatccacttttaacgtttcagaaagtgacagcattgtaggttggcaaggaatgcacgatatctgttagcatgatctgaaaaatatataatgttcactaaaacttttgtattgataaaatagacatccatgggtataactactgaattgccatttatattaatacaataa

SEQ ID NO: 50189 - DNA, 1501 bp, Oryza sativa
ccgtcttctcctctctgccactgcataatctaggtccagtatatcaccaggaacgtgctcatcgtcttccttgcagccggtgatgctgtggctgtacgcacctaaggcctctggggactggggtgagtctttcttctttgccatatggacttaatatatcttctgctttcccttgttcaattcctgcttcctgtcatggttggagtcgatcgagacgttggctcactcagtcatcttcttcttgtactccagcagaagacgttgatccggctcatttcagcctcacacccagcaacacttcgccttccatgcttaagcaaaacctctcaacttgttgcccatttcttcttcgtcgttgcccgttgacccaagaagctgtctaaaggtaatcccattgttctagttctttcagatttaatatgttctagttctagttcttaccatccacatgatgccctcgccaagtcaccatgatatcatcatccaagatgaattggaactttgcacaccaaccaaataggggtagagggatcactgcactatatgaaatttacagcggttagtatcgaatatgattttatgaaataattgccttcttccgttcattttagtatgttagactgtgtattgtttgctgttaattagttagtcttattctcaccagtcctatatacaattatgtaattgtaaaagataaaccattctttagttgtagtcccatattaagagtagatacactacactacacagaaaaaaaacatacttctatgaatacctcacatgataagaatgtaatacttttagtgttggttatgtacctcatactgtgcatgatttgtccctagaactttagtttaagtatgataagctaattattgtattaatataaatggcaattcagtagttatacccatggatgtctattttatcaatacaaaagttttagtgaacattatatatttttcagatcatgctaacagatatcgtgcattccttgccaacctacaatgctgtcactttctgaaacgttaaaagtggatctcccttgctgatttttcctatggcaaccatattagattctttggttggatcatgtgccaataagttgaaagagattattactgaagaggtgatacttattctagggatacaagaagagctcgcagagttgcagcggaagactgaactcatacattgttgtattagtgatggctgtgatgctgaggcaaggaggatggaagagtcagcagttgacaattggcttggtcagctaagagaagttctatatgatattatgatgttgatgatattattgacttggctagatttaaggggagcattctactaactgatcatccttcatcgtcatcaaggaagtcaattgcttgcactggcctgtcaatttccacttgcttttctaatgttcaggcacgtcatgaggttgctgtgaagattagaagtctcaacaggaagatagaaaacatttcgaaggacagagtat

SEQ ID NO: 50190 - DNA, 1091 bp, Oryza sativa
atgttgttcttataaaccgggacttaaaaatcttttttgtccaaccggaactattgtagatttgggtcgaccaaccaaagatggtttctccaccagtgtgtgatggcttataagcgtttatagaaagtttaaatggcatttcgtatataagagataacgtcgatcccagttggaagaagaagtacgcgcgtagacacaaatatgagagatattgaactatatgccactcttagatgtggcaattaactatttgccactggactcacatgtcataaacacatgtggacccacatgtcactgagataggtgtggcaaatagttaattgataaatctaaaagtggcaaccccaaatatgaagtagatgcgccaagcagtttattgcaagcttgtaacggacatcctgacacctgactagttatagaccacatgagcagaagaagataatgcttcaagctttcctctacttcaatttgctagtaccaggctagtttctgtagagcaagctcctcaccacacgctatgttttgttgcactcctacgagttatcaaatcttggtcatatactcgtatatatcgcaatctggcttgcatgctttacttactttggtgcacatgcatgcagattctgtaaaaaaaaaatgaagtacatgttttttataggcaaatttgatgcttgggcatatatatggagtatatatttatcatcaattcccgctgtcactagctagaacggccgctagttcatcacacaaaaattaaattccatcagtctattttaatttatgacgccgttgatttttcgacaaatgtttgacctttcgtcttatttaaaaaaattatataattataatttattttattgcaacttgatttatcatcaaatattctttaagcatgacataagtatttttatatttgcataaaaattttgaataagatgagtagtcaaatattggtaaaaagtaaacggtgtcatatattataatgcggagggagtatataggcgtggaagcaagctgctttgcttgctaccaatggttgattgcaacatatatatgtagtggctgcagctgccgtcgcttaattagaa

SEQ ID NO: 50191 - DNA, 1501 bp, Oryza sativa
gcagctggtggcgttcgagaaggtgcacgtgggcgccggcgggacggcgagggtggagatgggcatcgacgtgtgcgacgggctcagcgtcgccgaccggaacggggtccgaaggatccccgtcggcgagcaccgcctcatcatcggcgagctcacgcacaccgtcaccatcgccctcgagcagctaggggtatagaaagaaagccactctcatcaattaaaagcataggattattcaacaagatttggaattgtatcttttgggtgttgatgatgatttgtggattgttattgttggtgccactgccactgtctctacaaaggtagagagagcaattggaaaggcatcacattgctattggaaatttggaattgatcaagtattcaggttcaaacaattgaactgaagaaatacataagatcattcattacttgttcttcttctgttgtccaaaatacactccatttttacagttgattttggcagatggactacctgcattgtaagtactgtgatctgtaatgttatccaaagtactgcaggtctgacctcatgttctactgcgaacagggtcagttcttttgctagtgctgttcactgtttatacttgtcgtactccaaatcttgtgcagttctgaatctttgatttcttctgtttggtccaaaaccgtgtgttgctcttttttctaggcccaactgcccacaggtttctggtagaaatttttctaagtgactagttcagcgcaaagtttggattttggttgaaattggagatgatgtgactgaaaagttgtgtgtgtatgacatgttgatgtgatggaaaaggactgaagtttggatccaaacacagcctaaagcccatagcccataggtttgtttggtcatgacaaaacagacaaacaaatgaggttcaactgagcaaattcctgcctaatacagtgttcattcaactcatcatttctaaaaggagtttaaaaaggtcaagccttctgtcacatgtaacacaagttctcctacgctgactcctctcttggaacttcagacttcagagaattgccattgagtagaaatagtactgtacaagtaaagctctgtttctttgttgttaatttgtgtggattatgagaatcaatcaattaacttaaattgcttcctataaaattaatgaggaaatattataacttaatgcgttctagataagcttccagaactttccttgcaagcaagcactagtactccattgactagtctttcatttcacactctgtgcttaagttgagttcaatttcatttccaatcacacagatttgctctcttcttcttcttcctccattcaatctctcggaatccgaaccctagcctggtagggtgggggcacgatggggtgggcggcgcggttcctcacggcagtgtccttcctcgccgccggcgtgctcttcgcgccggacgctctcctcggtggctccggccgctccggcgccggggtcgcggcggcgaggc

SEQ ID NO: 50192 - DNA, 476 bp, Oryza sativa
ctccgcccccattgtggatccgcccctagtttccaatgaaaaggagattgattgtgaaatttgactaatcttttcaaaaaggagattaaagtcttgtttgaatctaacgaagataaaaaaatgatggtacgtaaaatgataaagtcattaacacaagattacttaagttttaatttattacaaacttaaaaaatgtatatgtctgatattttaaaacaaaagacgcgaatattatggaatgatctaatatcaaataattagaagggttgagacttcaaacccagatcatttaggccaccacctgcgaagatagaagacccctaaacgtttctctaatattttaaaataacatcagcataaaaaattccgtacaaaatacatcgtttagcaatttaaaaagcatactaatagaaatcgagaaaaaaatatgtatcttaatcaagttaatttggaatttggtttgttgtgtgttcctg

SEQ ID NO: 50193 - DNA, 1501 bp, Oryza sativa
ttcatcaagtcgtgtagatggttaaaccatcaagatttcgcctattttctttgatcatttttctccgacaagcttcccaccattccataatgtccccattggaaagggatgtcgtgggcatatgaaggcctagttttgaccaaattttgctccatacctatctagcgaacgggcaatccatgaagaggtgtctggctgtctccggctcaactccacaaagggagcaaattgggctattgtcccaaccctggagctggagcttatcggaggttaggattttcctttggaccattagccaaccgaaaaattttcacttggttttccatctttgctttccagatgtagttgaacctctcctcctgtatgctccccaggaattggatccggtaagccgagtttgctgagtagatgccaattgggatccatctccaagttactatggtatccgtttgctcctctagatgtacctgttggattaggtgccaaagaagaatgaactctctgacctgggtggttgtgttcatcctcttcatcagtctcaaccaacagttgtcttgtaactcctgtcctatgccactgtcctatttttccttgtcacgagctgaaaaagagatggagtcaattccttgggcgattgcccttccagccatctgtcatgccaaatttaacttttccccatttgttaaccgatagtaaatttaatatgtttttgtcatttgtagataactaaatgcccatgctttgctatggctaaaaggaaaaaaataataatattgttgcctaaaataaaaaaatatttttcatgaaatattttacccaccttttagatttagttactacatctgtttcatattataagttattttgattttttttcttagccaaacttctttaagcttgaacaagcttataaaaaaatatagcaataattttaacacaacacaacttatttttaatgaaactaattcggttttgttgatgtattttttctataatcttgatcaaacttaaagaagccttactaaagaaagacaaaataacttataatatgaaacaaatggagtatgtcatgttgaaaagtataaggggtaacatataaaaaccagaatggagtagtgtcactagaattttttgaattggagtatagataatgagacacaaacttttatacggattaagttctttggaataattgttgaaatagattttttctaaaaaaagagaatctcatgggatattaggaaacaatacaaatttaaatattttttaactcgtggtatgggagtatgagacaatgcttgctgcaccacgatatctttttcataaaacttgattgttttgaggaaaaagaagttcaatagataaagtaaaaacggggccttgtagcagaagttcttctggtggcaaaagcgggctttcgggacttgtgctgtggatactgttgtgggctttgggatttcatgcggacttgagtccaaatccagtccgccaatcgcatcca

SEQ ID NO: 50194 - DNA, 1501 bp, Oryza sativa
ataaacggaaactaacttttaaccgatccaatctaatctacttgtccccttccttattcctcgcatgcaaaaacagaagctctcgatcactgcaaagacctagacgtctaggcaaaccttacatgcaattcccaaatggaccgatggaaatttctaaaaactaccaaaatcgaacccccggtggtgagacgagcccctttttgcaggtcccgacgacaacaaactcacggcggcggtgacaacagtggtactaaacgtgaccataactcgaaacttcaaactaactagacgctaaaaccagtaacacgactcgacgatgcaacgcaaaactcaacaaagtaaaaacttaaaagaccaatgcagcgggcacaaagatggctaggtaatggatgcaatattttctatggctattttctaatgggtgcaatattttctggctattttctattggtccgatctttcgatgagttgatgataactacgatttaggtgaaacgttgacgacccgactacaatcgtatgagatgttgtggtgttccgccttagcgatcaatacagccctccatgggttgttgatcttgccggtgcagatcaaccttattcctgcaaaaaaaaagtgaagaaacaagcagaacaagataaaaacaatctaaattgcaaataggaattgaacacaaatgataagttcggattccgtaactagcaaaacgacgatctaatcgaccagtggatcacacggcaaagttgcgaagcgaaactttaatctaaacaaaacccaagaaaccctgaagggatacctagctatttaaggaggtgggaggacgatcaaggggtctccagagtcgagctccacctggttggggcgcaccccacatgggccggggtcccaaataaagttacaagttcatacgcccattataagtgacgtaacaccttgtttatacgattacagctgactgagatagaatttggagatgtggctggatccattggaaagaggactccgagagcttttcatcaagtactcgcggcccgaaaacggagtggccgtttgaagtcagcgtagtaggtggccgaatcagattccagcacttagatgacttgatcgtgatgaattcttgttgatccatgatgtgagcaatggttatatcaatagcaaccatggtcacgtcatacacgtatatatacatatatatatgtactgttgcattgcgtaagtagcatatacttctaagaagcagttagcaagaaaagaaagagtagtagtatctgataacttatagtatatgctaattggaatattagcaatattgttaagggtgaatagccagtccagtctacaacttttgttcagatgtcaattcgtctttgatgttttgtaatgtccaaacttatcatgcggcttaatatagtccttggaaccacttaaattgcgatgtggcatgtccacatcattcatgcatgtcaagttaacatttcaatgtccattttaaccttacat

SEQ ID NO: 50195 - DNA, 1501 bp, Oryza sativa
cctcgccacggtcgtcatcgccttcttcaccaacctcagcatcctctccaacctcccgcaccgggcggcggctgcatccagttcctccccgccgccgctacctagctcctttcccggcgggtgccggccatgccccgctcctcccccgctggccgtcggccgtgcccaccacctccccagccggccatcggtcgtgcccagctgctaccccgccgcccacgcgcgctgcaccatgcccaactgctctccgtcaatgtcgcccgtggaaagtggatgagaggtagagaggtggagaggagaggggaagaagaggctgatatgtgggatccacgtgggtccgacgctgagtcagctgccacatcggacaaaaccggagtcaaaactgccaagggacataatttacactggttttgtaagttgggggatgtgttgtatccggttttgcggtttaaggatgattttataattcgatgacaagttaagggaccttcggtgtactttttccaaaaaaaaaatagaaaccacaaaatgaactacttagaaaggaaatgggatttgggataaaaaaggaaaggggcctcgtcacacgagcggggcgcatctgactccgctcgcgcggtcgcgtcatagcctttctgccttctacaatctaaatctctttcacacacgtgtgtgcttgtgtctccttcagacatctttatgcaaaaatccattttttttagacggcccgcttaaattatttgcacgcaaaagtaagggtttttacgcatgcagtgctcttaactcacccgcatgcaaaaataccccaaagattcccactctcattttactgaatctccactcctctctctctcccataactctctccctgcactctttctctctctccccactaccccactcccccacttctccccactccgacggcgacagtggcgattgcggcgggacaacgaggaagggtagaggaggcgtgcgacggcgcagatctgatggcggccatcatctgctggccgtcgcccacgcggatccgacggcggctgcactcctcacgtgcggcagccacggatctggcagtggtgaggcatgatggtgggaaggcgcggcggcagatctggtggtggggatgtgttggtatttcttaacgatattactagaaatattcatttcccagcaatggcacggaaatagttctagtatatttatggttatagaagtaatccgcaagtgcacggatataccactattagcatttcaccttgaactattccaaggtatcgtatttatttaatcccaagggaagatgtgaaagagaaaaccatgctaataattatacacatatatattacttgccttcatcaaagtctaagaaggggttaatttaatatatgtgtagagtgacacgaagcgaagcttttagattccctcaaataaataatcctaagctaagtagaagaagaaatagaaagaactcaactcctatacttctaatatacaccct

SEQ ID NO: 50196 - DNA, 1501 bp, Oryza sativa
tgtacagcatgtacgtttgtacgtacgtatcatcccaccgtacttctttttctatttttttctttcttatttagattagatgaaaaacgaaaataaataattcaagtccattcacaaccattgattttccataaaacatggtggactaattagatttttgttattaaaaaattgaaaggtccacgtgtgccacgtcctctcttccatcatgtacgtccgtacttagtacatacatgtatatatcggtccctctacccattcggttccctctctctatgatgtattattagcaatcaaatcgtattcacaatggttgtgtagagcctcacacactatatactacatccgtcccataaaaattaaatttttaccttcgaaccttttcccataaaagttatatttctgctaatgtgggacccagtaaactgattatatttccttgtaatcttctttctttccatctcatctctaacctattctctttaacattccttttaatcaagtttatacatggaatgtgtatatgtactgtgttcattaaatagggttattgaagtcatttgtctatcgtcctaatatgtccttaattccctagaaattcaatttttatgggacggaggtagtatgaaatgttcccaaatgaattatctatcatataatgcaaatattttggagtatacaaacccatcaatttaccatagccttatgtcccatataatctatttattaataaataatgagaatctataccaatcttacttgcttattgatagtttttttttaaaaaaaaagttgcacatagggtgtaatgatgtcactatttgtcatatcatgcatttgaacttaaaataatatttgtataaaataaaacaaaagtgtaaaatgaaccaattctagaaaaccttataatttcttagaaccattgtggttcataactttcccttaaattgagacaaccatgcataaccacttcatcattttaagtgactacatatcaatagacttctctctgttctatgccatagcagaagatagttggctttgaatattatatttcttactattaaatttgggttttaacactcgggtttgactaaatgtatttaaacaaatatatagatcacacatattataggaagcgaggtctagaatatatctactctatatttttattgattcatacataagtacgtataacaaattgcatcaaatgtgaaccaattaaaagaaggaataaaacacatttattataaataacctttttgagattttttttaaataagagcccaaaacatttaattaaaaagaaaaacaacaccttactttaatttggatttaaagacccacgtcttcttaaatgatgaagatgattaactttatagataggtgcttatatagataaatcaaatattacatattgtaaactaacaaatatcttaaaagaaacatttaagctatgattcaggaatgcccgcgcgaatgcgcgggctaccatcctagt

SEQ ID NO: 50197 - DNA, 1501 bp, Oryza sativa
caagtaggaatacaatttagaaataactgaaatttagaattaaaaataattaatatttgaagaagagttcttatagaactgaatacaagaataattaaaattagaaataaaaaaataaaataaatttcgaaaatagaaaaataaatataagagttcaagtaggaatacactttataaataaaaaatatcagaataaaaaatatggaatttttaaaaattaatcaacctagaactcaacgatgacaaataacaataaataagggacaagtaataggcccgtaaaacagtaagatggtgaacggttgatgagaaatctaaaaattataaacaaaaccaccaatagaacccccaaggacgattaagaggtggtacgacagatagaatgttaagcagcatagacacgatggttggcgggacttttataaagtaaaaaataaatcgcaataacaatcatgttttatttttaaaatcttaatgataataaacaggggaggcaatgggtaggccatacaggagtataatagtgtggagccggcggcggttggcgggacttctagaaatttaaaaaatgagtacttaaaattcgaaataaaaaataaaaaaatttaaaaatagaaaaataattctaagagttcaagtaggaatacactttacaaataacaaaatatcggaatgaaaaatatggaattttttttaaaaaatagtccatctagaactaagcaatgacagataacaataaagaggagagaaatattaggcccataaaggagtaagttggtggcagttgatgcgacatctaaaaactataaacaaaaccacaaatagaatctcaatgatgattaagaggggggacgatagacaagccgttaagcaacacggtcacgatggttggtgggacttctagaaagtaaaaaagtaaatcgcaatgacaatcatgttcgattttgaaaatctcaatgataataaaaatacattagtatagtatggcgaagccggcggcggttgggcagatttctagaaaataaaagatgaaccccaacgatagttatgttcaatttttaaaatcccaacaacaataaatatgggagacaacaggttgatcatgaagaaatacaatattgatgtttgacaacattcctaaaaattataataattgaacctgacgagacaatgaactctaaaaactagaaggtgtattttttagtggtttaaaggaagataaataaaagccgtgatatattgggtaaacaaataaagggttgataaaagagtaagaattaaggactggtgttacttttaaataaaaactataaaagattaaggatgataagattcgatcttttaaggttataagacaacgtaatggctatttaacaaattttaagtaatgacaaatatagaaaaatagataattttatatgggtgctagccgcgcaattgcacgggtcacccagctagttagtaataaaaatacaacttattcttttaaaggagtgagagt

SEQ ID NO: 50198 - DNA, 1501 bp, Oryza sativa
taagaattaaggactggtgttacttttaaataaaaactataaaagattaaggatgataagattcgatcttttaaggttataagacaacgtaatggctatttaacaaattttaagtaatgacaaatatagaaaaatagataattttatatgggtgctagccgcgcaattgcacgggtcacccagctagttagtaataaaaatacaacttattcttttaaaggagtgagagtatatatatatatatatatatatatatatatatatatatatatatatatatatatatatatatatatatatatatatatatgtatatatatatatgtatatgtatatatatatatatatatatgtatgtatgtatgtatgtatgtatgtatgtatgtatgtatgtatgtatgtatgtatgtatatgtgtgtgtttgtgtgtctaaatatatgacggccgttttgtacttccgggagtacgtattcttattatcatccgattgaggttttgatcttattaaggaaacatatactccctccatcccataatataagggattttgagtttttgcttgtactgtttgaccactcgtcttattcaaaaattttggaattattatttatttttttgtgacttactttattatccaaagtactttaagcataactttttgtttttcatatttgcacaaatttttagaataagatgagtggtcaaataatgtaaacaaaaacttaaaatcccttatattatgggacggaggaagtataatttaccgttgcgtgcatgcacacctgattccggattcattgcagcgattcgttgcagcggcatgtgattcaattcaacttattaaatgttaaccataggatgaataaccaacatgatccttgaactttcgcttaaggattaatttagtccttgatattttgtattgtccaaacaagtccctaaagtccattgtatgatttaatatagtccttaaaccctctaaaaatgccatgtgtacatgccacatcatctatgcaagcatattgaatatttaaatatccattctacccttacgttttcatagaaaataaagaacaactattgagaaaaaaacaaaaaaaaggttttggcaattggtaaaaagatgtagcattggtaacaaaaagaatttggcattttcctttgttttatgatggcttcttcttgtttttccctttgtttttttataaaaaatgtaaggttaaaatggacattgaaatgttaacttgacatgcatgaatgatgtggacatgccacatcgcaatttaagtggttccaaggactatattaagccgcatgataagtttggacattacaaaacatcaaagacgaattgacatctgaacaaaagttgtagactggactggctattcacccttaacaatattgctaatattccaattagcatatactataagttatcagatactactactctttcttttcttgctaactgcttcttagaagtatatgctacttacg

SEQ ID NO: 50199 - DNA, 1501 bp, Oryza sativa
aaggtctattagtaggaattaagtactctctcaggagcctcaccatttgcattctaacaaacctaacgttttgacaaagaccattgcgtttccatggtgttactagaacaattgcttcagcgctagtgtgcaggaaatcaattaccatttagtgatgattggggatatgaataagaaaaggagtagccatagctaactatacggttcatgaatatacacaaaatgttgggttgtgcagcatagacaagtggacaattacttaaaatttggtcagtgatagtaacatgggaaagataaaagaaaagaagagtggttcagcagttgtctagctagtctgaatgttcagctatacaatatatgtaaggccttaccaccttgcctaaatcactccctagcctcctgcagtactgttgctttgttccactgtgtcgcattcttacactgcatttctaccggctgtgggtaagctcaatacatatagctgaatttacttcctttatttccttaagttaatccgtaaatgctcatcttgactgcagggcacggattttcaacaggatcagttgcgtccatttctgtctgctttctgattgattgagatgagatctactaggaaggaaaaatctgcttcatctgagtaatcccatatatactgctcttcttgaagcactccttgatcggtgaatgtcaacacatcaaccagtatttctggtactctcccgttgattcttctagttaaccttctgaatcatttcagttgtacatatataatacacacttcacttttcttctgtcccctttttgcagttgtagcagtgcagtctgcggttctctcttgatgactggctcataatgttctgaaatctattctatactctggcttattcaatcagattcctttggtcttgattaatctcagtttattgagatcttaagcacaagatgggaccgagcaacctgttaacctgtgcaagatggttgctactatactactgatccttgttatgtaccatatgttatttttgtgctgaatgatcgctctgtaaggtaagatttgcatcccggcgaaaacgaaaaaagatttgcatgtgtacttcaagtttcgaatgcatcattctgtgatctttttttgggatgcagctagtagagtagtaggtagggaggtgtatccgccatgcaacttttaggttttcatgtgtgaagctacctaaataatatagaccctgtttggatgcttgggctgtggttacataaccataaatgtcaattttgctagccattagactcaacatgcacggtacaccgaattaagtggaaactcttatacaaagaatagatggataatatatttactgaacttcatcttgcattcatattttgtcagccttatctaacttttaaactatgttaacaaagtttggttacatgtcaggctgcattttttacattgatcaattatatatggtggattaccccttttgagtttgtcggatggcaacaa

SEQ ID NO: 50200 - DNA, 1501 bp, Oryza sativa; identical to SEQ ID NO: 23462

SEQ ID NO: 50201 - DNA, 275 bp, Oryza sativa
ctgcttttctaatattcgtatacgtcatgaagttgctgtaaaaattagaagcctgaacaaaaagatcgataacatttcaaaggatgaggtatttttaaaactcaaccgcagacatcataatggaagtggttcagcatggacaccaatagaaagctccagcctagttgaacccaaccttgtgggcaaggaggtcatacgtgcttgcagagaagtggtggatttggtgcttgcacacaagaaaaagaatgtttacaagcttgctattgttggaacag

SEQ ID NO: 50202 - DNA, 1501 bp, Oryza sativa; identical to SEQ ID NO: 23460

SEQ ID NO: 50203 - DNA, 1501 bp, Oryza sativa
agaaaaccatttgtttcttctgtttcttcttgagattgtacctcctatctaacaaattgatgttaaccaagtcccgcagcaacgcgcggggcatcctctagttctatttatatgggtgggtatttaaccctcttaccgggtaaacattatgtagtggttatgtatttttattcgcccgtgaaattaacgttagggggcatgtgaaattgatttctctagtagtgtctgatgtattaattactaactcagcatcatgtttacattttcgagggcagggcataagcaagcactctgtagacactggttagctcttccaaagaaatatacatgccaccttaattgacagcttttttttttaattctcttgctttccattcaacagtttggcagtcccctgacgatggatgtgtaccgtagagtcagcaatatatattaatttaagtgattcgatcaatccgatccgctggatcaccgatccgatatgcatgtgtaccacggtgacgaactaattaatctttatatgtttagcactccctgatggaggagcactaatgcatgcgtcgatcatgcatagggatggcaatcgggcgcgacaggcacgggtagtgcctacccatacccatgcccgtgagattatttttgcccgtgggtatacccattactacatgacgggtaaggatggttgtccatgcccattgcccgcgggcaccttatgcccgtgggcgtgcctgtttacccgccacaacaaaagcagtggaacaaaaagtctacaagctactaagttcgaatcgaacttaaaacatcaaatattctccgcctcggtgtcgtgtctctcctctggcggcgatagagtaagaggagagaaataataagggaaataaaagagaaaccgtagaaaacaaagaacgtggcttatgtattctagtggattttgctcctaacctacatgtaagttagattttgcgggtaaacgggcaaagcgggcatgggtagtgattacccatacccatgcccatttatccatcgggcatagcttttgacccaataagatacccatgggtataaaatagagaacaaacccaaccctaatagggtttttacccgtgggtaaacgggcaaacgggcacaattgccatccctaatcatgcatatgccactcgaacatataagctagtggggttgggggtgtgccagcgttatactggccttttgaggcgacatggcatcattagcgtcacgagtggtgagtgcaggtgaaaaagcaagtcaaagaagcttttatgtggtcgatcatgtacaaaaaacttgctcacggctctgctaccagcttatacgagcaggggtgattgatattttgatgagtggaagataactacggtttagaaaaaaaaaaaaaccttgagctaaaatcgtacaatacgtggtcatgtttttccatagcttattgatattattatgtagatcaaccttattcctctaaacaaatcaaacaaataaacca

SEQ ID NO: 50204 - DNA, 1501 bp, Oryza sativa
aaatcatcatgcaataacccatcccacacaagttaagaatttagagtctagccaagtgtaatacacgtcccggtgctcaataaccgcgaacacggctattcgaatagatttggtttactcacactgcggtggatgtacactttaccagcactccgcgactgcccaacacatgagcctcatcccaacacatgagatgcgtcacggcaaagccttttgataacctcgcattggcagtacccgctccatgaactttacatcctcatgcactctaggcgtaatacgatttctagcagtgagaggagttctggcgcacccgggaagggaagactcacacatgcattaagttataattatgtttaaattctcacatggcagtcctaccaatggcgacaccactgtagacacccgcctcgtggtcctaccaatggctgccccaccgtagagcccctgcctcacacatcaagaaaccactatgcatggatattgcctccgctcagctatctactccgctaggtctatacccatacgagaagtgcggttgtaggggggtcgtttcatgcttaacttcatggctcggtccttaattgaccggggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcataattgacaaggactcatacgtaatcatggttacaaagattttaagggtaaacaacaatcaaggcatggcataatcaagtgggatgttcatcattgcatgcaattttatttgtaaacaaaataatttcgcaattgggatcaacatgttcaaagaatagtgatgacttgcctgctcaggataatccttattcttgatataattcttgatcaaccttcacctcctagaagttgcagacgttgcctcacgactaaccgatacacaaggtctataatacgcgagaaaaactaatattcaacaacaatcaaatatgcacaataaaatgtactattcgtgtttgctaatggattccaatcatgccaagggctaaagtttcttaatctttctattttcatcgtggtctatttaggagttaaccaacatagcatttatggtatacatatatatttggctaatcggcggtttagtctatcaaatggctatggaaggattatggctatatatgcatctatctaaatagcacggttacataccagaggttctgttgttagatggatttagtatcaatcaaataatgaatcatttgtattattatttaattgatggaggctttgctttaattatgaacatattttacttgtcacaataaattataaaaggttaataattatcca

SEQ ID NO: 50205 - DNA, 1501 bp, Oryza sativa
tcagaaagtgacagcattgtaggttggcaaggaatgcacgatatctgttagcatgatctgaaaaatatataatgttcactaaaacttttgtattgataaaatagacatccatgggtataactactgaattgacatttatattaatacaataattagcttatcatacttaaactaaagttctagggacaaatcatgcacagtatgaggtacataaccaacactaaaaactattactacattcttatcatgtgaggtattcatagaagtatgtttttttttctgtttagtgtagtgtatctactcttaaaatgggactacaactaaagaatggtgcatcttttacaattacataattgtatataggactggtgagaataagactaactaattaacagcaaacaatactaacaactgtaaaacaatactaattaacatactaaaatgaacggaggaaggcaattatttcataaaatcatattcgatactaaccactgtaaatttcatatagtgcagtgatccctctacccctattcggttggtgtgcaaagttcctattcatcttggatgatgatatcatggtgacttggcgagggcatcgtgtggatgataagatcagggtcacttgtcgagggcactggtgtctatatctggactggcgaggaactcaaatttttcattcattttacatgtgagaaattatcaagtgccagcaaaggggagaaagaaaaaagtagctggtcacctgttcactgcagtttggcataaaacaggtagcagaaacaaagcaacaattggagtgtaagaattagcagcagaacatattccatgagactgaaggtggtggagacgctggcctgagtacagcgagcatcgctacctttgttgcagttgcttctgctggtaagcccgccatggatggatcagggcaaagctagcactgagaccagtggtaaattgagggaagccggtggagaacttacggaaacaaaaattacacaacactgagaagtaaagtagcaataccagacaaagggagcaacttattataccttgtatgaagccatgaattgagcttgcagcagcgatgctccttctctattcaaattggcagctcgccggtttgttcaaaaaaaaaaaaaagcttgcagcagcgatgagtttctgctgctactatagtactatgtgcctcgatcctcttgtttcttttctagcataagaatataagtatgcttatgttactttctggttgtgacgagacaatggcttattgtcctcacacgatagctgcagatataaaaaattaatgtagactcgtatacgtcactattgcatccttgtccctagactgattattggaatcttgtgtgctgcttcagaagatggccgttcactaacatcggccagaaaccacatgacgatttcctttctatgatttcagttaaagtttgacttttcctaaaaaacgagttacaggtcgactatagaacattttgaaaactga

SEQ ID NO: 50206 - DNA, 1501 bp, Oryza sativa
gtacggataaacacagaggatttccgattttcaaaatcgggggtctacacatgtgggacccatgtgggtcccacgctcatgagtcagctgccatgtcaattaaaaccgtagtcaaaactgttgagggacctagtttgcactggttttgtaagttgggggacacgttgtatccggttttgcagttcaaggatgattttgtaactcaacgacaagttaagggaccttggttactttttccttttatttttttttcaacggatggggctacgagctacatgcttgggaggcccacgactgcatgcgcgcccttatatacccacctttgggcctccctactagttgggctatttttacccaaattcctaagaatacaagtttttttttaacttttttttatcgatgggaactgcacagtatcgatattcaaatgttcgtatttttataaaaaaattgtatttagaaagttttagggataattgtgttcttgtccttactttgagttacaattgtaattttgcccctcttttttagggtttgtgattttaccctactttttttgaattgaagcttcggtttgcccctgttttagatggcattaggtgggtccagattctgtaagataataaaatgaataaggtaaagaaaaaattgtttacaaaatgtagaaagaccattgtagccctgtaaaaaacacttaccagttaccaccacccagccatccaacccatcctcctctcccatcccaaacaggtggatgcatgcgacggaggtggcggcaccggagcaactcacgagcaggctacgacggcgcaagtggtagcgcttgccggcgtgagcagcggctgctcggtagagagggagtaggcggtgctgctcggtcaacacgcgagcaggtggtggctcagcgacgcaatagcaggggaaggggtggctcagcttggctcagagacgctgtagcttgctgcgaacatcgtttagagtaggagcagccacaaggacacacgacaagcaagctgtggagattatagataccctatacccacatggtatatatatccgactgggtataggggtactgtatgtagatagaatatctttaagagacttgggttaaattccaaacttgtgtatcaaggaaatacccggagtcttagtcgtttacgattgtattttatctttactcgcctattccgttaggaatatgggctgtaccttgtaatacggactccttcccctatataaggaggggtccgggtgcctcttggggcataacttttctcccagatcatacgatcaataatacactcgacggaccaatccatggacaggagtagggtattacttctcattgaaagggcctgaacctgtataaaattctgtgtctctaaacccatccacttctccagattgatagctacccctttttgtattgctgaaattttgtttcgacaggttgcgtgccaggtaggcgtagcgtcaagtttttcgccgactagtgcga

SEQ ID NO: 50207 - DNA, 1501 bp, Oryza sativa
atattttcttgtatatatactttatacgtagatatttcttccatgtatatactttctatgtatatgcatttgtatgtgtaaagtttcaatgtatataactactagaaaaaatacccgtgcgttataacgggtgattgctattttaattttattattattatatggtttagtgttgacaaccaaatttggtaatatcggcatcgaaaaagaagattagattgaagtggagtcgaaggcggagatcggttcgagaacagagaaagaatcggctggagtccagatcggctacgattaggatcgactgggtctgagtcggactaggtaagccgatgcagccgattccgacaatacgacttggtttatgacatcgggttggatcgaggtacttcaagatgattgccgcacatggatagagtcctgagaaggcaattgtatctattaattaggatattttatgtaatttccttagagatatgtttgggcaaaagtctgccgtaaagacttatggtatcttagagtttgttagagataagagtcgtgtccgatatggacattgtttgtaattttcaggtataaatagaccccgaaccccatgtaatcaattaacacacacgttcaatacaattttagcgcatcgccttgctttagttttatttcgacgagttcttgctttcgggttgagctgcatcggtttcgatcttcaacaagaggtaaaacttgttataacggcttgtgttctcgggattagtgcttccatctttatgatactctaatcttgtttatgtaatctgtcgagttatcatatatcttacataatctttggcaatatcgttatttaacctacaatcggctaacatctgttggaagagggcagttgattaggttagacaatgacgttgatttatattatataagatatccaccactctatgaaacttccagcggcttgattgtctagaaattgctcttcttttcatacttaatgttgcatcagttgagtttgatctattaaatcgtgcttagaataccaatctctagcctgcttcctggttgccgattaaggtagtgtcggagtttcagccgatcttatctgatttaactatatttgctctatatgctttattaacacgttaaatctgccctttatgttaagatttcattgcatacaaatatattaagcttctgtttggtatattctgcctgttttaacatcttaacataaagtcgtatcggaatattagccgatacatgctggatctatccgatcggctatgctataaacatatatagtcctgttattaatatatatttcgatctaagtgatttatactgtctcggcatggcgaccgatctatcctaatcacatgatttaagtatatatcgatataagaactatacgctgattgatttacatatgacatcggctcaaagataaatgatatgtcatcggcatctagccgatcggctatcatttataggtttaatcgcggtttctttgtct

SEQ ID NO: 50208 - DNA, 664 bp, Oryza sativa
atcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggataacttatgactcactattatttaatgatggcttaatgatagttcacgatggtcaatcgtgattggttaattaattatttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttactgtcacgcccagaaattcccgaatagaattccaagcagaatgtgcataaaaatccccgtccaggaccagccggggtacacaagcgacaatgttgacatacagatccacgtcttacaaacatcataaaagtcttacaaaaatgcagcggaaaacaaaagataactggagctaagccttgactaaactttgactaaactgcagc

SEQ ID NO: 50209 - DNA, 337 bp, Oryza sativa
gggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgtcgcaacgtgggttagcgttggacagcggatgtttaatattaattaattgttacaactgtttaaatctttcaatttccgtttataaatgctcgctttatgcaaatgagccactctagctcttctttgttaattccctgcatcatacccctattccggtatgacttgctgagtacagt

SEQ ID NO: 50210 - DNA, 534 bp, Oryza sativa
caaggaaagaacatatgatactatagcagtttgctaaaatagacaagggccacaattgttaccttgtttacttataaacagggccggcccaacaaaacacagcctaaaatgtgaaccaagattttggaattgaacgggctaagggtgccactacatgcctgcattcatacattcacgggagaagatcgcaccgttgaaaatttgatcgaaacaaaataaaaaaaattccggcgagatgcaagttctccaatattttgtgtgatgcggggcgcttgcctcacaacgaacgatttgcagcgctgaggttggcacctagcccccggattgagatcctctacagtcaaatgcacgatacttttgtcacttacatgtgggcctagggatcatcaggctcatatgttagtgacaaagtcacgtgacttcgactgcagaggatcctgatccctagccccccgatgtcatctttctgccaacgatgtacccacatcttctaagcttgcgtcttctcacaacaagtgtgggattgagtccgga

SEQ ID NO: 50211 - DNA, 224 bp, Oryza sativa
ataagtataaaccaaaagatgaggcccattagtatttacatgtacttcctccggtacggtaaaatctctctacactaatttttaaagattaagatccctctttacttaaagactacggaagagtgcatgacagatggagtagtgatgatggctgtggccatgtgggtcccatcgcgagctcactacaaaagctgccctgatgctctgaggcctctccaatctcc

SEQ ID NO: 50212 - DNA, 1501 bp, Oryza sativa
caccaccatacagtgacgatgcacgcagcacgctacaaccaacgtcgtttcgattcggtgcatagctgaatctgaatctggaatcaatatgctggatccacactccacagaggacgggacgattacatgcccggggtcctcactcgtcaataatgccgattgatgcatgtgtgtgctggtgtggttttttggttttcatgtagcgtcgcatcgtccttttgctatcgatcattaattgtactctctcactgctatgctatgcatcctggtcttttccttttccgaacaggagttcgtggccatggaccccttgctttgcctttccaaatgatcaaagctcgtactgaagaaatctcgtgataattagatctttttgttgatgctgttttaatgattattgtcgaaacatgaattcggcaataataaaaggggtagcgcacgagacctaaaagtggatggatgcagagacaaaggatttagacaggttcaggccctctcgatgagaggtaataccctactcctgtttggggatttgaatccgccgagtgtgtattgatctgacgatcaggttgtctcatgccccctagagggcctcctgcccaccttatataggatggggggcaggattacaagatagaaaccttaacccatacggtatcggtttcctaaatctattttacaatattatcaaatcaggactttaggccgcttcataatataaaaggaaacgtaatacccaagtcatgatcggttacatattccatagatataagctatcccctatgactagtcggataaccatgccgtgtgggtatggggtacccataatctccacagtagcccctgagaccttcacagtcggaaagataatcttctctcgaactagattactccaaagccgagtgcttcaatcatcctcgccatgatctcccgagtacttttaccaaatatgaagactgtggagggctgaaaaataaagtcaggtgcatcgagtagatgtacctaatagatgcaccaactgagtggttttgataatcgtagtcaaacaagtgacttaatattaatatatagcatatgcggtgtgaatccctgaataacatgatccgagtgatataccgactgctttgtaaaatatgatgcgtgcaacctaaagctgactacatcattgaaaattcacatagcaaaatagctataaagaagcttgtatgttgtgaataaagaaatttccaaagtattgggcatacgccatgcgcacactgctttaacagatgtgcttaagtccctagaagacacatggtcccaccacacctggaaatatatggcatatgtggtataaaatccgagtaaataaactcataaaggatttaccaaccgcctgaaaaatgaccacaatatataatcagcctaagccataatattggtcaataaaaatgcacacttacgtggcaaaaagcaatgatattgtatccaatcaattgcttaaaaacccaaacagcaccat

SEQ ID NO: 50213 - DNA, 234 bp, Oryza sativa
gatcccccgtttttttgtttatgactccaatcaactatgccaagaaatcgacaacaccaataaattagtcatctaactggttggtagctaaaaacaattggcattgccaaaccaaagttggtggagcaaaccaaacaaaagcctaccaatcttgtcacatattgctgatacacgagatttcttttgcatggcatccagaatacagcagtccctaatggtcgccctttatgattt

SEQ ID NO: 50214 - DNA, 185 bp, Oryza sativa
gagtagtgtctagtactagtttcttgatgatgtggagtttatggaaaccatgtctagtgttatgggttgggactgcccttagggaccttcccagtttgcttcagaactcatgtagcaaattaactttttaattaatactctgaactgtgttaatttctgaccagatcagttgtgaattgtgcagg

SEQ ID NO: 50215 - DNA, 1501 bp, Oryza sativa
atctagctagttccactagcgggaaggatggggtcgctagatctggaggcctaggcctccccgttggccgatgtgacagcggtactgggcagcagtggaggcgactgcaaccagcggtgttggaggcgacaacaactggcgacggtggagagagaagggaggagggagaagagtgggagagagatagaaagaggagggaatcagagggaccgagggaggagggagagactcgagggagtttggtgggcagtaggtgtggtgggctgtggattttaatagcgtcaaaatttgtttcgcagcggtgccctttacttaccgctaacaaaacccgattttcgcagaggcctgcctcgaaaaatagagttggttttttatagcggacctcctaattgtccatcagcgaaaatccgttttcactggtgatttgtgatccaaaataatctaatatatttttacaagcatttgtttcgttattccgccggcaaaaataaaagggtaacgccatgaaaaattatttttatagtagtggccatctcgatattacattatattgtcgaggaggactgcaagaggcgaaggctggagagcacgagcacctgttggagattggggttgcaaccaggaagttagatggggaggggagggaagatgatcgagggaaggtagaagaaacctgctcagagattcgtgctggacgcgtgtgaaatccttccgaaggagtgaaggacgaaagtcctctgtaattttcttcagctcgagggccagtcaagcaaatcaaggcatcatttctagaggatgctacgtccggaccatagaattttaattgaaacattccttttcttcttttttttttttttgcctacagcaattttcgtgtttggttacttttcttttaggaataacttgggccaaacatttgaagtataagagattatctggttcacagaatcacagccaaacgttaactcactttaccgcgtcacaaatagtcacgtttaataaacttcgctgcctatttggttgaggtcacactggagtataacatgattctttctcttccatctatattgtttgattgcatgctcactcgagattattcttcttaatgaaataaaggacatgaactttaattaaggagctgtgttgtattgtagccctttcatgcaaccatttgggcccacacggccatagtgaacgggcaaagggagggtaaggtggacacacgcagctggtgggaaaaactcaaaaactgttcttcaccgtcacaaatttgtttggcacaagagcataattgtggagattatgggtaccccatacccacacggcatggttatccgactagtcataggggatagcttatatctatggaatatgtaaccgatcatgacttgggtattacgtttccttttatattatgaagcggcctaaagtcctgatttgataatattgtaaaatagatttaggaaaccgataccgtattggttaaggtttctatcttgta

SEQ ID NO: 50216 - DNA, 1501 bp, Oryza sativa
gattcccagtccacgccgcggcggcggcggcggcggcggtggtggaggagggagagaggggataccttcgaattcgattcgaagccgagatggaaggacggagtcgcctccgccgcgtccagaccagcctcgccgccggcccgccgccgcgcagggactactgccaaaggccggcggctggccaccgggggaggcacagccacagggaggggagggaggctcacaatgctgccgccggcgcggcgagccggcgacgagaaagcgagccggcggcggcggcggagaggaatcagtggagaggaggcatttggggagtgagatttgggggggtttgggttggtccgaaagaggcaacaagaacaccccaaaacagaaaaaaaaacataaaaacatttaatttagagtaaattgtatagtattttgcacttacaccgggtttactatatatttttattttacatcaggatatataaaaatagtttttattttgtactccctccgtttcaagttataagacattttgactttgatcaaagttaaactgcttcaagtttgaggcaaatatattaatatttacaataccaaattagtttcattaaatcagtaattgaatatattttcataataaatttgtcttgggttgaaaatatttttattttttctacaaacttagaacagtttgactttgtccaaagtcaaaacgtcttgtaacctgaaacggaggtagcagtagattgtgtcatataactgaaggaaattatttataaatcacgagtggaccttatgttttttttaaaaaaaaatagaccatgtttcacaaagtttcattcattttatataaaatttcatgaaatttttataggtttaatgatgtatcccggtgttaactgaaatttatttgaaggcaacctggtataaactaaaagtacgtgctaaactagcacctggtgtaaagtgagaccgggtgcgctttactcagtgcaaaatgcaatttactctttattttttctaaaaaagataaacataatctaagtggattaaaaggggaaattcgagcgcattgtgagctgattttattttacagccatttagaccacgattcacgcaggccacaataaaaaggcctagaggaggattgggtataaccaatagggtatctgaatttactctgtgttggcacatattttagccataaaaacttataaattcatggctgcttcaaaaatcgatctagtctggcaaaatttgagagatcttgtattataatcaacccaatactgaaatgatgataaaatgtgttatagtaaatagctttgactttttaaaagtaaaaaaattacaaaagaaaatgctcctattactagcggattaatttgatattctcctttttaacttatcgcttcaagcgatacccttgaagtttccgagttaaaatatatattacaagatatactcttagagaagttttcaagagatgacgtaaaaacatggatttgactgg

SEQ ID NO: 50217 - DNA, 257 bp, Oryza sativa
ctatatctttccataaatatcatgatagcaacaaaggtaacattatcctccttagcctatatatgagtgggtgaacaagtatgaaccaagaaaaaatactcaccactgattgtcggctgcataggactgctggaacttcaactcgtcatcttggtattgttctccaatctatctcttttgtgttggaaattattatactttagtttgcacctattgatctcctacttcttctgtattgtagtaaggcatggcatcca

SEQ ID NO: 50218 - DNA, 1501 bp, Oryza sativa
attttgcactgagtaaagcgcacccggtctcactttacaccaggtgctagtttagcacgtacttttagtttataccaggttgccttcaaataaatttcagttaacaccgggatacatcattaaacctataaaaatttcatgaaattttatataaaatgaatgaaactttgtgaaacatggtctatttttttttaaaaaaaacataaggtccactcgtgatttataaataatttccttcagttatatgacacaatctactgctacctccgtttcaggttacaagacgttttgactttggacaaagtcaaactgttctaagtttgtagaaaaaataaaaatattttcaacccaagacaaatttattatgaaaatatattcaattactgatttaatgaaactaatttggtattgtaaatattaatatatttgcctcaaacttgaagcagtttaactttgatcaaagtcaaaatgtcttataacttgaaacggagggagtacaaaataaaaactatttttatatatcctgatgtaaaataaaaatatatagtaaacccggtgtaagtgcaaaatactatacaatttactctaaattaaatgtttttatgtttttttttctgttttggggtgttcttgttgcctctttcggaccaacccaaacccccccaaatctcactccccaaatgcctcctctccactgattcctctccgccgccgccgccggctcgctttctcgtcgccggctcgccgcgccggcggcagcattgtgagcctccctcccctccctgtggctgtgcctcccccggtggccagccgccggcctttggcagtagtccctgcgcggcggcgggccggcggcgaggctggtctggacgcggcggaggcgactccgtccttccatctcggcttcgaatcgaattcgaaggtatcccctctctccctcctccaccaccgccgccgccgccgccgccgcggcgtggactgggaatcaatccgggcttggattggtttcgtttctctctctagtgaaaccctactagcttcttcaggatttctttgatgggtgcgtggtgtagaagaagtagaactaataacatcttgtgcttgcagagagagaaaaatttggggggtttgagctgagctgaccaccacgtctaggtcaggtccacccccctgctgttcaagctgtggagtgaggagatgcgtctacttttgccaaggaattagcgaggcattgccaggtttccgatggataataagcatcataagaatgttgaggcagggaaaagctcattccacaggatggttcttgggcagcttgttggggaattcggtttcgacgaggagaatgttccttgcaatactccgagaagctcggttcgctcgcggttcggtgcttcggctagcagaatcgtcgcgtctactagcggtgcgtcagttagccccggtgagtatgtcagagatcctgggtccatattgagcctgcagccttggatctttaaga

SEQ ID NO: 50219 - DNA, 205 bp, Oryza sativa
ccgtggaacatcgaacaccttcgtcgcttctacccctgaggggggggtcgggtgtcaggtttcgggctcgggccaaccccgcaccccctcgggcgtgtagggttggccgggggctgccacacatgcacattcttatttcttttttttttcagtatttcaataaaagaagtttcaatttcctaaaggctgtatctgtgctgttttt

SEQ ID NO: 50220 - DNA, 198 bp, Oryza sativa
  unsure (1)..(198): unsure at all n locations
tactctatgttatgacgatgatattagagtagtatctggtactttagacatgatgtctagattacgagatatcattatttgggttacgacctcccagggttataatcttgtatttttttcatgctttatcaatataaactntgcgctgtatggtgcgagtcgttcaaaaaaaaatgcttgtttccggtggttaggaat

SEQ ID NO: 50221 - DNA, 295 bp, Oryza sativa
attccttcacacacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttctcccgctcagcccaa

SEQ ID NO: 50222 - DNA, 718 bp, Oryza sativa
acccctcggggagacagagggaggggtggccacgtctccctcgggcccgaccccccgagggggtcaggccacgtgggtgaccgcggctacccaagcctctagtcacaatacccccgaccccatgtcaccgacagttgcccccggcgttacgccagggcgatcgcctccctcgagggaagcgctcgggcgtgacgccactccttaggcccggtgacaggtggggccggtccctacaggcgggcagaaacccagcggtcgcaaatcgcgcgcatcggcaagggaaaatcgaccgacaataatgagcggcctcttcaagaccgctacattactcgagcagcgcgcgaatcgggacgagccggttcgtttcgcctggagagatgatgatggcgtttttctcggttggcgagcgtagttaatgcgcgcacgatctgccccatctcaaccgccgcggccgcgcatctgccgtgggcaccgcaaacgggcgagtggggttagtggaggcgtgggcgcgagaaacgagggggcaaggtagtgggcgcgggaagcgaggagccgggcatagcgttggcaagggtgtaaagacgccgaggaagggattcgtttccttcctctcgccactcttccccttgccttcgccacttgcgctctaactcttcgtttcctgtgtcctacccttgccgtactcgctcgctctcaagctcctcctctgccggcgtca

SEQ ID NO: 50223 - DNA, 1501 bp, Oryza sativa
ttcccgaggaatgcacttcaggaggactccgttagccgcgcgccgatagagggtcccttccaccagcacgtagcgcttggagatgtgccggacgcgttcactcccttcgcggtcctcgggtaaagtcttatctgcgaggtacgcctggatctcagtgatccaagcaatcaatctaggggagctgggagcgctcccctcgggccccgaggcctggactccgacgggcctcgggggccgttcaggcgcgtccgtctcccctagggggtcgggtcgcgccgacggatgggcaagcctttcttcaaaggcgcccggtggggtctgggctcgcgaggaagcgagccttgacagttcgtcggcggccgcgttatcccgtctgggcacgtgccgaagctctatcccgtcgaaatggcgctccatacgccgcacctggcgcacgtaagcgtccatctgcgggtcagagcaccggtactccttacagacctggttaacgagcaactgcgagtcgcctaacactaggaggcggcggatccccagtccagctgctactctgagtcctgcaaggagtccctcgtactctgccatattgttggtcgcccgaaagtcgaggcggaccaggtatctgaggacgtctccgctcggcgaggtcaacgtgacccccgcaccggcgccctgaagagacatggagccgtcgaactgcatcacccagtaggcggtgtgaggcagctgcgaggggcccgagctggcctcgggggcggagacgggctcgggagctggggtccactccgccacaaagtcggcgagagcctggctcttgatcgcgtggcgtggttcaaagcgcaaatcgaattcagagagttcgattgcccatttcaccacccgtccagtaccctctcggttatgtaagatttggccgagggggtaagacgtaaccaccgtgacccgatgcgcctggaaataatggcgcaacttcctcaaagccatcagaatagcgtaaagcatcttctgggcctgagggtatcgggtcttggcgtcctggagggcctcgctaacgaagtagacgggccgctgcacctttcggtggggccgttactcttcgccaggggtcgcatctctagggcgctcttcgtccgagaggccgcgcggggcgccctcggcttctgtgccgacaacctcggggtcagagggcgacaggcgcggccttcccgcagtggccccgaggccatcctgggggtcgggggcgcctggcaccgtcggacaagcaagcggagggccaactcctgccgtcgggggccttgggccgccgttcggctcgggggcctctcctccctgctctctctcgggtcgagtcgacacagggtgaggatgcgcggagtgagggttgtcctcgtcgcgctctgtcacaccctgaaaattcaaaatatataaattgttgtttaaatggaatttttagaaataattttaaaagtcttgaaaagaaaatctaagtttaattaataaattc

SEQ ID NO: 50224 - DNA, 742 bp, Oryza sativa
cttaatcacgcgtgcatgattttttttcacgatttttttttatttttttgtgaattttttaaatcatgtgcacctgaatgcgcctgattcaactcgaattttgagtcaaaagtttttaaaattttagttaaaagttttgaattttgagatgaaagttttcatatttgagttaaaagttttcaaaatccgatataaaagtttttaaatcttgactttgaaagttttcaaatctggattaaaaattttcaaaaaatcttgttaagttttcaaatctaagttgaaagttttaatttgaaactttttaaatctaagttgaaaattttccaaatcgttaaaagttttattgatgtactaggaggagaggccgagaggggctgtgccatctagcacgcacgtacccattaggaatctctatagcacacatttaactatgcgcgaagatgaccttttaactttattcttacatcatcacactccacataacatcattatatgatgattaacgatatgataataagtttgataaacaatataaacaaagttcaacagtactttagcatcgataagctgaggagaccaaagttcagcaaaatccacatgccacatcatagggttagcaacattttcttggtcacttccccttttttatgagctgcaagcgtaccaggctttcttcatttatgggcttccgatgggtttggccggctgagccactggggaactttcagatttttttttcaga

SEQ ID NO: 50225 - DNA, 510 bp, Oryza sativa
gggggagggaatcacggggaatgattccccccactttattgcacgcggggacggcgggaggcggcgggattcgcggcggcggcagcgctagggcgcgggggagcggcaggagcggcgggaggaaggggatggcgggcgggcccgcccgtcagcggcgcgcgcgcggggagaggccgagtgtgccgcgggggagaggagagagagaggggggagagatgggccgaattcggcccaagagaggaaagggggatttttagggtttttctttttataaaatcattttaactttgtttatttcttaataattattatttgtgctctgaaaattgcacgaaaatttgagggctccttttagaccaaggagaatttagcaaaaattctccgggccacatttgaatttttcttgtacgtattttagtgtttgccaatttcttttcgaattttaattaattctattattccttttagaaaatgatttgtttatttcgggatgaatttatcaggacgtga

SEQ ID NO: 50226 - DNA, 639 bp, Oryza sativa
aattggaccgcttcaagtctctaatttttccttaagaagtcaagaacccatttttgtgctttgttcctgcttgttatatggagtttattagagtaaaagctttttcttttccgttggtcgtgtagacgctgcagcttcggaagatccgctttcgtggaggttgaagccgacgtttgggaaagcgagcaaggcaagtcacatcatccttgagcatattgaatcccagtttataaaattattttgatttaaattaatgcattatcgctttatttaaattcccgcgttatcactgttttatttagccatgcctatttacctttgttatgaccttattattattgctattgttattattaccttgttcaccctaggataaacaaaaccccaactagtgggtaccctattcatggttccactagtatgaatttaggtagatgctttgctgattaaataggcaacattaggtggttttataacttggaatattcatatctcttggatactatggaatggttggcttatggtggaattggacatacccctctcttcctctttcaaagcccctaaaacctatttttcggtggggtttgggtgcatgccagtcgtgggaagtagcaccccggccaatataaggactaa

SEQ ID NO: 50227 - DNA, 588 bp, Oryza sativa
tagaccaagcttatagggaacagataggcacatctacacacacaaactgacccaggtaatccattaattgactccacatcgaccttcatggatacaacatctgtctttcctttcatctgcatgtgcattttgtttctcaattagtttacgaagacagacatttttttccacccatcacttgtgtatctgcaatatttgctttcacttttgaaacattgtaatcacgctactttgtttctgccaaatagttaatcatgctttattgtctgtattgcagtattgcaagttgccgtgaaaggccattctagggaatgcagaaagatgtgcttgcacgccagagatatctcctatgaagagaagggcatttctcccattgatttgacatcactaattcttgatgagcgaggatttcagttgctcacctggtgcattctgcaatcacaaagtaataatgatgctatcaatgtcagaaatactgctatgctagatcatgcaatttctgatgatggttgaagtttttgcttttacggttttcctctaaaattccaataaagaattgtccgctagcattgttttgaatgatggaac

SEQ ID NO: 50228 - DNA, 282 bp, Oryza sativa
ttcaccataggttaaacaaaaccccaactagtggacactctactcatggtaccactagtatgaatttaggtagatgcttcgccggttaaattaggcaacactaggtggttttacaactctagactttgggaatattcatatcacctggacactatggaattgttggattattgtggaattggattcacacctccccctctattcaaaatcctcaaaatggttttaggctgggctcggggtgcatggttttgatagtagcacctcggccatataaggaccggt

SEQ ID NO: 50229 - DNA, 419 bp, Oryza sativa
gtcgcatggaacctgcatctcaatcgaaggattctgcttatctttccatttaagataaatccatctcaaatttagagctctcccgaacacaggtaggtattttatgcccaacctgcccttttttttggtgtacaaaccttagacaattaactaaacaatgcccaccaatccaccatcacaatggccatcccctttccaaataaagcctctcctattctaatatattgacgtgcaatcattttgcgcattcccgaaaataaagcctctcctacatgctggtaaccgacatatgcacaatataccgtcggcgatgtcatttgccatctattatggaaaacataacactcattacttgattggcatgccacgcaacatttatgtgctccatgtccgttaaccccacattatacagtcagttc

SEQ ID NO: 50230 - DNA, 1501 bp, Oryza sativa
atataatacacttttccaacttctcctctcacttttcacatgtgtgttttctgaacgagtaaaaggtgtgctttatgcgaaaaaaaaagaaattccatagggaaagatgggcttaaaaacatattaatcttttctttagaaacacagtacaaacgcagatgctcataacgtgtgaacacatgcacaccctacccctatgagtacatctgaaagattgggccggcatatcttgagattgaagaaatcaccacggacgcctcactatcgacggatatatcgtataccattgagagaataattagccataaatgcgaacacttgtatcaagtctagggcttgaaccggggtgagttggttccaccacaaggaaatctaaccagttgagttgcgctcacttcgcaaattatattaatccatttttaagtttttaccaagcacataattttctagatcgtacaactgtatattcttatttttaaaagagtaaattatttaaccgaattatcgtataactatatatttaagatttaaggtgtttatatcacaaaactacagatctagcaacaaattatcatgtaactatagatttaagatagagttataggaaaactacagacattttaagtagcaaatttatcccaaaactacaaatttagtggcaatttaatcagtaaactacatgtctatagctcgcgcacaacaatagtgttggattaaaacaatacgatttgtagttttgcgataacttcaatattaaatatgaaattttgtgataaagttaacgctaaatcttatagttttacgatattttggtgaaaacttacgtagttatgtaaaatttacttctgagaggcggagattcgagaagctacgaacctccccaaagaaatctaaaatcacgcttcatgtgtgtgtgattgtgtgtgcgcctagcacaaagggggagcacccccagtcacaaggtttttgttttgttttctttttttttgtcgctttctccctttatttttgtttatataatttccagatcaaagaatagagaaaataaagaattaggatgtcacacgtacacttttccttacgaaatttccttaagaacaaagaggtagtatcatcttatgctaagaatcctatgaaattagcttagcttgtaagactaaaatcctaaggaatttagtagtagaatccattcatgcaaaacaaacgatttattttaaaaaaaatcattgtccctaaattctacgataatcctggtgaaaatcgtctgaactgaatgagccttcacccatccatccaaaaaaaaggggcgttcacttcagtggtgcgcgcgtggtggcgccacggaggccgacaaatccgctgctcgacggcatcttcgcctcctcccccacccgcatcctcttccacctctcgcgctcacgccatttatactctcctcctcctcctcctcctctactcctagcagcagcgttggttggtgagctgaggcatatggccatgg

SEQ ID NO: 50231 - DNA, 1501 bp, Oryza sativa
tgtgcattatgacgaaaaaaaaagtgaagcctaatttttttgtcataagtacatgagtttgacctcattaagttgtactaagcagtagtaagaacatgacatgtaacatggtcaagttgtgatcaatctttttacttagagatgctctgactgctagatatttgctgcaatgggctgaagacccctacttatttaattcccatataaaatatgtttatgttaatctaaaattatgtgctgcatccattctgtccttctcataagcatatctaatttgcaaaccttgcaggaaaatgctaaaatcagcacaagctattgatgaattcaatcaagatggagtttgaacagaaaatttgagatgggagaagaacttctgtggttggaagttgagatgggaggatttagcacgacaatacatccatcaccatgtagtccgctgccatcttcaccatatggtgtaaagccttctgcagttcacttgatgcacagatattttgcatgttaacagctgaggggttttgttaatcataaggcgtgtatctcattcaaattaatcattttttagcaaacacttcacttttgttatccttgagcaaccaagtttacaattatgtcgttttgagaatgcaagattatttgagaagacttgcttgattttcatggatatgtagttagacacaggtgcttgacactttgagaagtgtaagttggcacttgacagtttcctactaggcgtccaaaaaaaactagcatgcacacaagtcttgcaaaatctgaaccatatagcttagcaactaatttttttcatgcaatgcttaggtatcgaactatttgatgcctcacaacttctttcgtcatgttctgtaatgctatatttttcctttgccattacttaaagaatactcaattttcgtgttcgagaaagaaaaaagaataccttttcttgtcattactgttaaggctgaggagaaacaggaagaattttgaggcttaacgaattacagatattccttctataagtgaattttatagcttgatcctgaccgctgtgcccaccgactagcgaaacctgagatacctgcttatgaacacgcttctttatcacttcaaatttcttattttctgttctctaaattcatattcataaaatgtcaattttaatgaatttaagagaggactaaatatttgtgtttgcagatgatgatttcaagaattgttttttctgatgaattacagtgccaacttggttgattatagttgcttttttctgcatttttaaagtctttttagctttctaataatgttttaaagaaggatttcacctcaggtctgacagtattcaaatgtttagtgaatcaactacctcttggatatgggattgtctaagaaaaatgtgtgctcattgagctatagattctctccacttctgcagctacagtattgagcttgttatgaaaccaaagcttgaatttccgttaagaatcataaaaagccactcaaa

SEQ ID NO: 50232 - DNA, 165 bp, Oryza sativa
tgttaacctaggactttcttcttgtggtacttgatattcaaatatctcaagacttaaattcgtaatatagtttccccatgccagtactcctgctttacataaaactgcttgacaaagttcagtcagctatacaatgttacttatgtttgctagcaatatttgcac

SEQ ID NO: 50233 - DNA, 1501 bp, Oryza sativa
tgctgctaacagcaaggttttgacatgccaacgcaatgataatactttgaagtctgtattaatctcattgatttattcaagaaattcaaagcagattatcaaagaaaaaagacaaactgttggccgtaaatttcaccagttaacagctggtaactggccttgaaactggaaacatctatgtggatgtttttgctaccattagaactcctcaggttcacccctctaataacacttttttcaaatttaagttctatacaaaaatactccaatttgcttccactgatacagtgtaaatcccaaagcccaactctaaaactgaaaaggcaaaaaccagacgcagccagatctggtttctgatgcccttgtgagtgatatcatttaaacacatctagatgaggatggaagaaacgatgagctgatttcttgtatatagatagatcatgcttactcaattcaaataaaccaattgattttccaaaactcagtcctgctacatatgcactagccagtttgccaagccatgctataagcctataactagcgtagtgccgtagttccataatactactctattggcatattaaagaaatcggctagatagatattatatttttaccagccgaccagcatcaaatgatgattacctgtaagcaagcgaccacacacaagagttatgtcccactagcggtgaaacacaacgaccagaagatatatcccacatcatgattgttccatcttcatctccagaggccatgtatcgcccatcaggagacattgccaatgataaaaccatactcctatggccaataaacatccttatacattcacctgtttgaacatcccatagtcttactgttttgtcactagagccagtggcaatgtagttgcagttgacatgccattgcacacactgtcaggcaaaagtattttttttaaaaaaatgcagacatcaatataggaaattagagaataagcatgtatggaaatattccaacattaagtgatcccatataagaaaatgaccaaaaccatgagtacacttacatcaacatcagataaatgcccagccattattctcaaaggctggattttatccatggaccagattctagcagtcctgtcatgcgaagcactagcaaagtaatgtccaactggactaaactgccaaaagaaaacagaacagtgtcaacaactatcatagcacaaggactacaataacagaatcagataacttgcatccaaaagaatttgacagtgagcttttcacaggacatataagtacctagtactccatcatggagagtactaacgatgaaatactagttaggaatagttcataaggagcacacagaaacccatgcttccttttttctttttggcattgaaaacagctttgtatccacactaataatatactaaaagaactggtaatcacatacttggacatcccaaacagggtagttgtgtcctttgtagcaaacaagattagcattcaacttgg

SEQ ID NO: 50234 - DNA, 307 bp, Oryza sativa
ttagtactaagtagtaagatctggaagcaaaaaaaaaaagttggggcctggatctaagctcgcaggagatcttctgattatgtcgtactgattgaataatctcttgttttttccacttctggcaggcgcataattcctgaatccattttaagtgcagtaattctgagtaccaaaaaagccctcaaaatggtatgcctaatggtttattactctttgtaatattaagaaggaacattctgacattttgctggtataagcaagtggttgatttgtttaggagagcttattattggtttttgtgtaccgc

SEQ ID NO: 50235 - DNA, 1501 bp, Oryza sativa
aactgtatgcccatgttcttagtttactatagccatcatagtacctcgctggatcgttttctgacctgtcattgcaggcaatgacacaatcaaaatgatgtagagggtaaagataataagaacaacacaatgagctaggaattagatgcggaactacccctgctgcagtgagaagaagtgctacagtagaatccatgcggtaattaagaatatgtggttgaacacaatatatgaaaatcatgacagaattcctcgtagaaatgtggttccgcactcatcctcgccgtagaaattgtcggttgagagttaagcgctcaaattgatcctaccaaattgcttcctccacaaaaccatccccaaacacccaagcaaagctagtaatactactacaaaaatggaacaaattactcctgcgtgggggaaaccacacgaccaaattgaggtcccttagtactagttgagtgtgaaaacaacatctcgaacaaaaaaaaatcaatttataacaataataattgcactacgacactacaaattccaccactaggtttccgaaactccggcggctgagccgagcgcgagaggccgcaagagcagaatccgggaggggagggggaggtcgttacctggagagcgcggcgtcggagagggagtgggaggaggaggaggcggtggtggtggtggtggtggtggcggagaggcgggtgcggtcctcgagcagcgcgagccccgccacgcggaagcccttccgctgcaggtactggtgcaccttcttctccatctcctcgtcctccattgccgccggggcggagaaggttcggggagctagggttttgagaagagctcggatccgtggcggggcggggaaacgtcagaggaagaagaagaagaagaagaagaaagcaaagcaacagcagcacgaggaggagcagaggcaaagggaggaagaacgcagcacagcgtcatgtgtgcttcaggcagaggcccagcccaatccgttatatggccttggcccaggagtacgcaattgctcctagaaaggaataagttcacttcacgtccctcatcctacggtcgagttacaatcacatccctcatccgcaaaaccgtatacaacacattccttatcttataaaaccggcgtaaacaacgtcttaaggcagtattcagcccggttttagttaacgtggtgcttacgtggcactctaataaaaataaaataaaaatcatgttcatgccaattatttttctctcttctctacccttctcctacatttactggtctctggttcatcgatgccgatgggaaggtggaaacgttgtggtgtggagaaaggagacagcgatagtagagaagcagcagcaggaaagcttagcggagaaagggggtggagtcgccgccaaggagtcatcgggtcgagcgacgccatcgccgccacttcctgtcatctaggcaagtccatgacgcgcgtgcaaaggaaggcggcctcatcggtgacgcaga

SEQ ID NO: 50236 - DNA, 317 bp, Oryza sativa
ctatgatcttcccacgggattaaacaaatacgatacccttagaatactctcgggtgaaatgctacaatggtatatccgtgcgcttgcgaatgaactctgtaaccataatataccaagagtatttatgcgccattgctgggaattatatttctagtaatgtcgttaagaaataccaacagctaggccaacaatggagctacaaccgggatcacctaaaacactatcctaacaaccgacactaaccgcactctatccacatctttgggattcaaggagagagggtgagaaagaatgatggaatcgctctccctcctagg

SEQ ID NO: 50237 - DNA, 1501 bp, Oryza sativa
cagacctatttatttatttatttatttatttatgctgtttatttatttattatttatttatttatgctgttgctggaatttgattccgtttcccagtttttttttgtttttttgtttgacgtgtgccatctccatgttaattcaaagagatgtttgtttgttaatataaaaaaagaagagatgtttgttgaccgttcgaaatgaaagagatatgttgcagatatgtttgttgagagccatagttttatacgaagatatagacacgtttggatgtgctgcacacccgcacattttatatttgactaaaatgcaacaaggatcatttaacttgttggtgtcacgtaggtcattctatttttaaaatatactagaaaaaatgcccgtgtgttgcatcgaaaaaaaactaattgtttagtttcatgacgtcttacatgcgtagtatttttatatcatggatcatgatgttgacccacatggcaatctatctcctagcgcttgcttcacttaattgcaaatatctcttcgaactaataaacggtgtgttactgaagctgaatatgatttatcacgtgaggagaaacatgataacaattcaaatttgttaatgatagcactaatatgaagataaccaaggacccacctaggcattgagaaatacaagccaccagatctgtattccaattcgatcaggattgcattgtagccaatcataaatctaatttgatcatacatatttaaaaagtaatgtatgctattatatgtatacctttaaaaaaatgcattagaattttcatcaaattggaagaatagattccttcaacttggtcgacctctacaaaggaacaatataatcaaatggaaatttagcctaatttaattcagctttaccaatttacacatagatagctaaaaaagataatgactatggatttcaccttgttgatattttacatgattagaaatttgataaatactttaaaatatattctagtttggagattattgtttaattggaagtaagaattactacctctaacctaaaatataagcatttttaactatgaatctggacataggtaaaaatacttgcattttaagatagatgtagtattaaataggattaattgcgtctcatcattagcaggcagctactcatgcgctcgacggctcgagtccgtctaaccacacacttgagttcgcatgtggtagttccgatccaaggggtgttgggaaccttgatggtgtgggtcccacagtagcacaacatatttgcaatgtttatggaaattctagttcggagaaaatagataatataaacttgatcgataacgatcctggaagacatgtgcgcacgaggccacacaaccaacccaatggccgacacaagattttaattatgggtattcaagatttacaccatgacatttaaaagatcgatgataaaatgctaggttttttttaataaaaaagatgataatgtatagaaaaatatagtagaaaa

SEQ ID NO: 50238 - DNA, 1501 bp, Oryza sativa
atgaggctgcatccggaaataataatcacctagcaggagtactccatttttcttccttgatacctggggtcaaagtcaattgattagtgccaacctctctggacattgtgtaagagttgtcttgatagggttgactcttgaagcctgtgtttttatcctttgcttcaccataccatggctcagattcgaacccaaagtctctcttttgatagggttgacaaatttgggtgctaaccgttccattacacttggttggtagtaaactttaagacttggttttgacacgcgattgttgagagattaattaattaatagcaaaaaaaacttaaaaatagattaatatgattttttaaagcaactttcatataaaaaaaacttttaaaaaatgcattgtctagccgtttgaaaaacgtgcgcacggaaaatgagggaggtgagttgaaaaagaggggaaaagaacgcagccttataatgcattggttcatggtcctcgtatggccacttcgacataaaatagtattcgaaattataatgttctatttgaaacattacaaattaaaacaaatagttcaactcaacggcaaaacttgatagtttgggtggaaagttccatggttggtttttttcctaaagatgtagtaggctatccaaagccatacgattttcaatctcaatattattaaagacatctgtcttcaaagttttaaaattttgactctttttttttcttaaagaagatgacattttttttatggctatagagagagcgcgcatctggctatctagaaccatacaaaataaaaatgatagccacttgagtgtcattgtcacttccatcccaagcattgattaagtggttaaaaataataaatcaagcaaaaaaagaaattattttacaccttgcaccaatattcaacactgcacaatattatttttgttttgtagagaatggtatttttaacctggtctctacattcaaccggatatatgcaatatttttaaattagaaacttagcctatcaaacaggaaacttgcctatgaagatttaaactcattacttttttaaattaggaacttatgattttttttaaattagaaacttagcctattaaacagggaacttatttatggagatttgaactcaggactttttttaaattagaaacttagctctcaaataactcaatctgaaattcgctcttataaagatttgaacttacgatcttaatgtgctacttaggtcactgcaaccaccgaactgcatgtcctttcataatgttattgcattatcctctacacgacatcaaatattagtgacatgagaaagagtcatttagttaacactcatagtggtgccacgtcactcctctccccttcttctcttctttatcatcactacaaaaaaaaacccccgagattaccattccgaattccattcctcctccaaagaatccacggacgatcacctgtccaccgccgtcgtcttctccgtctccgatg

SEQ ID NO: 50239 - DNA, 1501 bp, Oryza sativa
tcctgaacggaagatgggtcggcggagattgaacacgacgtactctctccatcccaaaatgtaagcatttttagcgcgtgtctagatccatagctaaaaattactatattttgggacggaagtagtacatccgaggagacagcagtgaagcccgggtctcgtagcggtcaatggtggcgtatgccggtggaaaagcttcaggtcactcggctgacggcagcgcataccggcgtttgagctccgggccactccccggcgcaggcgggcacttcatcgctgctacttgctgggttttcgtgggcttcacgatggctggttctgtcagctatggcgtgctgcctcctgaggcatcggatggtttggacggtggatgagtgctgaaggcacgcgcgtgcagtcaccccgtgaaggcagacaatcttgatccgccttgtcccatttacacagaagaagcacaatgcaaatcaaatcaatgtcatcacacaaatgagaatagcaagatttacatattccacagaaaaaagaggaaataagggaggaattatagatctgaatgtgatgtgagaatggaaaaaaatatacagacgttttctgcacatatccaaaaatatttttttctcaatcctagaaggtacgtgaatagttagataagcaatgactcacttaactcacattaatgatttgatatctatatacctaataattaaaaaatacgcaaggtttccggtagtaaatttcgtccgtcccccggtttatccacgcgagcgatccatttttgaccgtgcgtttaacgagtccgatctgttatggcggatgttgcctcactaagaatatttattattattaaattttagcaacaccctatgacacaagcatcataattcctagttggttacccaacgaagcttctaaatggtaggtttggagttcgactcccaccaccccttagttttctgctgcttaccctctcctatttttcctttttctctcctaagctgattatatatttttaaaaagtacatccatatatctgaaattcatattaaaccaacaatatatgcaattttttattgtgcttttctacactttatcgcctcctcttattaatttttttttgaaaagtatgtcctatttttttctctcttctaagcttgattatatattttttttaaaagtacatccatatgtttaaaattaatattaaaccagcaatatttttaatttcccattgtgtttttttatcacctcctcttattaattcattttgaaaagtacgtccatgtgattgcaattaatattaaaccagtaatatatgtaatttcctactgtgtttttttacattttatcaccaactttgtatttttttttaattgataacataaggaatatctttcaaatgtcatggtgaaattcatgttaaaccggcatatatataattttctactatatttttctatacattatcatcttttttattaaaaaaaacctagcattttatcat

SEQ ID NO: 50240 - DNA, 1501 bp, Oryza sativa
aagtatcctgatcacctgaaaaatatcacatgaaagaaaagtcagttgcatactgaagtaacatgtcatcttttgtttccgaatttatatatgaactttaccacaccaccagctacaaaacatggtaattgtgacgaacaagaaaagcaaagttgcgatgctaggaaacaaggtaaaatgctttttttttccatcgtgatgattacacaaacaggaatgtatgagaactaacaattaacatggcaagaattaacggacaatatatataggtcaatgtatgagaatatgccaggccaattacaaaaatgatatagcgtggaagtgggaaaaatcactttgcctgtggggaacaatgctactccctccatccccaaatataagggatagaatcattcaaattttatccccgaatataacggatttggagtaatgcttgtccaattaatcatccatagttcaatttttcttcccaccttatgttgagtgtaggcgtgtgtatttcagcccaatagggcccattccaccaatgtatatgtatagtagatgagaaagaaaatgaagtgaagcttctagaggaaaaatcacaaaactacatggtatcagagctgggtcaccggcgacctcgccgacgcgaaccctagtcggcggcggcgctgtgaccagaggggttctgcggcgacgtcgacggctgaggcggagcggcgacgtcggacagcggaggtggagcggcagtgtcgacggcggaggcggcgacggctgctgcagaggttctcgacgcgagcagcgtgaaggaggagcagggcgcacgctcgctggttgagctgcgcaaggatttggtgcagcacaagctgtagggagcacagcggctgagagacgcgcagctattggctgtaggatcaacagagaaggatttggtgctattggctattgttgtccgttccagtggtggtgactttggtggtgctgttgctggtgctgctgctacttgagaaggtgaggatttggaggtgaagcggaagcttggtttgctgttgctgttgttctgatttggggaagaaactgagtacgagagcttggcttgctgctgctgttgtgctgatttgggggaaactgaaaagtagtgctgctgggaggaagtagtgctactgctgctgttctgtttttggtgagaaactgaggagtagtgttgttactcctattaattgatttggctagtatcctagaagatttggttgatctgccatgggggaaattcaaggaattgagcaaatacttgagaaattggctgaagaagttgaagaaataaggggaagaattcagaaagtgaaggagaaaacaacagtgcttggcaactttgttaatctcgcacatcctatgcaggtacctaactcaacttggatattagaccccggagcatctagacatgttacaggaatgtcgagtgagtttacatcatatactccatttcagtcatcatttaaagaaacaattcaaactgccg

SEQ ID NO: 50241 - DNA, 1009 bp, Oryza sativa
tccgccctaaaatataagtttttaatacctcgatataattttaagatgctactttgactaacaataactataaaagtaagatgatctaaataaaaagagttaaatattataatagtttgtttaatgataaatctagtaacatcaattttacatgattaatcttttttattttcttgctattaatagttaaaagaaaaaaggttttacttagcactattttaaaaatgcttatattttgagacggagggtttacggagcattaaagtctcactgtaaatcaactggaagccaattaaagatgacgcagggtctactgaaaactaactacagtacttcaaagctaattaaggctgtgtttagttcctgaaaaaagttgaaagtttagggaaagttggtagtttgaaaaaaaagttagaagtttatatgtatagaaaagtttttgatgtgatgtgaaggaaagttaaaagttgagaatagttggaggtgaactgaacacggcctaaatatggtgtatcaattgaatttggcatgaaagttgacaggactacttcaaagagaaccccacacgttgacctatcagtcgtatgtgatgtgatttttatatgcatagtacagtatatgtcctatactatttgctggagcaattgccgatcatgaatagttttgattatccttctttatcttgtctcaataagaaataaatcaaattttcagtctctcattcaaagttggcagtatataataatattactagtgaacagagaacgaaaatgacagctacattatgccacatttgcaagcatgcagctgctcctgctcctctggttgactgcatatgaaaggaatttgattgaatttgcagattattttgtccaacgaggccatttaaaatataactccaaaaactactgatcacacatccagtgaaggtctagctggtgactattaattgcactcttcagtaccgtctggtcagttgctttcaaattaattaatcctcttaactaga

SEQ ID NO: 50242 - DNA, 1501 bp, Oryza sativa
tcgtaaagttccgtcggcagtttgaattgtttctttaaatgatgactgaaatggagtatatgatgtaaactcactcgacattcctgtaacatgtctagatgctccggggtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaatagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcgacactgccgctccacctccgctgtccgacgtcgccgctccgcctcagccgtcgacgtcgccgcagaacccctctggtcacagcgccgccgccgactagggttcgcgtcggcgaggtcgccggtgacccagctctgataccatgtagttttgtgatttttcctctagaagcttcacttcattttctttctcatctactatacatatacattggtggaatgggccctattgggctgaaatacacacgcctacactcaacataaggtgggaagaaaaattgaactatggatgattaattggacaagcattactccaaatccgttatattcggggataaaatttgaatgattctatcccttatatttggggatggagggagtagcattgttccccacaggcaaagtgatttttcccacttccacgctatatcatttttgtaattggcctggcatattctcatacattgacctatatatattgtccgttaattcttgccatgttaattgttagttctcatacattcctgtttgtgtaatcatcacgatggaaaaaaaaagcattttaccttgtttcctagcatcgcaactttgcttttcttgttcgtcacaattaccatgttttgtagctggtggtgtggtaaagttcatatataaattcggaaacaaaagatgacatgttacttcagtatgcaactgacttttctttcatgtgatatttttcagg

SEQ ID NO: 50243 - DNA, 1501 bp, Oryza sativa
ttttcttttgaagggaagaaccatattcagtgccaaaccgccaacgaagtaaacaactaaaataatagttcaaaatccatccaaactttggttaccactttacagaaaaatatatcaataattttaaccaagcaaagatagtatatatcttgaaacttgaacaacctgagtcaaacgtagcgaaataaactcgaaatatttcatcaggtaaataatgcactacctgatcttggcacatctgattgataaaataaaacattctgcacccggccatggcattagattatatgctaatcacacagcttcattctttaatctcctctcgtagaatgccaacatcttctctaatcttgtcacctaacatgaagccatgaagcaattaaacccacaggtgctgccaaatggcaaaaaaaatcgtgtcctcacgacttgcttagttccctttggtaggagtgatggtgtgccatgtaaaatatctgcaaattaaacaggcagttgggcagttatggacaaaacaaataaactagaatttcgtcatttgaatagaacacacggcaaatgtttaaaacaatgctgtgccggagagagagaatcgtttgcaattttcaattgaagaccactacttaggaaaatatgaaatgtacttggatggcaattgctacctatacaatgtcagaaccatgtggatcctctcataccaattccttggaagcagcaagtgtcagacgcctgcaaaagcaatttccatatcattatatagccttgcaaacatttagtaggtgaatctaaactaatctaaaggactgcacagcattttagcctaaagcaatccattgaattatttgcttagagaactcttaaaaattttcaaacatcataaggcggttttatgatgggagtaggaactgaaaacatagcaacaaaagatgttttaataatattgaagataaacttctatgcttagtgaactgttaaggattccaagcttttcaaggccaacagtttggagttaactgtaatatcaacaataagggagggattgcagcccatggttcagtaaaacctaaacagaagcatcagatatgtcgatcttatcgcacagcctgaaacaaaggtggcttttgtcaacctgcagggtaaagaacaaacatgccagccactaagaccacatcagaaaacattgaaacaaactacagaatgcagcattatgctcctatgcctcatagaaaactcagtcacctcttgaactcaccacaaggattttcaacagtagagacaggcacaacatgacaagtctcccactaacccaacatctcaacctccctttcttccccccccccccccccttaaattcagactccagcacctccctcaaagttcagaccacagctggaaaacacacaaactggcaaacagacattgcactctcttagcttccctctcttctccatggagctccagttccagaagccaacacaagggcaatcccagcagcagcaat

SEQ ID NO: 50244 - DNA, 225 bp, Oryza sativa
ttcatatatatgtatgtaacatatatatgaatgtagacaatgctagaacgtcttataatatgaaacggaggaagtaattcttttttagcatttaccatcgcaaataaattgtttaagcatatccaattcttagccattagcgcattactgttcttagaataagaatgtctgaaattgccatgttcatgcaagtaccaataactaaatatttatgccttgccttga

SEQ ID NO: 50245 - DNA, 1501 bp, Oryza sativa
tgtttcaatgttttctgatgtggtcttagtggctggcatgtttgttctttaccctgcaggttgacaaaagccacctttgtttcaggctgtgcgataagatcgacatatctgatgcttctgtttaggttttactgaaccatgggctgcaatccctcccttattgttgatattacagttaactccaaactgttggccttgaaaagcttggaatccttaacagttcactaagcatagaagtttatcttcaatattattaaaacatcttttgttgctatgttttcagttcctactcccatcataaaaccgccttatgatgtttgaaaatttttaagagttctctaagcaaataattcaatggattgctttaggctaaaatgctgtgcagtcctttagattagtttagattcacctactaaatgtttgcaaggctatataatgatatggaaattgcttttgcaggcgtctgacacttgctgcttccaaggaattggtatgagaggatccacatggttctgacattgtataggtagcaattgccatccaagtacatttcatattttcctaagtagtggtcttcaattgaaaattgcaaacgattctctctctccggcacagcattgttttaaacatttgccgtgtgttctattcaaatgacgaaattctagtttatttgttttgtccataactgcccaactgcctgtttaatttgcagatattttacatggcacaccatcactcctaccaaagggaactaagcaagtcgtgaggacacgattttttttgccatttggcagcacctgtgggtttaattgcttcatggcttcatgttaggtgacaagattagagaagatgttggcattctacgagaggagattaaagaatgaagctgtgtgattagcatataatctaatgccatggccgggtgcagaatgttttattttatcaatcagatgtgccaagatcaggtagtgcattatttacctgatgaaatatttcgagtttatttcgctacgtttgactcaggttgttcaagtttcaagatatatactatctttgcttggttaaaattattgatatatttttctgtaaagtggtaaccaaagtttggatggattttgaactattattttagttgtttacttcgttggcggtttggcactgaatatggttcttcccttcaaaagaaaagaaaaataaagaatatgtactatggttctgatactgtaaaatcacagaaattccacgagtactccaattttgtttcatttcaccacattttaatttcatgatcagagactttggttggcaagtcaactgtagatgtggcagcaggttgcttgtgcctcgaatgcaaagattatccttagctccttgaactaacaaattgcgtagaaaatagaatgaaatacctgcgttgagaaatgcagaggtcaaagttaatggaagagcatcacctcacaatagaaaaggaaaaaaaaagatgaaccgtaagaagagtata

SEQ ID NO: 50246 - DNA, 1499 bp, Oryza sativa
cgatcgaacgaacgagagcgagaacgaacatgtcaacgtacgttgccacgagaacgtgaacgagaacgagaacgatcgaacgaacgagagcgagaacgagaacgatcgaacgaagacaagcgagaacgagggaacgaacgtgaatgagaacaagcgaacgaacgtgaacgagaacgagcgaacgaacgaggacgaacgttaacgtgaaatgcaatatatatatatatatatataggacactcatatggggcaccatggtgcccgggcaccatggtatctaatgcacaaaattactcaaatttttcaaaattttcaaattgtgagtatatacctagttataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccggacaccatggagcaccaaacaaatttactatatatatatatatatatatatatatatatatatatatatatatatatatatatatatatatatgttatacttcgcatttatcctaatacatctttttgtatcttgcagaaaagacgtgttgtcggagtcgtccgtcaagcctgagtggaagagctagccctagaaggaattggagcacgcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 50247 - DNA, 1501 bp, Oryza sativa
gatttgcgattctagggtgggctgcactgtcaagctggcagggacacctgactgtaccacggtcagccttaacttctccaattctctgcacaggcgatcttggccaggccgtatttgagctacattgcaataggccttgcgacttagcgcatcagcgaccacattagctttaccggggtgataatgaattccaagatcgtaatccttaattagttccaaccatcttctctgcctcatatttaactcgatctgagtgaagatgtacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcatcacagaagatctcgaaatcttttctgatatctggcaaggtgagaactggggcagtggtcaaccttttcttcatttcttgaaagctgtcttcacaggctacagaccattgaaatttcttttccttctttaacagctcggtcataggtctggctagcttagagaatccttcaatgaatcttcgataatatccagctaggccaaggaagctgcgaatctctgacacattcttgggcgggttccaagcaagtacagcttcaaccttgctgggatctacttcgacaccgttggaggagatcacgtgtccaagaaatgctactcggtctaaccaaaattcgcatttcgagaattttgcgaatagttgatgatctctgagcttttccattatcagcctcaggtgttcaacatgttcttccttattcttggagtatatcaggatgtcatcgatgaacaccacgacaaactggtccaggaattccatgaagattttgttcattaagttcatgaagaacgctggagcattggtgagtccgaaggacatcactgtgaactcatatagaccataacgcgttgagaaagcggtcttcgggatatcttcagatctgattttcagttggtggtaacctgatctcaagtcaattttagagaaaactcttgctcctttaagttgatcgaacaaatcgtcaatccgtggcaacgggtacttgttctttatagttacttcattcagggctctatagtcgattaccattctctcatagccatcctttttcttaaccagaagcactggggctccccaaggggatgagctaggtcgcacataacctttactctccaattcttcgatttgtcttttaacttctgctaactcattagctgccattcggtagggtctttttgtaattggtgcggtgcctggtgccagttctatggcgaactcaatctctcggtctggtggcatactcgttcttgtcgttagaaattctattgatgctaattaaactactgtcttgttttttcttgttctggtttacaga

SEQ ID NO: 50248 - DNA, 1501 bp, Oryza sativa
tcttgagtttatacaagcagcttgatctgtgaagatagaaaaaaatgccacaaataagaaaggagcagcactgacctatgcatctcagaacaaaagtaaagaagagatagctttccagaatctgaaagtataaccagaatttctttcccttctatctgaaaagaatatggcaaataattatcttcccatctgtcatcagaagaaaagtagagacagccatatgcacaggaaaagtattgcaaagtattatgctttgctatgagaaagaactgcaccttcggcattaaaccaaagtgtgtacagcgccagtttaagacaccaacatcttttataataccaaatgtggtttgttcacagattgattgtaaaacaccatcttcaccaataacaaccaattccagtgaattttcctgcagcaataaccaatattttcaataaaaggatgaaagaaaaataagtaccaggattctgcagaactaacccagcagccttgtaacagagatcatacagtgagttcacatgttaattgatatgtattcatgttcctctcgtcgtctgcttgttgtcttatcagccgcagccaaatttgaattttagagttgattttgagggtttttttcatcgtagtttaattaccagcattgacttttaaaccgcgaagaacacagatataaaagtttagcccacaaattatttttggttgcttatttcattttcccacggcttatcaaccatagatcaaacaagcagagtgtaagaatttaagcagctcactcaatatacgcagtgatacaagtctatagcttttcatttatcttttcccatcgtcccgcattctgtttcttctaccagcatggcacacaaatttattcaaatatggtaaaacaaagggacatccaggcatagatgacggtgtagcaaatgttttgaattattcatttattattctcctaatggaactgatccgacgctagcttcaacaacccaatcggtagcatgacagcaatatttgggtttagcaattccaatcactggggcaacatgtcctccatgtccttacaccactaaaagcagagcaaccatggttaccccagaccggacctccaaaccgaataacaaccgcatgatctatggcataaggagcatcatccccgacgctccgagccgaccataaaattaaaaaaaaaaaaaaaaaacccagccacccttgggggtccatcctctacgcacggcgatcggaagccctacacgattcgccgatcaggggaatgggagtgcgggaagcgggggggtgtttcccgaccttgcagagaacgacgtcgacgcagtcgggggagcggaagcagccctgggcgacgtggagcacggcgctcccgcggagcacgcgcttggcgaggtagcgggtggcgacggctgatgaggacgcggatgccgatgcggtggcggcggcggcggcggacgatgtggaggggcccgaggaggaggacgacgacgacgcggc

SEQ ID NO: 50249 - DNA, 447 bp, Oryza sativa
catcatccttgaacatattgaatcccagtttgtaaaattatgttgatttaaattattgcattatcgctttatttaaattcccgcgttatcactgttttatttagccatgcctattcacctttgttatgacattattattgctattgttattattaccttgttcaccctagaataaacaaaaccccaactagtgggtactctattcctggttccactagtatgaatttaggtagatgcttcgctgattaataggacaacattaggtggtttttataactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 50250 - DNA, 1501 bp, Oryza sativa
tgttagctgttagttttcacttttatgtcagcaacgcaaccagacttgttcttaggatcatgaattacaaactgctcactcgagaattgagatagttttcatgatataatggaagccagagtgctactggttttgtgaatcagcaggcgaatctgcgaaaactcaattgggatatcctttagttgagactggccaagttctctacactccaatccatgatgtagtgcattgtactagttgttgcattgtgttgatgacttgctgtgaaatctttatctcactgatatcgattatgcatgttattctttcgtggaagacttcctttttttttatacgaggtatcatggaaaagaatttttgcaaaaaaaaaaaaaaacttctactggtgagggaaccgacctcttctggctgagttcgcttgctgaggttctcaacctttaactctctcaaaactcaataggtcggccaaatcactcaccgatttggcttgttgattttttttaatttttttataattttctaagtgatatataaacaacgataggatatcaccttaagacacatcatgtaggagactcatcgcctcgatcacacacatatactgacatagtacatcgtactatacgtacttatttaagctaacatccaggccagctggtacatgcagagttttcagatcacatataggctgtgtttagttgccggcgtcctccgatccgttacttgaaagcgccaacgtcttcctcgtctcccttccggctggccctgaagtactccttcgggttaccctcgaacttgtcgcgggagatcatcaccttgccgtcaaagcccggcgccttcattgtccgggtcgtcggcggatcatcatctgccgtcttgtccgggtctccactgctctccccaatcgccgacagcaggaacaaggtgccggcggcggcggcggcgatgaaggcggtgacgccgaggatgcggcggcgggtcgaaggcttgtccgtcttctccttctcctttacctcgttcctcttcatctcgcggcaagagagagagagagacagagagagagtgggggggggggacagtgggtaactggctacggagattggagaggcctcagagcatcagggcagcttttgtagtgagctcgcgatgggacccacatggccacagccatcatcactactccatctgtcatgcactcttccgtagtctttaagtaaagagggatcttaatctttaaaaattagtgtagagagattttaccgtaccggaggaagtacatgtaaatactaatgggctcatcttttggtttatacttatatttatcagctaaaatttaaatttttaaccttaaatttggagctgattttgaggtttttttatcgaagtttattttttagtttttatttttagatcgctaagaacatgtatataaaagttttaaccacaaattactttccgtttgcaaatatgccgtttcgcttattccgcgaataagcgaaat

SEQ ID NO: 50251 - DNA, 808 bp, Oryza sativa
attggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatatataggggtgggactttagtcccggttggtagcaccaaccggggctaaagatcccggtgatctttagccccggttggtgctaccaaccgggactaaagtcccacccctatatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaataagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtaga

SEQ ID NO: 50252 - DNA, 594 bp, Oryza sativa
aaataggatctcatgatgtgcctataccttctggagatggagttggaaagtccccaagcaaaaaatccgaagccggtaccagctcctcgcagtcggccagtctgaccaggccctctggccggtctgaccgcagccatgttgccggtctgaccgggccatcaggccggtctgaccgccgacctgacgacggtctgaccgacgcctcaggccggtctggccggtctgaccggtggcctacagccggtctgaccgggctccggtgtcggtttgatgagagggctgcaaagggcgatgtgggggcttcatcgtcttcaagcaaagttaatagaggacattatttgcctcctagaacagagccgaatcctaggtggatgcctaaggatttgacggctacacaaaagagaaggttgcaatgtcttcgggcccaagaattaagggagaaaaaggccgaagaacaaagagataaaaggttcaatgagttacgaccaccaccggtatggaggcctaaatccatagagaaggcaaaaccgattgatgtagaggagaaggaagaacaatcggttgacaaagataaatcgtctccaaaggaagaca

SEQ ID NO: 50253 - DNA, 373 bp, Oryza sativa
agcttgaggtcccaatatcctgacttctgaccttattgccttttctcattgtcagccatctgttgcaaaggtttggagagggagagagggaaaacaaaggggagagccagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagc

SEQ ID NO: 50254 - DNA, 1501 bp, Oryza sativa
tggtttggaatggtatattcctggtttggagatagaactgtgcagccgggatggttgttcagaatggttgagcctatacaacagggtatgttgtatagcgttggattaatattgtttaattacttaactgttttattaaattctcaaatgtttgctaaatgctgcttttgcaaatgaaaccctactatgccatcctttgttatcctgtgcacttgcatatttgctgcgtggcttgctgagtatgtcatatactcaccttgcaatcattcatcagtggaagagttctacagtgaagctgatggtgtggaggattaggtgtagccttagtcaagctgcctgtggagtggagccgtccgcgccgtttatcttattttccgctgcttagatctttattgattgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacagccaggaagcccaggggtcctccccgacaccaccccggcgaatccacatgtctctcggcatcaaggctcccctgataagctagttactcagccaggggtgtcccattccacccatgtggtcgtacttgtcttatctttggatgaaattccaaggaaacggtccttaagtgcaagagtggaaaaccgtacacccggtacgttccccggtccgcggttttgggaatttcatttagttcgcaagcaccgacccaggtgtcgggttttccaagtcttttgtaaaacccaagttttatccaagttgtttttcagatttttaagtttgaaggcgaccgtcgatactcgcacagggtgcacgaatatcgaggcacaactagatggttacaaggggacatgatatatcaattaacaaaggaaggatcaaatgcaacaaactaggtaggtccgccaatctgccttgcagacgggacaaacagattaagtgcgatcctatcaatgcataatattttgcaagcaacataattaaattcaaatataggctcaagatgttcaaaggtggcttgcctttctcgagatctggagcttgatcctcgaaatcctcgcactgcgggtcttcgggcttcgaaactacacgcaaaacgggatgactcaacaaacggtgaaaataaagccctattaatgacctataagcttgccattagatagatctcgagatttgaggaattttggaagttgaacggagtcaaacggatttacggttgggaagatattgaatttttaagattattggatttttggtctaaaggaaaaaggatttaattaaatccttttttggaaaagaaaagaaaagaaaagaaaagaaaagagggagggaaatcagacttttcctcgggcggctagggcgcggcccgagagaaatggagcggtccggccgagctcaa

SEQ ID NO: 50255 - DNA, 370 bp, Oryza sativa
ggcttgctgagtactgtggttgtactcattcttgctcaatcttttccctcttcagtaagagaagctttggaggagaggtcttaggtggagttatggcttataccccagttgagcgcctgtgaagatggagccgtaggcccgctagtccgctgctgtttatttttgatggtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacacacgtgccacataccaccacggtatacggacggaagacgtgacatagt

SEQ ID NO: 50256 - DNA, 346 bp, Oryza sativa
ttttaggattttctttttataaaacctttttactttgtttatttcttttcaattattatttgttttctgaaaattccactaaaatttatttacgcattttaggcttttaggaaatatacaaaaatcctccaagcctcatttgacttttatcttgcaccttttaattgttggaggctttcacattgaattttacttattcttttgcacaatttcgaggatgaattttagagtcgatttgggacgcgacagccgccgccgctccggacttcctcccgactcggcgacccctccatccgcttcgccgtgttgccgccgaccccgtccgccgctccgcttcgcccgcaga

SEQ ID NO: 50257 - DNA, 585 bp, Oryza sativa
acgtcacgtgtgaggtctgcggcggcacgggtcattctgggaatgactgccgaaaaacccgtgaggaggcgatgtacatgggcaacaatgggtaccgtccacaaggaggtaaggggtggaaccaaccacgcccatattatcaaggaggtaacaacaacggtaacttttctaaccagccctccttgaaggatctcgtttttgcgcaagctaaaactactgatgcgctaagcaaaaagcttgctgccaatgacaatatcctaaagaacattaatgtcaagttagatggctttgcttctgcttttcaaaatcagctgagctttaataaaatgatagaatcacagctagctcagttggcatccttagtccctgcaaatgaaactaggaggattccggggcaacccgactcctccattgaaaatgttatggcaatcacgacgaggggaggtaagtccactcgtgatccgctgtatcctaaccctgcaggaaccaatgggataaccaaggaagcaccatctagtgactcggctgacaaggaagttcagctagaaaagacagtgccataggagtactgcaacacacggttgc

SEQ ID NO: 50258 - DNA, 1501 bp, Oryza sativa
gtctctgtctctgtgctactaatagcagtagtagactactctaagggtgtgttcgctggttctagttctcatcgagcacagtgagcacggaaaacgaaatggtccattagcacgtgattaattaaatattagctatttttttcaaacatagatcaatataatttttaagcaactttcgcatagaaaatttttgctaaaaacgcaccgtttagtagtttgaaaacgtgcgcgcggaaaacgagtgagatgtgttggaaacttgggtaagaacacaccaatttagttgtttgacctcttggtcaaacttttctaagtttgatcaaatttgtaaaagaatatactaacatttttaatacaaaataaacatattattaaaatatattcaatattaaatttaatgatgttgctaaattttttttataaatttgatcaaaccgaaaatattttaactaagaaaaaaagtcaaacgacttataatataaaacagggggagtagcagtttaccgcctaacaatcaagtttggtttctgcacaaatgtaattagagatgatgaagaagaaaaagagctggagcttgagctttgattatgatgatccatcatccatcctgttctacgcagcctacgtacgctggtactatttggttgtatagataatatgcctgcccgtatttcatttcttgtttctttcctctgttgatgccatgagcttgagctttgcatgtttatttgtgctgaatcatggagacatggagctccagggaagaagacagataggaggaacgagatcagaggcaatgaggtcttttgtacacggtttgctgcgtagatagcaaaaatggcaaaatagcaacaaaccagtggatcggatccagatgacaaataattaaaatagttcggaaagatggcatctaattagaatgtgccttgagctttttgctctatctttattcgtcctccgatgtatcgatcggactagctccttctcttttgtgagataatgaacttctctgaaagcctgacgaattgcaagaacaaagcagcttgatcctgcaattttgtctgcctgccgtatcgtaacatgtataagaaacttgaagaaatactcggacaaaaaaaatcccaaaccttgggggcaagtaatgtacagtacagaggagggtcatgatcttacttggggagggaatgcatcatgtatgttgtccttaatcagaatctatccttggagaatgagagcacgcaaagatatctagctaaagtatcatacgatctcttgctttgcctggatgaacacaacgtaaaagcagcaagcaaggtgggcatcttctaaattaaaggcctttactttccctgcaacatatgtttatagtcgttcatcactctgttggtctctcattgcgctagctgcctgctgcaacttcctcaaccacagaatctgcacaaatcaaccaagagttgggtgtgtacagtgtgtggagagggagagagagccagggtggtga

SEQ ID NO: 50259 - DNA, 1501 bp, Oryza sativa
tgaactgcctcaccaagctcccaatgaattggtttgcatcaaaggagtgcatcagccttacccaggcgtggcattcaaactctcctttgagcttttggtaggcagctcgaacaacgggcactgtcccagcaggtccacttcttgtttccagcacagcaatcactctaagtccaccttgtccgtcgttggtgatgagcttcacgaggtccaccttttcttgttgcttggcggcacgtctagcctcatcaatgtcgtcgatggcggcagtggattgcagcagctcagcagcagtaacagaagaagactgtggggcagctgcagacacaccatggtaacgcatgtttctctggctgacatcctcaaccttggctctcagctccttcatctcgttcccgatgcgacgcctctcccggtgtactgtgcaagggaggctccaccagggtggtttcttcaaccgggcagcgtagtcttggaggcagtcttccacgtcgtaggccacgtcacgtacttgcttcacccaggtcctgatgacctcgtgatgatgtccatcatgctctttgtccgcagccagcaggaaagactgcatcatctcaagctcatccctgatgaaactttggtcgcgctggacgcccagcttcaaagctccctcttccgcgatcgcggtttgggcatagctaagtgctccaccgagcaccgacttgcccacgctcaccgccgtcgcctccattgctggccagctcacctctcttcttctgactcttcttctttgattgtgtggatgggtctgcttctgccaccaatgcaggggacttgagcagaaaccaacggggtattaaaatgaggagcttcagctcagggacaaacatgccaagatggtgggggccacctggttcttatccattgatccaaaattgagcttattagccatttgaatcatcatgcagctgcagcttctcatttcttcgttgtcactttgctagctatttgcaataccagctgcaggagagcagggttgacggcgaagccatcggcgccaaagcaagctctacacgctacatctccatcagcccagccctcatattcaccatttgtggtgtacttggattcttcccacctgtttcacatactccattgctagtctccaaatctgatgcgtcagtttccctcaaatcgagctcctcgcccaatcaaaattgctagcttcaccactaaatacacctcacttacatccaccataaccaaattgcttcaccaaattgcgctgggaatggctggaccgctggaactggaattgaacgaacatctggggctcttcaagatacatagttgatagctagtgataggatcgcggatgcaaccacatttaggtatcattatcaaaaaatgagaatactagggaaaaacctaatatcaaataaatagagagggtgaggcttcgaaaccaggccgactagcccaccaccttgtggagctagccggaagatcgctggacgtttctcta

SEQ ID NO: 50260 - DNA, 1501 bp, Oryza sativa
ttcgatttggaaggaattggattcggaattgttctcgacgatcgatcgcggattgagatcttgagatggcacgggcactagacaacaagcaaagaaacaaatttcgcaattagggtttttaagagataattttcccgctaggcgccacgacggaacgggcgctacatttaccatatgccgacgagaggggtcccagaccaacaacaggttaggtcccagaccatactgtgccaggaagcccaggggtcctccccgacaccaccctggcgaatccacttgtctcctggcatcaaggctcccctgattagctaattactcagccaggggtgtcccattccacccatgtggtcgtacttgttatatgtacggatgaaattccaaaggaatcggtccttaagtgcaagagcgggaaaccgtgctcccggcacgtcccccggtctgcgatttttagaaattcatttagttcgtaagaaccgacccaggtgtcgggtttttccaagacctttgtaaaacccaggttttacccatcgttggatatttgaaatttgaggggaggactccgacgtgcgtgcccgaaggcccgtacatcgaagtacaatagttgacaaaggaggtttaagtgtacaataattcaaggagggtaattgcaacaattaggattggggccggtaggctatctcgcaagccgcggccaaattacttgtgttaatcctatccatgcattatttgcggaaaagaaatacttaggtttaaagtataggtgcaagatgatcaaaggtgacttgccttgctcgagttcttgagcttgatcctcgaaatccgcgcactccgggtcttcgggctccgaagctacacgcgaacgagacgactcaacaaacggcgaaattaaagtcctattattgacctctaagcgtgccattagatagatctcgagatttgagagattttggaagttgaacggagtcaaaaggatacatggttgatgagatatggaatttctaagattagaggatttattggactaaagaaaaaggatttattaacatcctttttgaattagcaacgaaagaaggaggggatttagacttcatgggtggctagagcgtggcccaagaggagttggcgcggctcggccaattggttgggccggcgcggcctcagaaggtggcgcaacagagggaggcgggggagagagagagggagagagagagatccggatgagccggatccatcgtgcggggtcccggggtaggcccacgagtcagtgactcggtgcacgggagagagggtttatgcggcgcgggggagctagggtttgcggatgcggctcacagatggtgcaccgggtggactgggagacggcgggcccacgcgcagccagctggctctccgtggaccacgcgcgcacgggagacagatcggaggagcggcttctccgaggtcaaacagtcctagcccgcggccgagctggcgccgacgtggcgccttcgtggctgccacg

SEQ ID NO: 50261 - DNA, 282 bp, Oryza sativa
tcgccgccgagctccggtccgctgccgtcgtcgccccggaccaccttccccctcggcgccgcctccttcggcttcgccgcatcctcgccgacctcgtccacccctccgtttcgctcgccgaccgccggagcaccgccgaccccgtccacccgagccgcgccgccgccttcctccgctccggtcgccgtttccgtcgtcgccgtcgacccggggtgagccgtggaccgccgcttcgtttccccccttccttcccctctgtcggccgccgctccgccgtgccta

SEQ ID NO: 50262 - DNA, 626 bp, Oryza sativa
atcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttgtaaataaaactatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtgaagcaggagtgaagatcttgagaacccgtcacagaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctcc

SEQ ID NO: 50263 - DNA, 1501 bp, Oryza sativa
  unsure (1)..(1501): unsure at all n locations
tttgtggccgggatggtctcttgccagaggagtcgctggcagtggaagcggtcagtggtacttccgagtgctggacagcggcggcatacaccatggccttcacctgagcgatggtggtcttgactgccgcgtcgcctggaatcggcatgttgtcgaggagggcctttgcggctatcatgttgttctgtagcgtggtgaagacatcatgttcttccaacttgacttggaagatggcattttgggcgagacggncgcgctgtcgcagctcgattagacgccgagtgaggtcctcctgctgctactggatacggcgcttctcctcttcgtactcccttttctcctcgtccgtctcttgaaagacgatgaagacctcgcgggagtgatggcttgaagtccgggtgttgttggagcttcccgagttccgagtcggagagacgtacagactcatcaaggaaaccaacccagcagggatctgagctcccgcggcagtcgaggacggtgacgcggagcggccgtggtgtcccgggcaccgcgggggtttggacgtgatcgggcggctggtgtcgaggttgccgacttgaaatgccttggcagaggaagcaacgaagttgctgataccgagaggtgctggcggtgtagttgtcgatggcgtgagttcccacgaagccagcttgaggacgccggagttggtggcgaagaagtcgagactgccgaaggagagagcttgattcctggagggtagcggtaggctgtaaccggcccgatgacgccgaggctcacctgacagaccttgccgaagctgtcggcgatgaagtcgaatgcgccaaaggagatttgggtggtggcagggaagtggtggtgttggtgatctcaacgccggtggatgccatctccgccttgaaaataatcaagcgccccctacctggcacgccaactatcgatttcttggatcggcaatatattttatggggtgcgctagataagaagagatggtgacacataagtttatcctggtttaggccctcagagtgagataataccctacgtccagtgtgtttaactctgtatccggtggaaaaatgatccgaagacctccctcagactgccaccggcgccttttatactggcttaggcccgccggcgctaatcagggtacagtatccttataatctagatacttgcctactattacatgatacgtggttcattgccatatctgctatagcttaccaactatacaacacctaccatactcggaattgggtcttcggcccacccctgaggacgcgatcttagtcctcaatatggggtacccgggtgccacatacctcacactttttatgttggttttaatagttagagagggagtcattattacgaatcagattcgacccatatctgaggtagctaaatagacttttttttcctaattccacgaaaaacttaaagcccatctgaaatcgttagttttgctcttgctcagttgccagggcccatctga

SEQ ID NO: 50264 - DNA, 1292 bp, Oryza sativa
gtgcatcaatatagccactggaatcataaaccgtgtcttcaggatgagcatcgtcgtcaccactcaccacttcctcattggaaggtgtctccaacgcggcaacccgatcagttagtgtggatatccgcttgtccaacctctccatgtggttcaggaagccgattttagtgaaggcatctggacagactttgcaacggcttccgtgatgtccttttgagtattttcttggagagttcgtagttgctcttgactgacacagtcagcaaaatcctggggactcttctcaccttcgttacctgccattgaaacaccaaaacggcaacaaacggtgaagattgtcgcgaccgggaaaattgccttttcccgaacgctagtgtattaatccccgtcccaggaaaagccggggtacaccacacaaacatgatataaaagacacatctttattatatcgatagtatttacattattacagaggcgcttcaggcctggcaatcaaaaataaacagcagcggactagcaggcctacggctccatcttcacaggcgctcaactggggtataagccaggactccacctaagacttcttctccaaagcttctcttactgaagggggggaaagattgagcaagaatgagtacaaccacagtactcagcaagtcacaccggcagatgcatgattaatgcaagggggtacaaggagataataataggggttaagttttgcggtaaacaacatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctaga

SEQ ID NO: 50265 - DNA, 1501 bp, Oryza sativa
aacgctagtgcattaatccccgtcccaggaaaagccggggtgcaccaaacaaacatgatacaaaaggcacatctttattatatcgataatatttacattattacaaaggcgcttcaggcctgacaatcaaaaataaacagcagcggactagcgggcctacagctccatctccacaggcgctcaactggggtataagccaggactccacctaagacatcttctccaaagcttctcttactgaagggggaaaagattgagcaagaatgagtacaaccacagtactcagcaagccacaccggcagatgcatgattaatgcaaggggggtacaaggggataataataggggttaggttttgcagtaaacagcatttaaaagtcacttagttgcccaaagctattttataaagacgatcttagagctacacaatattattaatcaaggccgtggacccacacgaacctgccttaacccaaggcctacgatgattcggaccgaactggcaacccgacctgggtcccagctcgtcccaagccaacccaggccaacctttccacattttagttgttaagcaaattttaagaattaaaccactaacttgggtacattgctaggcttgcccatatccgagggctcggctattcgaatagatttactctgatcagaggtgtacatctttacccacaagacacatctttactccgcattccatggccttggaacccgtcgtaaacatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcagagatatccatcgtcgcaacgacttcatccatctctatccgtgtccttttgttcaggactagcctgagcaccgagttaagccttacccattagacatgtggttagtacggtagtgctttgcaacagaggcccgagcttaatccttatagtggccggggtgctacttcccacaactggcatgcacccaaaccccaccgaaaacaggttttaggggttttgaaagaggaagagaggtgtatatccaattccaccataatccaacaattccatagtgtccaaatgatatgagaattcccaaagtctaaagttataaaaccacctaatgttgcctaattaatcagcgaagcatctacctaaatttatactagtggaaccacgaatagagtacccactagttggggttttgtttattctagggtgaacaaggtaataataacaatggcaataataatgtcttaacaaaggtaaataagcatggcttaataaaacagtgataacgc

SEQ ID NO: 50266 - DNA, 1501 bp, Oryza sativa
cctcggattcggttggaaaccgctcccctaatctcgccggcgccattgatggcggccgacctcccgcgccgcggtttcctcccttccccggccaccctccctcgccccggctctatttaaacgctccccgtgcctccctcctccgtttccgccactcgtcgctctctctccccgtcggaatcgagctcgcgccgtcgtcctctctctccgccgtcgccgccgagcttcggttcgccgccgtcgtcgccccggacctcctcccgcttcggcatcgcctccttcggcttcgccgcgtccccgtcgacctcgtccactcctccgtttcgcccgccgaccgccggagcaccgccgtcctcgtcgacccgagccgcgccgccgcctctctccgcttcggtcgccgttcccgtcgtcgccgtcgacccggtgtgagccgaggaccgccatttcgtttcccccttccctcccctctctcggccgccgctccgccgtgcctatggccgccgccggcgaccataggggcgcgggcgcgccgcctcccgtcggccgtgccggcgaggccgcctttgggcgcgccccgcggctgccatgtggggcccggccgtcagccgcccgcgccctcggtgcggctgacgcgtgggacccacggcgccggccagcgcaagccgcgtgcgcccggtccaccgtggaccgtgaggctgccgcgtgggccccactcccgtggacccggtccgcgcgcccctcccctcggctgacgcaataaatccgattttaaattaaaatttaaatcaagaaattcgtaaatatccatttaaagagcatataaacttcaaatggccataacttggccatttgaactcgaaattggaccattcaagtctctaatttttccttaaaaagtcaagaacccatttttgtgctttgtttctgcttgtgatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccatattattattgttattgttactatttccttgttcaccctagaataaacaaaaccccaactagtggacactctactcatggtaccactagtatgattttaggtagatgcttcgcttttaattaggtaacattaggcggttttacaactctagactttgggaatattcatatcacctggacactgtggaattgttggagtattgtggaattggattcacaccgccccctctatttaaaatcccctaaaatggttttaggctgggctcggggtgcatggttttgatagtagcacctcggccatataaggaccggt

SEQ ID NO: 50267 - DNA, 1501 bp, Oryza sativa
accacgactcgccattgtcaccatagccatgtagcttatacatcaaatagtcgtatctctcgctgccgcgagggcttgcgagagcagtgaggaggatgaacgagccttctgctccgacaattttggcatcgagttcgtcgaagttgttgtacctagggtgggaggagtagtggcagtggaacgataggtaggagattgccggaggttgggagatccaggaagataccttgatggtgtggcctctgctggatgtgagggtggcgacggtgtcgtcgttcatggcgtcggtgatgaggacgttcgtgtccaggagaatcggctggcggcggtggccgttgatgtcgatcgattgacgggacgtcgacatcaagtcgccggccggagcgtcgtcggagtcgatggcgcggcgtcgactcgccggagaggaactcggtggatttgggatttagagttgggacttgtaattcagagcctactgtttttttttaaatctagtttttctggtaaatatataaggaaaatttcgttctacgtatacgtatcgcgaatcctgacatgcaattttttagggaattagggatgtgccgtgtccaacttccaaacagaataaagatccgtctccttttgtacgacggcctccaaaatattcgcgggccttttgccttcggcccggcccatatatcgcctcaaattcccccagccgatcgatcgccgactcgactcctcctcctcctcctcctcgtcggcggtgctgcggcgctgatctccacgatggcggagcggtcttcttcttcgtcggagtcgactggtaatggtaatgtcaatgtgaatctctctctctgtctctcgtaggttttgtagtgtgcccaagatgcgatggatcgtgctctcgttgattgttcgggatgcgtgattactggttcggttgttggtttatagggtttttgtttatgtgatctaggtgtaataaacccgcgaattagtgaaacgaaataagcccttcggtgtttgtttgattcggtttatttatgtttatgtagatctagccataaaaaaaaagaacttgtcagggcagatcataccatcatcacccacagctccttgtaaaggagtaaagaaactgaaattggaagtttatcatatcatgttagttttttttggttcatatcctcatcctgataagaaaaatatcaaccttgatttggtgttatagtagtagtttcttatgaccgacattatttttgtattttagaatttgtttatgtgattgtcagctgatgagctgataaaatcgaattgggaattatttggtgcgttggtcaaatccatcttcattcatagtagttgcgttctaatccactttgcaacctcaatttttcgcggaaaagatttattgcattgcagcttccctcatatattgtaagaagaaaaggtagaaaagaagcaaggaatcagttcttttattcagcttctttactagccagttttatgctttgttgtc

SEQ ID NO: 50268 - DNA, 906 bp, Oryza sativa
catttggcctggaagaatgtccatggacgccggacttcatccatttccaaatcggggaacttttgtttatgactagactgagccacaaattaagccttacccattagacatgtgaaagtacggtagtgctttgcaccagagggccggagctttagtccttatagtggccggggtgctacttcccacaattggcatgcacccaaaccccaccgaaaacaggttttaggggttttgaaagaggaagagaggtgtatgtccaattccatcataatccaacaattccatagtgtccaaatgatatgagaatttcccaagtctaaagttataaaaaccacctaatgttgcctaattaaccagcgaagcatctacctaagttcatactagtggaaccatgagtagagtgtccactagttgaggttttgtttaatctagggtgaacaaggtaataacaataacaataacaataataatatggtcgtaacaaaggtaaataggcatggctaaataaaacagtgacaacgcgggaatttaaataaagcgataatgcaataatttaaatcaacataattttataaaatgggattcaatatgatcaagatgatgtgtcttgccttgctcgttttcccaaacgacggcttcaacttccacgaagagcggatcttccgaagctgcagcgtctacacgaccaacggaaaagaaaaaggcttttactctaataaactccacataacagcaggaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaattaaaaaacctatttattg

SEQ ID NO: 50269 - DNA, 1501 bp, Oryza sativa
tcatcctccccttcttcacggaaaaccgtcctcggtcttttggaatcatcgtctttttcgctttggaagttcgtggattcgaggtcgaatcggatcggtctctttcctccgaaccctaacctttccttctcgtcgccggttgccgtgggcctccgtcgccgctcgctagcccctttaaaaggacccccggtgtcgccgctacccgccgccaccctcgccttcgtctcttgtcgtcggaagcgccctagcaccgtgagaccttgtaccgcagtcgtcgccgtcgctccagccgtgcttcgccgtcgctccagtcgtcgccgtcgctcgggaaggttgccatcgtggtcgccatcgcgtcgccgtcctcgtccgccccttcgccgtcgctgaagaccgctggagcaccgtcgccgtcgtcaagccgaagagtgccgccgccttttcctcgacgccgtcgccgtccgttgctcctccgccgcttctttggtcaccggtgagttcgccgcgtcgccctctacgtgcaggtgccctccgttcgcgtcgccgcgccgtcgttcgccggcgagtttgcaagcccgagccgccgccagtggtgacgtcaccgctgacgtcatcgggaccgtccgtcgtggcccggtcgtggatcggttgatctcggccgttcgtttgggataggttcgatctcggccgttcgttcccgtgagccgccgccgtgcacccggtccaccgcaaaccctagccactgacgcaataattcccttttcattttcaaaaataattcattattgcgtcataattcaattaaaatccatataagtgttttaatccgatttaatctttaaaaattcataactaattcattgtaactcagttttatgtggttcaagttgcaaaagttgtataaaataaagatctacatattaaaattatccataaattgaattaaatttatttaattctttttaaatgggctttaattagatttaatctagtaaaattcataataaattcatttgaagtcagaatgaggccgttcaagtctcataattcatctaaaattatgatctacatgtttgtttactttttatgtattgtttatttggtttttattagtctttttcttcgttttgcatgttagcttgtcgtttccgtcgttgcaaaggttcgcgagtgcgccggaagtattcaagaagattaattgaagaccgattattgcaaggcaagtcacacagatcctaaacacaatcctttgagcatgttgatcctatgtttaaattctctatttatttcaactgtgcatttattttcgaatgtcactaggtggtgtgaatctattcctttgttatggcctgtttgcattgattactttatcccttgataccttgggttattataacttgactagttgagctatatatattggttcagctagatattagatatgattgcttagccatgtttagaaacattagcacattactgggataacttatgactcact

SEQ ID NO: 50270 - DNA, 1501 bp, Oryza sativa
aacttggaaatcagcagggctagttagctcgttgagtgttgccgtagcgccagctttagagagattacaacctttgtaatttgcttattgttgtaaaggcggtgttctgacgcacacattagtgccccttcccagagggtttgtgcagttttctcctttttttaatatatacatcggtcggtattcttcgccatcccggccaaaaaaaaaaattcatacttttttttttccttttggaagcgcttcgatcacaggtacacagcccattcattgttccatggcccaacaaacgtacacacacacctgtggcgacagaatggagagaaagcaagatcggttggggaacggcgggcgtgcggcggcgcggcggcgtggcgggcgcccgccgcccgttcgagagtgcagcattgccacgatgggcggaaaagggtgtgggggcaggcgccggcgccggcggcggtgggttcagcggcagtgcctgcgggtgaccggtttctttccgccgtttcgcctccaaactgtcaccaaatctttcgtctgcgcatgaacttcttctgaaattttgctggtatttccttttgaactctgctgaggcccccaaatagtttcagcagttgtcaaatttaagattcacatgatgtgtcctcagttaggtttatcagtttttgacctctagctcttaatttgtgtactaaatctccttatgggaggggatcgttttaaatctagagaaacgtccagcgatcttccggctagctccacaaggtggtgggctagtcggcctggtttcgaagcctcaccctctctatttatttgatattaggtttttccctagtattctcattttttgataatgatacctaaatgtggttgcatccgcgatcctatcactagctatcaactatgtatcttgaagagccccagatgttcgttcaattccagttccagcggtccagccattcccagcgcaatttggtgaagcaatttggttatggtggatgtaagtgaggtgtatttagtggtgaagctagcaattttgattgggcgaggagctcgatttgagggaaactgacgcatcagatttggagactagcaatggagtatgtgaaacaggtgggaagaatccaagtacaccacaaatggtgaatatgagggctgggctgatggagatgtagcgtgtagagcttgctttggcgccgatggcttcgccgtcaaccctgctctcctgcagctggtattgcaaatagctagcaaagtgacaacgaagaaatgagaagctgcagctgcatgatgattcaaatggctaataagctcaattttggatcaatggataagaaccaggtggcccccaccatcttggcatgtttgtccctgagctgaagctcctcattttaataccccgttggtttctgctcaagtcccctgcattggtggcagaagcagacccatccacacaatcaaagaagaagagtcagaagaagagaggtgagctggccagcaa

SEQ ID NO: 50271 - DNA, 1501 bp, Oryza sativa
agacttggaccattcatcacaggcgcgacatggaaactagatcgaaaccctaaaactcttcataaccgacttgctcctggaagaactcctcgtcagcgggatccatctcatcttcttcagcaactgaggggggattatttatatagagcaagggtgagtacaggagtactcagcaagtcatgggaattacgtgtttaatgaaggcttcaaagggaaggctattgtttttacaattgatttttagttaaactcctttttaaaacaactaagtgagtgcttctcaaacgacacggatgagacagtgcatctcgtccggtcggagtatgtgcattgtatcagtctttgattgattcaagattggcacccgaccacaactttcaaacggccacccgggcctagctgatcccgtcagccacagatgttccaaacatcgaacccaattccacaacagcaatttcacaaagcagtagtcaaacaaaactacgctaaggaatcacctcacatccgcccatgaccgtgggcacggctgttcgaacagtttgataacctctgcagagggggtacactttacccacacgacattactaacccggatcacccagcccgtgcagaacagccacgtctggtgaccttgaggctttcatgacaaggcatttcgagagccgacacaggtttactgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccacttcatcttcttcagcaactggggggggggaattatttatatagagcaagggtgagtacgggagtactcagcaagccaggggaaaataagtgtttaatgcaggcttcagggaaaggctgttgtttccgtaattgattttgtttgaactcttttctaaaaagtctaagtgagtgcttctcaaacgacacggatgggacagtgcgtctcgtccggtcggagtatgtgcaatgtatcagtctttagatcttgaaacagggttggcacccggccaacagcttttcaaacggccacccgggccaacaacttttcaaacggccacccggcctagctgatcccgtcagctgctgatttttcaaacatcgaacccagtttcacaacagcaatttcacaaacagtagtcaaacaaaactacgctaggaatcacctcacatccgcccttgaccgtgggcacggctgttcgaacagttcaatgacctctgcagagggggtacactttacccaca

SEQ ID NO: 50272 - DNA, 1501 bp, Oryza sativa
ccacaagcccacacgtatagatgtttgatcagcatttgaattggacctagattacatttctgcggatttgtagttatatcgttcaatttctcaatatgtgaaatcctggtatcaattaattgttctgttttagttattgaaccatcgactaaactcaaacagtacaagccggaccgaaccgttcctttttccttttctagaaaacctctcgaatatgtacatgagcgtcctgcatccaggcccacattgtgtagcccattcatcacgcagtggcggagctagccccgggcaggtcgggcgtcgtccaggctcctccgctaacgtcttcactgtaaattaatagccattcatgtctaaaaaaattagtcgaatattactggaaaatgttagtactcattcgggcttcacgatatcaatggctccaccaccgcattcatgtgtgtccgcgtctgtcccttccaagttccacaccacacgcatatattcagcttccatgttgtagaaaaaacattagatttttcttttcccagttaaaaacctgggacactactggagaaatgattttgctggatcgcttaaaaatcacattagtcccggtttgaaaacacacaataattttttttttatatttagtcccggttggtgttaccaatcaggactaagtattatttttactcccggttcaaagacatgtcagagtcctattattttttagtcccggttggtaacataaaaaaacgatgaaaatcctgcctcgagccgcgcgccgtgccttgatctccccgctcgtccttatcccctgcttctgtgctcctcctgccctgtctcatgctcttcttctcctactcccctccttttctccacctcctccccctctcccggcctctcctccccttcgtcccccttcccctctcctccccctctcctctccctggcggaggcagccaggcgaaggcggccgggcgatagcggctgaacagcggcggccgggcggcggaggccgggaggcggcacacggctgggtggccaacggcggcttgttttgtgattttcttttatttttggaatgatttgtaaatttcggtgtaaattattttagatttggggatgatttggtggatgattttgtgaatgacttgtggattgtggatgattttgtggatgggctgagaattgtggatgatttgttgtgcatgatttggggatgatttgtgtggatttgaaggtgacaataaatgcaagaagcaaaaaaataaaggaaaaaaaagcgcctaaccaaccagactaaaatggcgctgggaactttattcccggttggtgttaccaacggtgactaaagattcatttttactcccgtttatatctttagtcccggattggtcgtcctgatttgcaacccaggactaaaaggggttgtaaaccgggaataaagagcccttccccagtagtggtaacgtcaaccagtcaacgggtttggataagatcgatccccttaggacct

SEQ ID NO: 50273 - DNA, 1501 bp, Oryza sativa
ccgatctagcggcgaaattgttctctacagattaatctaagtaaaaccaaaaaaacctaaagatggcggcggtactgatatatagagtttagggtcgtgcaaccccctctcgacgcaaccctaatgggttccaacacgatacacgggccaaaagcccaaatacggtgacgcagcaccggaacagattctggacgttaaattattcggtcaattcccattgacttggaaagaatatgtatgtggggccaaaaccattggaaagattatcttcttagctttccatccatataaagaacgccccaatccgagcacgtaggcgacctgggcgcccgttttagtgcagactggtactggactccgaattgcacccgatgtcgacttggtttgggcctccaccttgacttggatgtcctcgatgatcctccatggctctaagtccttctccaagtgtctacttgtcccctccattgttcctaatcataatatgatcgttaggtagcaatctattcttgaattcatacaaagaagaacataggaacgagctcacctctaaatttaattgtcgcacacgagctcttgttatcggtccttgaatgaccgttggaggattgttgtgtgtatccgaggtagtgatgtccgcatcagttatggcctcgggtcatgacaatacaccatcagaaagggatgtttaacaggaattgaattcgatctttactaaccgaaaagaataggaagataggacatcttttgttcttcaccagcggaggaacagcctgaggccatggaataccgcgattaatcaagcaatctatcctacaaccaaatttgcaaacatcaaaacatatagagactacagaagaacctgtgtttagaaattacctgacgacttaagtatccccatccctgttaggaataagtctagctgctcattgtagttagttgtttgctttcctattttcatattaagtctagcgcatgatctggtcttccgggttgtgcagattgtgggcttgacgcacgctgcgttcgtgcggagtctgttggagccgtgcgcggtatgctccagttcgtgggatggcgcgaagtggcaaggggtgtgacgcgtgcatttaggaggccactatggccacatttttgttctttcttgtaatctgctatttaagcttgagtcttaatccagaaaagctgctagttaacgcagcgccaaaatactctgtgtttgctctgcttccgctttgccggactagctacagttttcgttttgccgctaacaattggtatcagagcctgcggcgatcgccggggttcctgatgtcgctaccaacgccgcgcgtctcccactcaccgccgtgtcatcgctggcgtttgccgtctccgcgccgtggccgtcatggcggccgcggccaagtcgtggtgcatcgcgtcgtccgtgaggtgaccacgagcagcgtcgtctacccgacactcacccgcacaaattaccaagactgggtgctggtaa

SEQ ID NO: 50274 - DNA, 1501 bp, Oryza sativa
gcattagttatacgtagcaaactaaatgttttcatattaacttatcatcctaattattttcttttgatatcttgtcttcttttgatatcttgtcatgtccaggattcaaacccaagatctctccctcatgcacgctctccatgaccaactcacatacgcatcaattttgtttaaaaatacatacaatttcatttgagactacctaactgagatttgaatcatgtatttgagtatttaaaatatttcaaatgaaaaatttaagttgtagatctcatcgagagctataaatttcatataaaatttgtcctaatccgtgtccatatgaaaagaataagtcaaattatgagatgataaattttttattgcaacgaatttattgatcatggcaatagaaaatagtgaaaagtaccatgtactgtgcaaattgccacaaaaattaaatgtgtggcgatagaacatgtttttttgcaatagtaatgtttttttgtggcgatagctcatttcctattgcaacaaaaatactgaacaaaacaatgattgtaaatcgttgcaacaaagtatagttatttgccacagaaaaaatatcattgtgatagtataatatattgccacgaattattttttgttgtaataaattggtggcgatagttcaattctcttgtagtgaaatgaattactcttacgttgttcttagcccttcttttagtaaataaattactactttattaggataatactgtcagggttatggataccacatatctaatgatagtcgactacatctcggcaggacccaccacataccatgtcttatacggaaactgacttcgaatatggagggagttccggataaggaaagacaatcagagttctacatggaaacgacaaggactactcggattgtatctatattggtttccctagttctacttggacaaggggacacctatgggtataaatacaagaccccctaggaggagaggggggaatccagagacgatcaacatgatcaacacgattgacacgagacaatcgacgaccacctcaatcaacaaccaacacaatatatgggacaacatacaagccaacatacgccaagacaagccgccggatatcgacttcagggataggcatggctattcccctacggtttctccggatgccgtcaggagagacgaaagcgctatttctgatctcgccggacacggattcgaggagcaaggctaccctgttgtcgactacgagtcagaccttcagaccgtcatgtcgacaacagttagataggctaccccacatattgtactggtgtgattatggtgaataaaagcaactccagctccggccaacaggatgtagggttattacctgacaactcaggggcccgaacctgtataaaaatcctcgtccccatctcttttacctcagtctcgcgtatatcctagcaccgacggtccccatactatgcaaataccagaatttcgacgagatgggtttcaaaaga

SEQ ID NO: 50275 - DNA, 1501 bp, Oryza sativa
gacagagcatcttttagctaatggaggtagagtatctgatagtgaagattcagatcaagtctcctcagatgatgaagatgaaatggaacgtaaggcatgctctcgttgtggagaaatcggtcatgtcgccagctcgtgtgccactatatgcgttcattgcgaggaagaccatccacccgacaggtgtccaacgagcaggatcacttgtttcttttgtgaaggaactgatcatgtaccaaaagattgtcaattcagttttctgctgacgaagaagatggctaaccaacccgccagttccaatggagagaagcatcaaggaagcaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgcaaccccccgcaatcagaagcttgctcctcaacgaattgtcatccatgcatcccgaagcagtcctatagcccgcgttgcaacagctccaactccaatgagtgcactaccacaaggtgtcaatgctcaatttcagccccagccaccagctgacaagacagaggtcagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcggcctccacattttcgccaatttacaggaagcaaccatgccaatcaccaagtagtcagtggagcaaatgcagtacctgttaagcctagtgctagtcagaagcaaccataatactcttgtatcggtgttcaagtacttttgttttatagctgttccccgtcaatcatgtaataacagagaaacatgagataatgaatgagattggcaagtttatgtagggtccatattaagattgcaagtgttgtgtgatgggtacatttggttgatgattaaggagacctagggtctcatttccgtaagctcataatctattatgaatcaaataacctagcgattgatggcgaagaaaatcaagtgatcaaccaaagagacatttgtttggactaagagtttccgatgtgtcttcttcggatcaaaggcatgcacccgttgtggaaaaattggacatgttgctagcatgtgtctcatcagctagtcagctccaacagcaacattgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcgga

SEQ ID NO: 50276 - DNA, 1501 bp, Oryza sativa
tacccggctgtacagatctaactccaaaccaggagctaagcaaattattaccaggtataacatccataaatattgtgagaggtgtgagactaatcacgaaaaacattgctcaacccgcccataaccgcgggcacggctatttgaatagttttactctggccagaggtgtaccactgtacccacaagacacagccccacaacatgtcaccatgtgcctcaataccaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttatggttggcacggttaatgtttcacaatagtagctcgcgaaccggtccttaattgtcatgagcacgactctcaaaaccatgtgctcacaacccaccattatcaagttttagttggcaagtaattaatttaccaatcacgattgaccatcgtgaactatcattaagccatcattaaataatagtgagtcataagttatcccagtaatgtgctaatgtttctaaacatggctaagcaatcatatctaatatctagctgaaccaatatatatagctcaactagtcaagttataataacccaaggtatcaagggataaagtaatcaatgcaaacaggccataacaaaggaatagattcacaccacctagtgacattcgaaaataaatgcacagttgaaataaatagagaatttaaacataggatcaacatgctcaaaggattgtgtttaggatctgtgtgacttgccttgcaataatcggtcttcaattaatcttcttgaatacttccggcgcactcgcgaacctttgcaacgacggaaacgacaagctaacatgcaaaacgaagaaaaagactaataaaaaccaaataaacaatacataaaaagtaaacaaacatgtagatcataattttagatgaattatgagacttgaacggcctcattctgacttcaaatgaatttattatgaattttactagattaaatctaattaaagcccatttaaaaagaattaaataaatttaattcaatttatggataattttaatatgtagatctttattttatacaacttttgcaacttgaaccacataaaactgagttacaatgaattagttatgaatttttaaagattaaatcggattaaaacacttatatggattttaattgaattatgacgcaataatgaattatttttgaaaatgaaaagggaattattgcgtcagtggctagggtttgcggtggaccgggtgcacggcggcggctcacgggaacgaacggccgagatcgaacctatcccaaacgaacggccgagatcaaccgatccacgaccgggccacgacggacggtcccga

SEQ ID NO: 50277 - DNA, 1501 bp, Oryza sativa
  unsure (1)..(1501): unsure at all n locations
tgccaccgncgcaatccgncgncgtcgagcaacctncgcgaatccgagccgtggcntcgttncccctgtcacgtgcaaccgggggtgtgcacgcttttgcctgtatcgccgtggttcgctccgccgctgggggcgttgtcccgcgttcattcgaggccgggtcgtcgtctacctcccgccggcccgcgtggcagccacgtaggcgccacgtcggcgccagctcagccagaccgggtcgggccgaccccggtcggtccctccgcgtgcgcgtgatccaccgcgagccgtgaggctgcacgtgggcccgccgcacctgcgtccaccgcggaccacgcgcatgcaccgcgtcccgaccccgcccgcgcgcgtgcgtcgcatgctccctccgcacggtgagccgagccgctgacaagcgggtcccacccgggaccgcgcgtggtgagcccggtccaccggctctctctctcctccctcccgcacgcgcgcgagtttgggccgtcttgggccggccggcccacttagctcggccggaccgctccatttctcttgggctgcgccctaaccgtccgagaaaagtctatattccctccctcccttcttttctttttccttttcaaaaaggatttaaataaatctttttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattctcgccgtttgttgagttgtcccgtttcgcgtgtagtttcggagcccgaagacccgcagtgcgaggatttcgaggatcaagctccggatctcgagcaaggcaagccacctttgaacatcttgagcctatatttgaaatttaattatattgcttgcgaaatgttatgcattgataggatcacacttaatctgttgtcccgcctgcaaggcagattggcagacctacctgattcgttgcatttgatccttcctttgttaattgttataccatgtccccttgtaaccacccagttgcacctcgatattcgtgcactctgtgcgagtatcgacggtcgccttcaaatttaaaatctgagtaacaacttgggtaaaactggagttttacaaaagacttggaaaaaaaccgacatctgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcata

SEQ ID NO: 50278 - DNA, 1501 bp, Oryza sativa
ctgacaatcaaaaataaacagcagcggactagcgggcctacggctccatcttcacaggcgctcaactggggtataagccaggactccacctaagacatcttctccaaagcttctcttactgaaggggggaaagattgagcaagaatgagtacaaccacagtactcagcaagccacaccggagatgcatgattaatgcaagggggtacaaggggataataatataggggttaagttttgcagtaaacagcatttaaaagtcacttagttgcccaaagctattttataaagacgatcctagagctacacaatattattaatcaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccatagtgtccaaatgatatgagaattcccaaagtctaaagttgtaaaacctcctaatgttgcctattaatcagcgaagcatctacctaaattcatactagtggaaccatgaatagagtacccactagttggggttttgtttattctagggtgaacaaggtaataataacaatagcaataataatgtcataacaaaggtgaataggcatggctaaataaaacagtgataacgcgggaatttaaataaagcgataatgcaataatttaaatcaacataattttacaaactgggattcaatatgttcaaggatgatgtgacttgccttgctcagagataacggccttccgaaccttcggcgacgaccacgaaccacgcttcgggaacctccggaacgacagaagctacgcgaagcacacaagcaaagctaaaa

SEQ ID NO: 50279 - DNA, 1501 bp, Oryza sativa
aggacgaaaattagacttttcggctgggcttctacttcttggcccgattgaaagagggacacaaagcagacttcgacagagggagggagagggctgcaggctgagaggagattgggccaagaaagagagaggacttttcctgtttcggcccgaaaaggaaaagaggaattttaattacttttccaattaaattaatcactgaaatgatctttgaattgttaaaaatacttccaatgctcaaataatttcaagaaaaatcctgaaaatacttggacactcaaagtacttaacaagattataattagaccatttaatgattaatttaatatgtggataattactgaaatgttgtttgtattattaaaattagaaattgagctccggaaaatctgagaaaattccagagagtataattaaccatggagaatttaataaaaataaatccagccatgctttatatttagaaaattttatttcccacatttagcttcacttgtaaattaatgaacatttaatataaattctaataataatttattaaataatttataaatcctaaaacgaaaattaggatgtgacagtggactcttaattattagccacttttgcttatgtagcatgccaaagtggcaacccagggtgagaaattgcgtagggaccacacgtcagtctctccctccccttcatttcgacagtcccgtcgacgccggcgacgccccctgctacaccgcacgcaaccgtcgacgccggcactgctacgctgctccatcgcgcgcatctcttgcaccacgtcgatgtcggcgctcgtgctcctcgtcgccacccacagtgccgtcgcggtgtacaacctagtgcaacgagctcggtgcgcagcggcagtgttcatgccagcggcgttgcggaggggcagcggcgttgcggaggggcagcggcgcggcagtgctcctccagctcatctttctcgtcgtcctcgactcccactctcctactcacatgcggcggcgttgaggaggggcggcggcgtggcggtgctcctccggctcttcttcctcgccaacctccactcccgccggcggtggcggcgccgagctagctgtggcatgctgtacaccccggcggcgctgtgggtggcgatgaggagcacgagagccgatgtcgatggggtgcaggagatgcgtcgacagggctggagagatgaagaggagggagagactgacgagtggtccccatgccatttttcccctcgggttgccactttggcatatgacacttaggcaaaagtggcaaatagttaggcaaaaatggcaaatagttaagagaccacctctataaaagggcaaaaaaattaactccaaacctaagaagggtatttggataattgccgaatctaaaagtggcaaatagttaaattccccggcaaaggagagtgcgttgggaaggaggagcgatatgagccgttgggttcgatgattttgggtcgttggattggtgaattaagatg

SEQ ID NO: 50280 - DNA, 1501 bp, Oryza sativa
tgatattctgtcttcctatgataccagcactgtttcctgggactggtatcggttaacaggttaatttggagcgtcacgggttggatccgttcggagctagttcagggcgtgataggcggtgacccagtaggtggtggcggcggcggccctaggggttgcgttgacccgggacagcatcagctcctgtcggcgccgacaaccctatgggcagcggcacctcgggacggtggcggtctgagcacctacgcaaggctctcagcgagtaggcagaggtcaacaccggtggcggcaacggctcagacgaagacaacctgagcacaagcacacaaggccctcagtgaggtgcaggaggaggtcgaccccattggtggtggcagccctagggatgacagcgggctgggtccgaaaggcagaagagcatcccccgacgacgacagcatcactatgggcgtggagacctaggatccagcaaagtggaaagcgatcccgtcggctagtgtccggtcggctagttctgactaaacgatgagcgacgatggatgaaagtaggctaattaactggcggcgcactaggggcggcagcgactagacgaattccactagtcaaatctagctgtttcaagagagtatgtcaggaaatagagaagcacgggtgtgccgaggtcgttttgcttttcttttcttttttggttgtgtgttctcctccttgttgaggtgtgcgtctaagtgctcttgtaattttttagctgtgtatatccttcgtggatatagaggccggattaatgaaaatctattatcaaaaaaatgtgttatcatttggtaataaccattaaataggtgtgcctgaatgctctactaagaaaaaactgcacatatcttaatgaagatgagaagcctgcattaaatgatgattaacaacctaaacactagtactccctccattccataatataaggcataaccacttttttttagatgttccataatataaggcatgcatgcatataggccattaactatgacctcttctccattaaactatttctttttaaatcctccactcttatgttctctaattctattggatgcatacattgtatttattaggatgatcctaactataagatgataataattattttcttggtcttcgggttatgggtggttatgtcttatattttggaatggagggagtactccgaaagggcaatttcgtccttgacttaacgaagttttttttttatgaggacttaagagagttaattatcctgtccatttacagagcccgctggtgcgcagttcttcctactcacagtcaatgagacttagtaactgttttatttggttaaaggatatgagattttaggaattaaggagggaggaactccctgttttttaatgcctggattgaggtgggagttgggaggaagttccccccttatattatattatttagacagatatcaaccatcaattttcactcaaggtcaagactatcaga

SEQ ID NO: 50281 - DNA, 350 bp, Oryza sativa
acggcgcgagcacgattccgacggcgagagtgagcggcgagcggcggaaacgaaagagcggagctcgggaagggtttaaatagcgccgggggaaggaaagagcggccggagagggaggaatcgcgcgcggaagattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggaga

SEQ ID NO: 50282 - DNA, 1501 bp, Oryza sativa
gtgacagctcagtacgggtattcctccgcgtgtgtatatagtcctaagttaatttcctggggagggtactcctccgtatttagccccggttgtatggtcatgacaggctgtcgtaaggaactcggcagtaaggggtggcttctcaaaacaccaggaggacactgggtacggagtattggttacatgacagtataatagcaagtatagactaaagatgtatgtatactagaagtacatgaatgatacttttcttattctttctccagttagcttagactatattttagtgagagtagttcttagttctttcttttgtgtgtcaacctaccctttgaactgaactaacccatacgtagactttgacgtatataagtaatatatgaattgttagcatagtactctcttatcatatcttcccttgggataaaataaatacgataccttggaatactcccgggtgttggtatttgatacggttacagataaaattcgcaagcgcacggatataccgatgtagtacttcccctacggagtattctaagggtatcgaatccaagggaacgtgtgtggtcagatcttcttctggttcatccaaggacacgaagctaatgatagactaggatagagaggattcactagtgagaaatagtgtctagggaaagcttaattttaatcctaacgcaatacttcaggcactggcaacccgctgttcccagatgtctctctattatgtacccggacagggaggacttaagtgatctcgagggctgtcaccacctctacacccacctcaaacgtactgtgggatacgcagcaattactggataataattacctaaacaccacgtctaagcaattaatatctactttagtgtttataactcaccaaagcaatcactatattttggttgattatagtgaacaataatctcgtatgctaattacgaactaaccaagagataattctcacaagataaatctaaattactcaagaagaatgttatattgaattcagagtaataaacaaaataaaagaaataggagaagattaccgacaactccggaattcttccgactccttctactctactctcttcctattctagtataaaatatagtacaatagagcctcttataatttagctcaagcttggaagtgtgtgttgacgtgagtgaagtgaggtctttatatagaggtaggtatgacggttgtactctgcgaattgtcggaaatgccccgcaaccgccatcaggagatgatcaggaccgtccacgccaaaacctggatccaaccgcgtttaccagggttcgggcgaacctgggctgggccctcctggcctggcctttggcccatgtcctcccctggtcctcctctatccaattcttggtattttgggctgatttactgatacctcgatgaagttcacaacgtatccttgtatggatacagaattctcctcactttagtctagatttcctcccaacttcggggtttatcacc

SEQ ID NO: 50283 - DNA, 262 bp, Oryza sativa
tgtttttagattttctttttaatagactttgataattgggggtgttgtttaataattatttccagtgctctgaaaattcaagtaaaatttgagggctccttttagaccaaggagaatttaacaaaaaatctccgggccacatttgaatttttcttgcacgtattttagtgtttgccaatttctttccgaattttaattaattctattattccttttagaaaatgaattttatttcgggatgaatttatcaggacgtgacagc

SEQ ID NO: 50284 - DNA, 1501 bp, Oryza sativa
tgtaacatatatgcagagagcggaagtcttttattttctctatcacctgatcttttatgttagctacagttctatattttttttttgttggttaggagttgaaagaatgacaacagtgatcgatcatactaggacatacaaaaatagattaacatggaaacgttgttcatgtgggcatttcattccactgcatgggatggacaactgtttggcttcctctgctgctgttgctatgctgagtttgcgattcatctgctgttggtgcctcaattcctcatgaaccatttgtctaacaagtataaattgctcaggacaatttgagattgacttacaaagtgtacagatgcagcctactgatcatttttaggaaatagttctgtcattacagatttctgggtagatttgaatatcataaagtgactgtaattactacttgcctaccttttcttttacggataatccttttacatctgtttgcaactaccggtggcaggtcttttgtttgaatctctctgatttcattagataactgaaacactaatctcacaatacatggaatgtttatctacaaatgctatactttactgtcctgaaatatctccgcaggttagataacctttcaaatatgtacaagtcatccatgcgaatataaaagtgtattttcatgtaggagggtggctgatctagctacaatagatttgatgctgtatttttccatataacactacaaccccatgcatctttttctttgtgatactgatattacacaaagtctgaggaaaaagctttcatggatgttcagcagctgttggcaatatatgtgtttagctggacatcaacaattttcttttctttttttaataatggcatacagaagacaattccagttcacatctcttggttacatgatttcagtttcagataagccaacacctgatcttggaaaggattcatttagtctttgtgcatccattttcttattatttagtcaatccgcgtcgccaaggaaccatgactgctgcgagatgaaaattttcattatgtatataagagtagcaaagagaacttggatttgaacgctggtgttatacttctcttgatctggcatttttttatttcttaaaattaatctcattttatatattgtcttttggttgcttaatataaatattaccgtagcgttaccacggacatgctactagtatgggaaaaagatgtggcctgcagctaggacatacatgcttcagaagcatcaaatgtggatggatgaagtgtttgaatatagctcagatgtcaagccatggcttgacgaacatcacaacctactgtgggctagaaacaagttttcatgtcagagcaagtgtgaatatatcaacaataacatggcagagtcatggaatgcttggatcaaaggtttgaaggacttgccaatcgatgctcttgctgatgcaattagggagaaaaccttgattcttttttagaagagtaggatctctacagc

SEQ ID NO: 50285 - DNA, 1501 bp, Oryza sativa
tgacttgggttccaactggcatgttaccagcagagggagcagcgaacttgcaaagggtcttctcagccatatcgtgcaattctggtggcgcgaaattggctggtctagttgccgatagagtaaccttgaggatgaacgataggggtcagcttcacttcatcagtgactccagatatgaaattggtcggcagatcagaaccaatcctgtactaccctattttcacataaaagagaaaacaaacaaggtttgcctacaaaggacaatgacttatacagaggtaaatataaaattattagaaagtagtaaactcttaatcatttatcttccccgggcaacggcgccagaaatgcttgttggtatttcttagcgacactactggaaatataattcccagcagtagcactagaaataatcctggtatattatagttacagatgtgatccgcaagcgcacggatatactattatagcatttcaaccggtgttggcggttgttaaatgccgattctataccgccaacggctacataaagatcagataataaaacatccaacatagtgataggtgtttaatctcacgtattccacaagtgtatttgtatgcaggtgataaaccccgaagttgggaggaaatctagactaaagtgaggagaattctgtatccatacaaggatacgttgtgaacttcatcgaggtatcagtaaatcagcccaaaataccaagaattggatagaggaggaccaggggaggacatgggccaaaggccaggccaggagggcccagcccaggttcgcccgaaccctggtaaacgcggttggatccaggttttggcgtggacggtcctgatcatctcctgatggcggttgcggggcatttccgacaattcgcagagtacaaccgtcatacctacctctatataaagacctcacttcactcacgtcaacacacacttccaagcttgagctaaattataagaggctctattgtactatattttatactagaataggaagagagtagagtagaaggagtcggaagaattccggagttgtcggtaatcttctcctatttcttttattttgtttattactctgaattcaatataacattcttcttgagtaatttagatttatcttgtgagaattatctcttggttagttcgtaattagcatacgagattattgttcactataatcaaccaaaatatagtgattgctttggtgagttataaacactaaagtagatattaattgcttagacgtggtgtttaggtaattattatccagtaattgctgcgtatcccacagtacgtttgaggtgggtgtagaggtggtgacagccctcgagatcacttaagtcctccctgtccgggtacataatagagagacatctgggaacagcgggttgccagtgcctgaagtattgcgttaggattaaaattaagctttccctagacactatttctcactagtgaatcctctctatcctagtctatcattagc

SEQ ID NO: 50286 - DNA, 1501 bp, Oryza sativa
agctccggtccgacgacgtcgatgcagcaaaagggatggatgctgtggctggtgagaacaaggggaggagaaggcacagcaatgctatcttcagagtttcaggaggaggaaacctgggctcagccattctggttttcttctttttctgggggaatgaatggatgcaaatgtaatatgcaaaaatatatatttgctcatgaatgacacttcggatcatgttatatagtgactactgttagaagaaaatactgatcctcttttccttttttctttttggcagtagtattatgttatctctgtcattcgagtcatgatgaagtgtctggtccagttgatttgaatgtgatatttgcgtcctcttcatggaattcccctgcacccggtcatacggcaatgaaatcttactagtcaacaaaagcaacaagtttttgcttgcatttcgacctcacgcctggtattgtaagaactcagatgtgggtgatctgctgctcatttccagtgtgaaagtcagcaggagctactgatagtctgccctactgaagacggtgtgatttgtgcttgcaaattggggcatattttctgtggctgttcctggtcagacgccaagcacaacggctgtagatgggtttccacgcttttaccatgacttgccacatatgatgccatgtctgacagggagcagcaactgagtggcctgaaaggggattctagatcaaccaaagttgaattctgtgaaatcttgtctgttattttgtacacatgtttgatgttattttcctgctggatttaattttcttaccattcatttccaccacttatctatgtagacgagaaatataacaagagggtgcaaaagtttataccttaagtgaaacctacgtgtgtttccaatgtatatcataatatttcatctacaaaaaggtaaatcatatttcacataaaaaaggtacatcatttttaatcctgcttagctgctgcctgttatagcattttatccttaaaattatttcttcatcactgttgtcaaacctataaacaataataaaccgtttatgaaggcacaaaacttgcactgcagaaaacatctgctatggctggtttcctgaattcgataagcaacaaacatcatctgatattacacatggatacagatagaggaagattgatccaacaaaacaatcgcactgaacaaatctgacgatgccgattgtgacgacagttgcatcccccataagcacagttgaattttcatggagctcttcttccatccgtctctttacatcttccttctcttacttgggtttctgccactctcatcagaacttgattctgacttctgttgttgcattgcaggcattggtactctctcagcgtctcagtgataccaccaagaccgatggaggtgaagaaattgatccagaatcttgtgttcttcggatgatccattagaaagattgaatcaaaataatctttcattttaggatcgctcagtctcttattg

SEQ ID NO: 50287 - DNA, 1501 bp, Oryza sativa
tcgatgcagcaaaagggatggatgctgtggctggtgagaacaaggggaggagaaggcacagcaatgctatcttcagagtttcaggaggaggaaacctgggctcagccattctggttttcttctttttctgggggaatgaatggatgcaaatgtaatatgcaaaaatatatatttgctcatgaatgacacttcggatcatgttatatagtgactactgttagaagaaaatactgatcctcttttccttttttctttttggcagtagtattatgttatctctgtcattcgagtcatgatgaagtgtctggtccagttgatttgaatgtgatatttgcgtcctcttcatggaattcccctgcacccggtcatacggcaatgaaatcttactagtcaacaaaagcaacaagtttttgcttgcatttcgacctcacgcctggtattgtaagaactcagatgtgggtgatctgctgctcatttccagtgtgaaagtcagcaggagctactgatagtctgccctactgaagacggtgtgatttgtgcttgcaaattggggcatattttctgtggctgttcctggtcagacgccaagcacaacggctgtagatgggtttccacgcttttaccatgacttgccacatatgatgccatgtctgacagggagcagcaactgagtggcctgaaaggggattctagatcaaccaaagttgaattctgtgaaatcttgtctgttattttgtacacatgtttgatgttattttcctgctggatttaattttcttaccattcatttccaccacttatctatgtagacgagaaatataacaagagggtgcaaaagtttataccttaagtgaaacctacgtgtgtttccaatgtatatcataatatttcatctacaaaaaggtaaatcatatttcacataaaaaaggtacatcatttttaatcctgcttagctgctgcctgttatagcattttatccttaaaattatttcttcatcactgttgtcaaacctataaacaataataaaccgtttatgaaggcacaaaacttgcactgcagaaaacatctgctatggctggtttcctgaattcgataagcaacaaacatcatctgatattacacatggatacagatagaggaagattgatccaacaaaacaatcgcactgaacaaatctgacgatgccgattgtgacgacagttgcatcccccataagcacagttgaattttcatggagctcttcttccatccgtctctttacatcttccttctcttacttgggtttctgccactctcatcagaacttgattctgacttctgttgttgcattgcaggcattggtactctctcagcgtctcagtgataccaccaagaccgatggaggtgaagaaattgatccagaatcttgtgttcttcggatgatccattagaaagattgaatcaaaataatctttcattttaggatcgctcagtctcttattgagttggcgaattccaagg

SEQ ID NO: 50288 - DNA, 288 bp, Oryza sativa
caagcctaaggaggatgcaaatgcttatttgcagcaattcctgttaagttgtagcacgtataccgtcaaaggactcagactccaactgttgtcgttctccctcctcgggagagcaaaatagtggttctacatcaccgtgcaacggtgaaaacccggaataagcactcaacggcattcctctcatgattcttcccgatgggcaagaccaacgctcttcatggaagaatatttggtttgcagcgaacgagggatgaaaccattcttgaagcttgggaaaggctgcaggaa

SEQ ID NO: 50289 - DNA, 419 bp, Oryza sativa
gcattaaccatgcatctgccggtgtgacttgctgagtactgtggttgtagtcattcttgctcaatcttttccccccttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgtcagccgccttcccctcctctcctcatgggccggccacccggcccaaccctagccgcgcccccgcccgtgcagc

SEQ ID NO: 50290 - DNA, 376 bp, Oryza sativa
ggcaggataacgatcaaacaataagaagtccagcagtaaagccgtttgggaagacgtcaaagcatgtcaagtgggataagttggttcggttgagaaacataattcaaaggcaaagttatcgaccctcgcatggaatagcagaagtagctagcacccggagagcaggaaagctaatatgatgcagttagtgacaagttgtcaaacatggtatgctggataagcgtgatatcatagtccaaagcattcagtggtaagttagaagtaaatgacaagcatgatattctcatgatgacaagcatggtatcctagtaatgacgagctgatctcgacgcatgacatgaagtgggtaacttgtatgaggttgactccgaagata

SEQ ID NO: 50291 - DNA, 890 bp, Oryza sativa
ggggtcgttgcccgccggagttggaccagtacggctcgccggagatgggggaagagacgaagagaagcagtgcacttgagagatgagtccccttatcgaaaaatacaccgaaaaagtcaaaaaaaaaaagaatagaaaaattttgagaggtgcaagcgcaaggctgttagatgggaggactaaattttagttaccgtcggatgtttgattcattagaagtagaaaatgtagattaatgaaaaaacacaatccataacctgaactaattcgcgagacgaatatattgagcataatttatccatgattagtccatgtgataccacagtaaacatgtgctaattatgaattaattaggcttaaaaaaattatctcacgaattagctcttatttatgcaattagttttattattagtttatatttaatcttttaaattagtattcaaacatctgatatgacaggatcagtccctgtatccaaacaccacctatgacatgtaaaaaaatcagctcaaaatacaacatatacacatagaaaaaatgacaaatctcagtggaatagaaaactgatttgtttaaatactattggagaacaaaattgtttctttttctcattgtgcacattgtattttgagttgatgttttgtgtgatggcaaatgtcatagtgtttcacatctcgaattttttttcatattgtttttgacttttttgatgtattttttttaggttggtaatatgtagcacgctactgtgcggtagtacctgatattctccacgtgggtgtgacttcttggttgcttgcagcaagcttttgtgacttttcctcatattttctccatgtgtgacttcttggttgcttgttgccttgcttgttgcttgtgctctcctcagt

SEQ ID NO: 50292 - DNA, 228 bp, Oryza sativa
agcaaggttcgtgtggtccacggctttgattattaatattgtgaagctctaagatcgtctttataaaatagctttgggcaactaagtgacttttaaatgctgttactgcaaaacctaacccctattattatccccttgacccccctgcattaatcatgcatctgccggtgtgacttgttgagtactgtggttgtactcattcttgctcaatcttttccccccttcagt

SEQ ID NO: 50293 - DNA, 308 bp, Oryza sativa
atctatccgctctggtttgattcgatgcccaaattaccagtttccgaataggagtcgtaggaggagtaaattttaatttcttcctagtttccgactaggatgggggccatggtgcgatagatatgcgttatactccctccatttcctaatagatggcatcacaacaaaataaattataattacgtaaatttttttataagacgaatggtaaaacgtgtaacaaaaagttaacggtgtaaactatcactacaccagatcctcacacctctgacgggataactgtgataggcaaacgaaatggtcactga

SEQ ID NO: 50294 - DNA, 177 bp, Oryza sativa
tttttggcagcacggtgatgatttaaaccacgtatgatcaagccctaggagcttaacataaagttggcaaggatagagtgggcctggtgcaaaatgggcctaaataatgtcataacccaaattaatttgctgaccggcccatgcattcccaactcctaaccttgctttattcgtaga

SEQ ID NO: 50295 - DNA, 606 bp, Oryza sativa
aaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttctttcgcgaaaacggactctccggaaacgacggaatctaagcaaaaagaagcaaaatcaccaaaacagcacataaacaagcatgaacagtacatgtggatatttttaatgtgtagatcttaattttagaaaaatttagagacttgaaccaactaaatcggagctaagatgaattagttatgaatttttaaagattaaatcggattaaaacacttaaatcgattaaaattgaattatgacgcaataatgaattatttttgaaaaggaaaaagggattattgcgtcagcgggctagggtttggtggaccgggcgcacgggcggcggttcacacgaacggacggccgagattgatccgatccaaatcggacggccgagatcgatcgggtccacggcggttcacggcggacggccttgatgacgccagcaa

SEQ ID NO: 50296 - DNA, 204 bp, Oryza sativa
tcgacatttgatgtcgcgattccggtatttgcatagtatgaggattgttggtactaagatatacgtgagactgaggtaaaagagatagagacgaggatttttatacaggttcgggcccctgaattatcaggtaataaccctacatcctgttggccgaagccggtcgttgatcttattcatcataatcacaccagtacaatattt

SEQ ID NO: 50297 - DNA, 157 bp, Oryza sativa
cgagcacgacatgatgccgacgactcgcaagatacagccaactcccatggtgacgtcattgaccaggttggcaacttgccattcaatcgagtagacatgtccaataaaatcaagtcagtggtaaagggcatacatgacttgtgtacgtgtatatcta

SEQ ID NO: 50298 - DNA, 352 bp, Oryza sativa
tgcacccccagcaattgtttcagttatattctgaactcagaacatgacatcacagactgatattcaaggagctaaatctaattacaactgatattccaggtttcacaaggcctgttcttcaggtgcattgctatctagaatcagagtttatacgcgaaacaaagagatgtacaccatgttttttatccaatgcaggtttctggagccccaaattaggggctgagcagcatgtacaatgttgattgattactgtcaagctaccaaggacacaaatttctctgcaactccacccaaaaatacagtttcaagatcatttcccgtcagctaaggcacctaaaattctctctcaagc

SEQ ID NO: 50299 - DNA, 839 bp, Oryza sativa
tttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtatgaatccaattccacaacaatccaacaaatccaatgtgtccaagtgatatgaatattaccacaatctagagttttaaaaccacctaatgttacctaattaatcagcgaagcatctacctaaaatcatactagtgataccacgagtagagtgtccactagttgggggttttgtttatcctagggtgaacaaggtaataataacaataacaataataataaggtcataacaaaggtaaataggcatggctaaataaaacagtgataacgcgggaatttaaataaagcgatgatgcaataatttaaatcaaaataatttcataaattgggattcaatatgttcaaggatgatgtgtcttgccttgctcgctttcccaaatgccggcttcaacttccacgaagagcggatcctccgaagctgcagcgtctacacgaccaacggaaaagaaaaggcttttactctaacaaactccatataaaaagcattaacaaagcacataaatgggttcttgacttcttaaggaaaaattagagacttgaacggtccaattccgagttcaaatggccaagttatagccatttgaagtttatatgctcttaaatgaatatttgcgaatttcttcatttaaattttaatctaaaattggatttattgcgtc

SEQ ID NO: 50300 - DNA, 474 bp, Oryza sativa
cggaaacggcatatccggcagcacaatgtttggtgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggtaggctgccatttgtgctgtgaacagttttgcagaatgcgatgccattgttctttcgcaccaaagaggaattgccacttgcgatctcaggatgcgatgctgcctatatatctgtcgaaaca

SEQ ID NO: 50301 - DNA, 841 bp, Oryza sativa
agccgcgtgcacccggtccaccgtggaccgtgagaaaaccgagtgggccccactcccgtggacccggtccgcgtgcccctcccctcggctgacgcaataaatccaattttagattaaaatttaaatgaagaaattcgcaaatattcatttaagagcatataaacttcaaatggctataacttggccatttgaactcggaattggaccgttcaagtctctaatttttccttaagaagtcaagaacccatttatgtgctttgttaatgctttttatatggagtttgttagagtaaaagccttttcttttccgttggtcgtgtagacgctgcagcttcggaggatccgctcttcgtggaagttgaagccggcatttgggaaagcgagcaaggcaagacacatcatccttgaacatattgaatcccaatttatgaaattattttgatttaaattattgcatcatcgctttatttaaattcccgcgttatcactgttttatttagccatgcctatttacctttgttatgaccttattattattgttattgttattattaccttgttcaccctaggataaacaaaacccccaactagtggacactctactcgtggtatcactagtatgattttaggtagatgcttcgctgattaattaggtaacattaggtggttttaaaactctagattgtggtaatattcatatcacttggacacattggatttgttggattgttgtggaattggattcataccgccccctctattcaaaatccccaaaatggttttaggctgggctcggggtgcatggttttgatagtagcacctcggccatataaggaccggt

SEQ ID NO: 50302 - DNA, 667 bp, Oryza sativa
attcctgcagccctaaaggaaatatttggatggactcaaaaggattgtaaaggaaatatgacaacatagtatatcaataggcctaaggagattagtagaattgttgatggcagcagcaagcaaacatagcaaatgtagaagaaaaaagtagatctgttgatggaatacgattagaggctaacaaatcaacactactctttgtgggtaggactgtgagactgagaccctagatgcttcatccaaatcatggcatatcaatggaagagaaccatttcgaactaaaggttgaagatcatctactaatcaagaagccaatttcaattagaaatatcccaagtaatccactggtttatgctattgctgtgttgcagcacatgatagaagcatgatgcgggaggttttagaacttgtgccaactgatcttaggtataaatcaaggagctagcagtgcacaaaatgatgatgagcaatcaagcttatagcatggcaatctgatactagcaaaatataggataggaaacaaaggatgttgatgatagtgcacaaaatggagttccaggacaacaagcagaggctcaaactgaagcctaaatgcaacagatccacttagatttggtgagaatgtagaagaaagcagaggagtttcctcagctgcttgaggatgaaa

SEQ ID NO: 50303 - DNA, 309 bp, Oryza sativa
tccatgtccttaccaaccacaaaagattggtggaggcaatggacagtattgaacaagaagattttggcacagaatcaacatatagccatgtgacgaatgccatgacgtcatgaggcagacatcaaacatgagtagtttgtttcatccaagcaatcaagcctggttactggtacaaatagaatcatcagggactcagagccaatctgaagtctgcaacttatacgtccagcaccaaacactcaaacccaattaaccccagctgcagctggcaccatctttctcgatctgcaggcggaggagatccatcca

SEQ ID NO: 50304 - DNA, 407 bp, Oryza sativa
tcgcagctatgtgcattcactcgatagtttgatccagcatttcaatatctcaccagtgcttctaagctactctcatgaatgagtatgctagacgactaggcgcgtgagcatttagaaggttatggtgcacaccgtacctcttgcagagcaagaagtatcagcaagaatgggtattttcaactatgattgactaagaaaatgaccaagagagtacggtattcggtgcgccgaacttgcaccaggtaccatggacactctcaatgattctacccgagcgtcacaaaagtcgtactcaagcatcactagtgcacatttataggtgacttatgatggttgtatggtggttaaacactcacaatacacattgggagcgaaccaggaatccacgcgtggatggccaacttcca

SEQ ID NO: 50305 - DNA, 321 bp, Oryza sativa
gatctaatgatctgctgtctccgtaccatgcattatcagcatttagattgatggactagatatcaaatatgcaccattatattttacaaagtgatgcttggatggttttgtatgttttctactcttcatggagacaactatttttatatcacaggagacaactactttcatcactactctaaacattttgataatgtgcttactgaatcacttgaatgcattttattgtgaaaatatcttgtatttgctactgttcctctcatactatttctgtattctgggtgattataaatttttatgttgtcaccttttttggacagg

SEQ ID NO: 50306 - DNA, 284 bp, Oryza sativa
gctatttttttcgtaaaaaaagaatgcatctttttcctgtttcactggttaaaagttccattcaagttctgagcataatacactgaagatcttcagaagggagaaaaataaattagttcttcagaaatagatagccagattgttattataacgcaagaagcatcacatggatgtgcaaccaacatctatctaaagactgcaatctaggatacagaatgaatttatcttcatattccggaaagcaggtttgttaattaatctctttggaatttctgtggcttgta

SEQ ID NO: 50307 - DNA, 668 bp, Oryza sativa
aacaatggcagggatatgcaagataattggggatagctgtgctcaacatcgacatcttcgtcgagacacgaggagggatcaacatgaccattataaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatatttatgttcccatgtattatgctgacattttgttcaacaaactgcaatgtttaaaacaagataccagagctgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggacatgaagaagcaacatgctatgtttttgtcttctattactaaccatttgcagg

SEQ ID NO: 50308 - DNA, 276 bp, Oryza sativa
gataaacaaaaccccaactagtgggtactctattcatggttccactagtatgaatttaggtagatgcttcgctgattaataggacaacattaggtggttttataattttagactttgggaatattcatatcatttggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 50309 - DNA, 293 bp, Oryza sativa
cgctctcccgttcttcccacgccggcttgagctccgccgcccaccggcgtcctccaaccacgagccaccgcggctcctgtcgttgccgtgctacgccaccgccaccaccggctttcaagtggcgggaccaaagagtagtctaggtaggcccaggactaccctataatttggcccagataagaacaggtatttatttttcttggcccataagaaagcctggcccaacaaaagaaaactctaactctcttatctcccctctccacttactctcctggcctcccactcccgacagg

SEQ ID NO: 50310 - DNA, 330 bp, Oryza sativa
tgtgggtgtgtcttgttgagtacggtggttgtactcagtcttgctcaatttttcccaagcccagaagaggagctccttgaagatgaaggctttggtgtctagctcgtgcctgccgtcaagtgcctgtggtcgtcgccctagtcttccgctgtttctcgtttgtctttgtgtgtgctgggccttcgctgcccatgtaataaattaactatttacgcttccgcttgttaaactctgatttgtatcaacttttgctgtaccttgcctcctgggacaaggattaatgcacgcacgtaaggaatgcccgttgggttatttccggtcgtgacacac

SEQ ID NO: 50311 - DNA, 1501 bp, Oryza sativa
cttttgctgttatgatgtatgttaggcactatctgcaagttgattaagcaaacaacctagacatggttacatcacaccccactgatgcaaaccacgcgctacacacacaaacaaggaaacacacgactaacgactctaccctagagggtggcttaggttctgcgacgggttctccaagatcttcactcctgcttcacagctggcttcactgcttcctccacttcactagcagatcctgcagtcttccggagcttcggcgaacaactgacgatgtcttcttcttcactgacctgaccatctagtactagttgaaatccgaagaaggaagaacggagtaaaccttttgcaaatagcattaggggaaggagaaaaaggaactttcgcaaataatttttatttataaaatatgtccttgggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgacaatatttacattattacaaaggcacttaaggcctgacaatcaaaaataaacagcagcggactagcgggcctacggctccatcttcacaggcgctcaactggggtataagccaggactccccctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacataacccttcacccatcctagccgtgaacaaaagtaccgacccaaccctgcctacggccggtatcccgggacaggcaggccagggttgagcccctagcaacaagatctagaccgggtgcgccacacacataggggtgagaccacccgcgtactagtccagtgccatggcatctcgactaacgggcaccgacccgtgtagtcttcatttgcctagacatctcgattaccgagccgcagctcgcgtagccttcatttgcctcaga

SEQ ID NO: 50312 - DNA, 248 bp, Oryza sativa
tcctccgtgacgtggacaccgtcgcttatcgccgcctcatcacacgagccgtctgcgccattgcggccgacgatctgtccgcgccccccccgccccggtacactccgggcaactccgggcattcgcaggccagggtttgtcctgctgctctcctactctcgatcttgccttacttatgtgctgcttagggtgtgtacatttctcgtcttctattggttatctgaggctgccctttttttttgcctgca

SEQ ID NO: 50313 - DNA, 1501 bp, Oryza sativa
ttgccgaatttcctcatttttgttatttttttcaatattttgttcgaaatttccaaaatttcgttgaccccttcccctcagcgaggttacctcgccccaatgccaccgagagaagatgaatcaattcttggtgaaatccgagagtgagtttttgatttttgttcttgattggattaggggattggttgcatttgttcttgattttaattttgtttttgctcatggtgtatgtcatataggttgatgaccaggttaatattttcacgcaggagtcaggtcaattgaaacagccatccactatttgccactctcttagttcctatttggatggttagtccctcccatccaaacaaccccttagatatgacaaatataacttactgttaagtaagggtaaatagtacatgtgcagtctcaaaaggtatgctaggcacaataaacaaattagtagtactagtacgttttcttttatctttttaatcctgacaggaactggttgatcactcaaagtataagtatatatatttactttcggatagctggtattccttggttgtctcggaaaaagagaaatcctctatatttgtggataaactaatggagcaaagtcccctatatttctagatagagggagtacatcttataaatatatgagagctcaactatcattgacacatgcatggtaaatatttgacaaataattaaatacccctccaaagctgatgagtgacttaattctaccctataattcaacaaatggttttactcattcatcattcatcatatcatatatccaatggtccaaaatcaattgatgaagtcgatcggacggctccgatcgataacaaatgacgcccctccctccctccccaccagtattgcgcaagacgcgtccccaccccgctcgcggcgcagatcgcgcaactccccttcaaaaaaaaaaaaaaactgcaaaatctcaatgaatctttcgccgtctccgaggcttgcacaactcttcttcctcatcttccgcggcggcggcggcggcgccggcgacggccatggcggcggtggcggcggcggagcaaagcgcggagcagttcaggggccaggcgaagctcctgttcctccccgtcgccgacgctgtcccccgcctttcctccttccgtccacctgccaccgacgccgccacccctggcagtgactcctcctacccgacgccgacgtcgattcccccgccgccaacgtcactgccatcgacacctactcctgtggcagtgtggaggactgttgcttccgttgataatgcatccccgccatcgcgcctcagatcggggacaccgacggccctcatgccgaccgcgccgctgcgcctccagatcgacgctgccgacgcccatcacacgcaccaccaggtaatcgtcgtgccgcgccgcatcccgcccctccgccgtcgtcgcatcccgcgaccccggcggctactccgctgcaacccctgtgcggcaggcgaccccgatgg

SEQ ID NO: 50314 - DNA, 394 bp, Oryza sativa
cttttaattaaaccaaactaatggcacatgcacttcataatctcttttaatggttctcattcaaaatttattccagtgttattagtactgtacatctattactgtactaatggctcatttaccagcaaaagttgtacaatactgttttatttaatcttgctgcaataaaataaatttagtatgttgatgttatgactttcttttgaaaccagttattcaaaattacaaaatttgtgacctcgtttccaactgttttaatttatttcgcaaagcttggtttactttatttacttacctctttactctgattttctaactttattcaaattaatccaaaaacttgtgctattaattggataaaggtcttaactccctcctttcacttgtctttaga

SEQ ID NO: 50315 - DNA, 1501 bp, Oryza sativa
taagatgaaagtttttccttattcacatcaactatctgatttgcatttatttttgttcatagagattaaatttgttccaagagagtgcaaaatctgtcatgtagcatttatcgttcgacaacatataagttggatccgaatagatgatttagatcttttctttcactactctgctttggagcaaataaatatttttcgtcatcttgttttgtttgtgctatgacgaagtgtattatcttcttgattttcttacttgcagtgtcctattgttgttaagggcgacaacactcttgcatggatgatggttcaatggaaaaattaggaattgcagcaccgacaaaagttcacctattgcactggtgcaattttgtaattaagatattgtcccatgatgaaatgcatgtttgtactgtgtgacgattttaaattaaatgtattaccatgttaatagtaatgtagtattaagggttgattaattatttttgtttgaaaagtttagcctaggtttggtaaattgaaatttaccatgttactatgacatgtatgagaatttacagattattttttgggccaaatatattacaatatatatcattgtttggtttttcagattttgacattagtttgctaaaatatgtatcttttagcatttggttgtttactttgcattactaaaagattaacaatacgccgttgtgttagcacgggtatattactagtttacactagttttcgaagttaagggtgcatcttatattcatatccagtcctatggttgtcggatgtggtagtgaactttttcctaaggggtgcgcaacatgttgtcgaatttttttcggatttagattttttttttaatatttacagaaataatctatcgaccaaaaaaaattgcagaaatagcccctgccgcccacctctggggcggcaagctgacgtggcaaacgggggaggaacgggcagtgacggagggagggttttttttgcaggaaaacccttgccgccctttggtggggcggcaaggggcccgaatgcaaaaaagccagtcagggccggctattttgcaggcggccccttgccgccctctggccgggcggcaggcctcgctgcctataaaaggcctgctgcccagcccctagccctcattcttctctcctcaattccagtgaaaaaaaaagaagagaggggaggagaagagaagaaggggcgaagccctcccggattcagacgccgatttcaggtaatattcatagatcctatatgtgactattgagttaaatagtgtgtattctttaaaaatttgtttgaataaatgcattatatttttagggttttagttgtagtaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 50316 - DNA, 388 bp, Oryza sativa
agccattctgtctgacctatctaacatctgtgcttcatatttcctttgttcacacttcttttccttgtttttcaaagaatgtacgacatgtcgatctattagcactttgcagtcccatgatctcacatgcacatgttgctgctttcattacccctgtctatcccaattccatttcctagttttgttggatcaacattgaggctgagccagagtaccaggataatgtaatttgttccgagtaggagtttgtaaccacattccaatttatattgtgaacagctgttctttgcttaatattttgttagaatattagtttgtcaaaacttccagaccaaaatccacatgttagcattctaaattcttggacttgttctcttttttggtcaga

SEQ ID NO: 50317 - DNA, 1501 bp, Oryza sativa
aaggttctgagttcaaatcttcacaggagcgaattttagattgagttatttgagggctaagttcctaatttaaaaaaactgcatatatccagttgaatgtagaggccaggtaaaaatactcttatctaaaaaaaaaaagctatggatgtatctctgaaatggcaaaagtaaagcagatgagatgaaacaaagttgcaagaagattggtgatgctagctatagactatagtagtaccataagccgatgctagttcatacaattttcatcaccagaagcaaaactccgatggatgtatctctgaaatggcaaaagtaaagcagatgagatgaaacaaagttgcaacaagattggtgatgctagctatagtagtaccataagccgatgctagttcatacaattttcatcaccagaagcaaaactccgatgtctcgcggattagtatatgtttacattacattcatgttggtgcctagcaaacatgaacatgacaaaattttgaaggaaaacttgccgaatctgaagatgacaaaactgaagagcagcttgcctaactgatgatataacccaagaaccaatccctgatgaaactgtcctccccaccctattccaaagtttccaagctatatccccgcctccgcggctcgccgcggcgtgctcttacgccggctgccattctgccggaagccattggacctggtggattcatcgttgctggaccgggtgcttgagctgttctcctcaaggtcaaggtttgagctttcttcctccttgggcagcctgttcctcttgttgcccttccctgcagagctcttctccgttcttgacaccttcggcttcgcaccgccgtcttctccttcgccttgttggtagtcagcatcaccgtcgtcgccctcggttagattcttggcctctgcttgatccaccaccttgtcgacaatgcgcttctgcggccttcccctcctcttcctcgcaggcacaacctcctcgccgctgctgcccttgtcctcatggctcctgccattggtgagcttcctccctctgcctcttcccctacccatggatttcaatccagcagattacttctctatctgattaaatctagctggagttggattgggcaattactgggaacagaaagatgctactgctgcagctgcagctgcttctgttatctgattacttcttgttattttcttggaatcagtttatctgattgattcttggaagcagaatatttcacttctcagtcagttctcctagtttgatttgtgatactgcagcaagaaataagatagaaatctgcaagaaaagcatacaagaacttactcttactgtaacaagctattggaacagtatatttcagattatcagatatctctgggggaatcgatttattaagcataaatgaagtgtctcatattgagatccatagaacttgacaagttcagacaacaaatatccccattaaactcaggttggaatacatcaaccaatatacta

SEQ ID NO: 50318 - DNA, 1501 bp, Oryza sativa
ctgcattgaaatttgatagaacaatatatacttcttcattcatacgttcgtttagaaaaggatgatacatgtaaaatatgaagtcaagaactgtaaaacctccaaaatatactattcttatgcgctaacattgtactgttgcagtggaaagagaaaaatgctgctctgttgaatcttgagttcctgtcttctgctttttcagaaggccctaaccataaacctttgtttcggttttgtctaaccagatgaagtgaaggccctaaccatgaactatccgaccattgtcagtgttttgtcagtcacccccatcatcatctgtcgtcatggtaacagtcataacagagcaaacctgatggcagatgcgcagaagctgatgaatgcctcaagctttcaacacatccaaggctgttcactcaatcaaagaagcttctgtaccatgtcctaccaccttcttgattgcaggcagtacaaggaatggtgcttcctttcttcagatcacatgatctgcaaggttaatgaccaggcagaggttcccaaatttgcaatagcctataagcatgcattgccctaataaacgactcactgcacaagcagctcatggcctgctggaacacagccaacatgcttaacatgcgagctcaatctgtcaaccatctcagatatctggtctgaatcttggtgctttctatcccccacggtgaactcatggaacgtctcattgagttcgacccagcttgatcctgctgttttctgcgacccagttcctttcatctgcatccttgcctttgccatgtcactccactgcccagcctcagcatagatgttcgagaggacagcatagttccctgcattcgacggctgcagcttgctcaactcgttcactgctatttctgcatactccacattcttatgcagtcggcatgcactgagaagggatccccatataacctcattaggctcccaaggcatgcttttgatgaggtcgacagcttccttgatgagccctccacggccaagaaggtcgatcatacaaccgtaatgctctatctgaggcatgatgccataatccctctccatgttggagaaatgccggcggccctcatccacaaaccccatgtgtgtgcatgcactaagaacattgatcattgtcacagcatcagggttaaatccctgttgcttcatttgagcaaagagctccagtgccttgtctccatgcccatgcattgcaaaacctccaatgatgctgttccatgacaccgaatccttctgaacagtctcagtgtcaaagacataatccgctcggttcacacacccacatttgcaaaacatgtcaatcagtgcattgcacacatgggttgatctccctagattcctctttcgcacgtatcggtgaatcctctttccaagtgaaagagagcctgactctgcacacgcagccaggatactcacaaccgcggcaacatcaagttccacggaagcctccttcatctgagcaaacaac

SEQ ID NO: 50319 - DNA, 1034 bp, Oryza sativa
tctatagccaaaaagatttggtagtgattagctttgtaatgtgacaggaggcagcaattacaaaaaccagggaactcaagaagctctgcgagacaacgctatcaactgtatttgatggcaggccggtgcatataattggagagatcaatactttactaagttcgagtgttagtcaattagctggatgactgtactagccggatgactgtacctgaaataagatgagattgaaagctggttgattacatcaaggttcatactttaacaacttgtctggttgtacttgggttatttttgctgcctgaatcaaatgttcttttgtgtatgattgctgccccggagtgggtgataaagactgaagatggcgaagttaaatatgttgtggagaaaaattccattgctaacaagcagatatcaatggtttgaatatcaaataatcgatatcttaatatcaatgatttgaatagtttatgtttgttgctgtgctatgtagcgagtttgtgtagaatatacccccctatggggttaattagatacatgctactataaatttcacggtacaatagcaagtggttatctgatacttcaaactagtattgtacatcttaaaattactataaatttcacggtacaatagcaagtggttatctgatacttcaaactagtattgtacatcttaaaattagaattctatgaagttccgctccagtattgtgttagaaaaagtagctagttctgcgatgttacagtccagtttgctgcatcttaccacaaagagagttactttggtactactgctgaagcttggacaacacaacacgatctatatatatatagtgtaaattttgataccttctggcacctctacggtgtcaaggtactaccacatattaacagtttaacactacaatctgtgatattttccggtaactttttagtaccataaatttactccaatttatacattacactaggaatatttctccctcaaaagctgtatagattcatactgttaacaacgcacacttcagtta

SEQ ID NO: 50320 - DNA, 574 bp, Oryza sativa
tctatagccaaaaagatttggtagtgattagctttgtaatgtgacaggaggcagcaattacaaaaaccagggaactcaagaagctctgcgagacaacgctatcaactgtatttgatggcaggccggtgcatataattggagagatcaatactttactaagttcgagtgttagtcaattagctggatgactgtactagccggatgactgtacctgaaataagatgagattgaaagctggttgattacatcaaggttcatactttaacaacttgtctggttgtacttgggttatttttgctgcctgaatcaaatgttcttttgtgtatgattgctgccccggagtgggtgataaagactgaagatggcgaagttaaatatgttgtggagaaaaattccattgctaacaagcagatatcaatggtttgaatatcaaataatcgatatcttaatatcaatgatttgaatagtttatgtttgttgctgtgctatgtagcgagtttgtgtagaatatacccccctatggggttaattagatacatgctactataaatttcacggtacaatagcaagtggt

SEQ ID NO: 50321 - DNA, 1501 bp, Oryza sativa
ttattagaaaagcataccgacaatgtagcgttctcgatatattttccagcattgtttctttccgcctttttacgtaaggtattttcgaaaacaaattatacacaatcaacaacatatgtgtcgtttatcgcgatggtaatggatacgtttaatccttttttaattgcttccaagtaccaatataatcacactcttcacgaccctcccacatttcttactcatccttacaccatctcagccacccaacgcacgatccgacggtccacaatccatcaacagcacaaggtgcggttctaccacagccgcagaggcatacaaagctcatcacggccgtccagatccgatcggacggtgggggatcgctccaaccccaaccatttctctctataaaagccggccatggcggccacaagccaagctcaccgccaccactccattgccatcttcttccacctccagcctcctcctccgcctccaatggagcttcccctggacaaggccgcggcccgctccaccccactcgcgctccccgccgctggggcggcggcggcggcgaaccagtccccggcgtctctgccactgggaccacccgcggccgcctccgccaagcccctcgtcgcggccgccaacccgccgctgctgccggtggtggctccggcggcggcggcgcccaagtcgtcgtcagggtgagctgtgtgtggtgtggggttttgctgtgttcttgtgtgttctttggtggttctgaatttgcttggtttcttggaggaaaaacttgtgagaaaattgcactgcgagatgggggcaggtttggatgttttggtatccaaagctgcactcctctgtagttcgcagttaaagttgcagcagaatactttgcgtttgcatttctttttcgctgatcgaaacgatctcatgtgttcttggttgtgcttgctcttgatcatgccgatgatcctagtgacatccaggggtagagatctattttggcttcctcgaaagcccggttgatgatctctcggtgtcttggagaggcaaccatgctgcagagtacgtgtgttcttgggtttctttggatgttcttggaggaggagaacttgagaagttgttgcactgtgagatggacagctttgggtgttttaatatccaaagctggactcctcttttcgcagttaaagttgcagcggcagatgctctctcttcgtttgcgtttcttctgcgttgagatctcgtgttcttggttgggtaacgaagctgcatatatatgcttttcatgccgatccatgcatcgaacggtagagatctcttgggttcatcggaagcccggttgatgtgatgatctctctcggtttcttggacgcaaacgcgtgcatgcagcgttgcagtagtacgtgtgatgttccagggtttcttttggttggtttgagttgagacttgagaacgatcgatcgacgactaaaggcttgaacaggttggatttctgccgtcttttggttgcatggag

SEQ ID NO: 50322 - DNA, 334 bp, Oryza sativa
aattcatcagcaggacatgcaagttaatcagataattaatgagtgaatggcatgataaatccagtcctcaaaacataataaatctcgctcagtaatcaataaaacgaagcgatccattccaagattccaggatacataaaacatagtgataactaataatcaattactaattgattcaatcaaatcgtgatcaaacagtgctatcatatcaacaccatctcatcagtaaaaagaaaaaaataacccccgaaactttgagtacttgatgaacacaagaacaacacacacacagcgggcaagaaacccaaagactcaccgccgccgcctccctagc

SEQ ID NO: 50323 - DNA, 356 bp, Oryza sativa
taagcatagctaattctccattattttagttatattgatggtcgaaatttgtcggtaacgaccgtcaacaaccccaacacccatgtgatcgttctccccctcttaccaagaacaatggggttttgtttattagagttagcaacttgatacttgcattcagcgcgcgtgttggctaaattgtctgtctgtttgtcttcggaaccccaccatattgtgatttcttcatagtgaaactttcatattcatttagtgtttgttctacttgttcttcgattgcttgcaggaagagtgacctcgttgcctggttgttgtgcaccacaagctcgcgacaacagacgttgtattggttgctaagg

SEQ ID NO: 50324 - DNA, 606 bp, Oryza sativa
tttctgtccttaggattcaaacctctgttcatattttctttgttccaaaggagcaccaagcctttgatgcataatagaaatggattgtagtttaatttgttacgtaaaatttgcattattagttaagatttgaatttgaaaaccattgataatatattcacaattcatgtgtatctcctcaatggccatcgatccatggccagggcattgaatatatctctctcatatctagaggcacggggatgggaaggggttaggcctccttcaacttctgaaattttgcactactgtattataattgcatattttgtaaaattttagaggatttacatttttcgctctaacaaataaattctagtgtttctaaagatcagcctaagttgattcctaccactcaaaactcgtcctaaataagttgatcaacgcacatgcgaggtagctaaacagaactccattaatttctttagccgatcggtcggcatgcatgattgcatacatgctcactttctatctcccaaacctgacctggcccacctgtcgataactttggcagacaatatatatggcttttttagcctaagatcttcctactctctgatttaacat

SEQ ID NO: 50325 - DNA, 1501 bp, Oryza sativa
cctgatacagcctccagccccacacacccacgctccccaccaggtccataataagcagttaaaatttaactcaccgacgaccaatctccaatccacccctagccgtagtagtaatttttttacttgcattttgcactgcctatatatgtatttgtatccagcaataagcccgtaaccattcaaacctccaattcccgaaatttttggatccatcccagcacccagccgtagaatgccctaccggcacctcaccgccacgccgtcgtgatcgtcgtgttcgcggcgggatccgcagtaggcaacgtgcgacgagatccaagccgtgagcggtgataagttgcgagacttggtggcggatcggtatccggctctacccgtcggcattgccggtgtcaaattgaattggtgcggcgcccgcaacaatgttttcccaagtgcttgccttgatggcgggcgtacgcgccgggccacagggatggaggcggttcaggactcggagaaatagatgtgcctcatccttcatcttggatttacgcagcagttgcgcgtacatgcatggtcggggatgctgagggtgccatacatgatcccggtgctgaggggcatggcggcgagcgctggcattgtctgtgagtaggccgggctctacggccggatatggcttgttttttgcgaagcaactagcgaatggtgcagtcgacaatcgatctgcgcagcccctaccatcactggatgtcgctccctaggagcgtgccatggaacttccatgagcaggaggatcgatgaagagcgtcagccttggtgccatgccggccatcctctatgacatcgacggtgcccccgcgggctgcgtggcctcgttgcctgctgtagtggttccatggatacagtgccatcattaagtgagtaataaaatatttattcaacaatcaatgagttattaactataataatgcaaaaaggatgtaacaaaaatattactattgttaacacacggaaactggtgtgaaaaatatacggggagtaatatcgagcccctaagttaactaagtttaaatagaggggagtaaaatttaactaacttgtggggagtaaaattttaactaagtttaaatagaggtgagtaaaatttaactaacttgtggggagtaaaattttaactaggtagatatacaggtctgattttgctatggaattttttactggaattaatactaccggatgtaagtgggaaaaagattaacaaaataattttattagtgagaatggaccaactgcagtaaatattttacttaacacaggctagcatctggagtgctgcatgtggaacggataagtcggaaggaggtgggaggaaaaaaaagaaaagaatagcggtactgcgaagggagttaaaaacgggaaaagcggaggaggagagggaggggggcgactgttactcgcgttacgaaactcgatggcgcgtacgggcgctacgtagcatcaccgtatatatatatgt

SEQ ID NO: 50326 - DNA, 504 bp, Oryza sativa
tgcagccctccgaaagattgatctcatggcacaacttgaagaatgcaatgctaaattggccttggaaacacagaagctagccaatctcccaaaagcaatcgaagagaaaaaatcatgacttaaatcggccatcaaaaatgttgctgatttaaccaagtctgtgaaggttatcccaggaaccgatgcccaagacatccaagaagtagaggaaattagacaatgacctatatcggctatcctgcaatacctctctaaatgattggctttgtaataagacttagcttgaaactcatttttgtaatcggctatttgtagtctaactcttaatccatctgccgattaatataattttcgcgttgaaaatccactttttttttcatatatctgcccccctaattttgcaatgacgaaggcattgataaaattataacttgtactaagggcgatatagcaaatatcggccatcatacatcggcaaaacaccatcgattataataatacaga

SEQ ID NO: 50327 - DNA, 305 bp, Oryza sativa
actagaggatcccccccatgtgactggccttgagcttcttcaaacgcttctgaaccttcctcaacgaaaacgctctcctccagaacgtcagaaactaaagcaaatgaacaaaatcaacaaaacagtacaaaaacaagcataaacagaacatgtggatatttttaacatgtagatctcgattttagatgaatttagcaacttgaaccactcgaatccgagttacgatgatttagttatgaatttctgaagtttaatcagattttcatcaaatacagaaaattattacgaattaaataaaagattta

SEQ ID NO: 50328 - DNA, 1501 bp, Oryza sativa
acatcctctctccgaccattgatgagccatcagaactcccagttgatttgatcgctgcaacaacatacaaaaggtaacttagtttggcagtacaattatacaaggacaacagcatatgaaaaatgttggatattatcctttgatataacgtttctactaataagtatacggaatgtagcatcatactttaaatgagccatcaaaaatgccagtttgatcgctgcaataacatagaaaaggtaacttagtttggtggtatctacaaggacaacagaatatatgaagaaaccttagagattatactgtgatataacgtttgtagtaataaatatacggcaatgtagcatcatacttttgatccccaaagacagggatacgaatccaagtttgatgaccaccaacaatagaaaacattcatgtgaatagtccagcatacataaggtattgcattaaacaaagccgtatgatctgtagtgacacttgtgtataaccaaagtagtaggattaaaacggaagcaaaaccttacttttgtctacgcttttgtgctttgtcagtttgatttcacacatgatgtgcaaattatcatgtgttttgtgaggttaaattttggatatggtccagggaatatatatatatatatatatatatatatatatatatatatatatatatatatatatatatatatatatatacatactagtacaacctgtcaggtgtgggcctactatgaggcaaaaaggttaaagtgagaggaacgactgatatatctttgtgcatatgcattgcctcattatggtaatttaaaacaacatctctaacgttctgatacaggagggtataatataatattatataatccatcaaaggtttcgataatgagtagaaagataatgtgtagtgtacaggggcagattatgctgccttctagtttttcatagtacaagcagttatatgaatatttaattggaatgcttatttttaagtagcattttctgtttcatcagaccattttatcctctctccaactgctaagcaatattgagcttcatttttgagagattatcacttatcactccatctacacttgttgacaatgacaagcattaaatcttcaaatgactttgctaaaattaaagccccaaacaaaacaataagacgaccgaaaagccttgcaagcaagttggagttactattagctgataattgatggaattactgaagcagttgagcacaatgcgtagctagctgacttattttatacgcatcaccctaacaacccaagctgccctgccgcgtctcatctcactgtcctctgctccaaaccacccttcctacatgcacccccccacaggtgctatatatgccaccccatgcccgcctcttctcgccacccacaaccaagagaagtagaaacaaacagagagcaattctcttctcctacctagcaacctagtgcagtgcagtgcagtgcagcgaaggtttacttggcgacttcca

SEQ ID NO: 50329 - DNA, 1501 bp, Oryza sativa
ctcagatattggaggagcagcaggcagagagtctaatttgtggtagagaataaaaaatcacccagagaaaaaactatttgaaataagcatagacatccacaaacgtcttttgaagatacacatgcatagatctatttgattcatccccaacagagagctatagaagcatagagtccaaagaaatacaagaaaataaaaagggcaagtaaatgctagtaagagtttgatgtgcgatggagctcttgctttgtcgcacaggacaagcaagactagaacacctcgctgctgcagtgcagctagcatccgatggttggaagcttggatgtggtaacggcggagcgagagcgacgcagacgcttgtgtaatgttgcctttgatccggcgacgacggcgcggcacttctgctgcttggcgtggctcgtgcaggcgtgctaccttgaggacggcgacggcatggatgcgtcagtgcagtgcggaggaagggactggaggagtgcgtatttggatctgagaggaggggtgtgctagggtttcactagaatatatatgtggaccttcgaattgggccgtgtaactgagcttttagcttctatctgggctgcggccttgggggatatctacctgtccctgataactcttggccccatggggattcagggccggggtgtgtagaacacccccggcccatgcccacccgacgggtggctcatttggccgacaacacacccatggggagtgatatgctcccatttacagaccctaatagaggttttccccgcgggggatcgggggtcgggtcccattgccatccctacccaggcacaaccctcctcgaggggggggagcgtcacgtgggcttgaggcggccttctctctttgtacgtggtacccccgggcccatatcaccgacagtagcccccggcgttagctctgaccggcgctctttgcagatggctagggttgacgccactcctctcggtcaatggcttgtgggcccggtcttcgtcccacgtggacggattcaacgagtgtggcccccacgcctaggcggggctagagccacgagataacctcgaaaacgtggaatccgggcgaagtgggattgcctcccttgtaatgatgggccatcacttcgtgattactgcatcttacgggggccgtgaagataatgatgggtgcacgaaacgaaaagggtagttcttcgcggtaaccgtgcgcaattagggtagtcgtggccccacccgcattctgaccgaaacggccgcgcgcgtgcatggcgcgcgcgctggaaacaggtgcgtggtgaatcgagggggcggaggaagtggccgcgagaaacgaggagccgaggtgcagagggaggataaagggcgcatgaaggggttttcttcccctcctttcgccactttgcttctgccgctctcctgcgccccaactcaactcgcatcttgctcttccttcgccacactctcgctccccgttccccctcttgatgacgtca

SEQ ID NO: 50330 - DNA, 1501 bp, Oryza sativa
gtgctgatgtactcctcaatgctcatggattccatggctgtgttccaatacaaaccagaatttctcaccattattgatggcaaaatgaactgacacacaagaacatataaacagatgacgaaaagctcaatgttctatctcttttttttcttctctctactgatctcaccttggtgtgatgggcacatgaattgccccgattccaaaactcaatttcttcgagtttcttgatcttttgggacaagcaaaaccggagtcaaatactgccgaaggatcttatttaaacggtttcgtaagttaggggacctgtcttatccggttttgcgaccgagcgacgaaaatcagactggacaacaaatagagggacccaaagtgaacttattccttgtttgaagcctagctctttccagatgggtagaattcggcccagttcgaaaaatgaaattcaaaattagggcgcaatttcattttgtttagaagaaaacagaatccatccatgtattgcagtactgggaaggtcgttccaatcacagttctaacttctaatcatctagccatctagacgcagtattacaatttgcgagagaattccggctggttccatttgattccacacgagatgcattttgttctgcccaagcaaaaatcaatcaagcagagccctaaacaaaaacaaaacaaagggtgaattctttttttcctttaaccatagtccaactccatccccatttccaccgcttcgagaaaaaaaggtaaaaaaaaaagaagcgacaggtgaggtgacagcctgacaccaccctccatgttccgtggtctcggtccacaagaccagtgtgctccccgcccctttctccccgtgtgcggaacccgtagaccacgaccacggtccacggggcctcgtgccggaagcgagaggaagacgaatcaacaaacaaaaagcaacgccacgccacgccacgccactgcagcgtccgcggggtttagggagggttcatggccttctcgtcggaggcgtggaaatcctccgccactgccggccacggcgacggtgacggcgacggcgaccggacccctcctccgacgcccccgctgccgacgccgctgctgcctcctacgctcgctccactgcagcgttcgctggtttttgggagggttgagggcgaggcgatgtcgtcggaggcgcgggaatcttccgccaccgccgtcgaccgtacccctcctccgacgccaccgtcgccgccgccgccgccgccgcctcctcctacgaacgggacgctcacgccgccaccgtcatcggcaccaagcggcggtcgtgctacctcgtcggaggcgcgcgaatctccccacgccaccagcgtcgacgacggcggccgcgctcctcctccgccgccgctacctcgtcctacaagcgctcgtgctacgcctgcgaccactcccagcgcggacggctcctcctcctcctcctcgtcgacgtcgggcgggtcgcttccccgcggtgaaa

SEQ ID NO: 50331 - DNA, 1501 bp, Oryza sativa
ccggtcttggtgtttggtgtagaccggatttgctagataggcgccgtactatcaagaggggtctatgaagcgagcatgtggatgatcttgtgccatattagttcatatgcatataggtgtattttgtgggcttgtctagacaagtgtggtgagttttatcaagtcccaaacaaagagagaagtgggcacatcctataggtttgggtagcctcatgtggttatgtccggtggagtatcctttggagtgtgagctatttctccctgataaaagttgtgtttattggatggattgttcatgggttggatagccctttgaataagctttccatatagtccaagaacgccaaattccgagatccgagtcaagagatatcgtcgttttactaacggttggttgtgctgaaaagtgacctgcggtctgaccgtaggccttaggtcggtctgaccggggctgttagccggtctgaccggtgtggtaaggccggtctgaccggccctactggtctgttgcactggtctggtttttggtggcgatacagagccgccagagccgcaaccggtcagaccgagccgacggcggtctgaccaagccgtggacggtctgaccggccactacactgctgtcagaccggccaggttgagtgggctcaatgattgccctgtaacggctagttttctagccgttacaaagtagtccggtttgaccggccactctatggcggtctgaccggccgagcacagagttggggatttcgactccaacagctagtttaggtggttgggagtatatatacctactccccagcagcaagattaaggttttggcactccattgcattatcttgaacctttgcaagagctctcacatccttgtgaacttagtttatctagtgatgtgttagagagtgggataagccaatccaagtgcattgcttcattgttatagctagtgtggcacttgatcatcctcagcaagcatcctagacttgttactcttggaggttgccgcctcctagacggcttgtggaggtgttgcccggtgacctctccgaggagattgtggaggaggcccgacgccggttgtgagtagtttggagttcaccaacttcggagtgaaggaagaactactctagtgatcgaggcttgggtagtcctctccgtgggccggctcccaccttgcccacctcttgacgaagggggcgtgcggtggcttcgtggttgagcggtggagttgggctcgcctcaacggggattaggaaaccagcgagtttccgaacctcggtgaaaaatccctcatctcttgtcccatttatttgttgcatttacatttgagcaagtttacatagtagagcttatttgtgctattatcaccctaggcttgcaaaccttaacatagagtagcttctttgtgcacttacgtgagactagttgatttaggttttgaattgtgcaaaaccgttttgatttacgcttccgcatacaaaactcgattttagccaaa

SEQ ID NO: 50332 - DNA, 1501 bp, Oryza sativa
tgtagaaccaattacgcctaacctgccaacaaatactataacgttagtgtgtctagctccgtaagagcaagaagaataatagtaagctataaaactgatataagctatagtaagctataaaattgatataagcttatgtgaaaaagagaagtaacaaaaaaaataaataaagaatattggctgttatgcaagagctagtttaacacgtgttgcaagacaaatatattaaatgtataagtaagagagaagaagaaaaattaaagctaatcttataactaatctatcatatatgttggttttaaaatgggctaaatgagtttacaattaaacttgctataacaaacatattctcgtaataagataaggtgagaacacatgacagccgccgaccaactaattaagccccaaacatgagacaaaaacgacctcgaattaatcatgggtggcaagtgcgagcctctgacagaataattggacctcaaatcgatcgcttagttaggatttatttctgacttgtgatctgcgagcgctgtgaaggtggggggtgatcttgatttgtttagcccagctgtggggcaagatcctaagctggctgggtttagcagttttcaaacgcttaaataatgcgtcgccgggtttggtgattagcgctgggaatctcttcgcagatgggaacaaaagtccaacacgacaccacacagggcaatcgggggcagcgtcctgccattttccgctgaaaattttgatcggtggttgacccctcttccgtgtgtgggacacgggtgaaattaaacggcattacgtccatggaaatggttctcgattgatcggtagttttcgtattttatgaattctacaaattgactttatatagatgtttaaaaatttattttacttttatagaaattatgtttgatcactcagcaatttctgtttcgtttatatttgacattctccctccgtaaaaaaacatagtattagaatgtgataacgactctataagaatgtccaaattctttgtattattatatgccacatcttagcacaaggttgtttttgttttttttttgacgaatagagtagtgcgcaggggtgcggtactctctatagtcgtcgcagctttcgattgtgtaacaacagggctcgtttgaaacacgagaggggaattactgtcaacgatcactgtgaaaaaaagcctgtaaattttctcgctgtcgcgagcactagcaacgcactcgcgactcacacatgtgtgtgtggcacgctttatggtggcacgcgtgcgtatgctagggctaggaaggtctcgcaggcaggcaggcaacgagaggcttttctcctctataaaaagtggttactgtgcagaggtcaagccacacacacacacactgatacacagatcggcagaaaggaaggagaagcagccaagcagaggccccggtcttgtcaccggaaagagagaaaaagagaagtgaaattgaggaagaggaggagaatgtga

SEQ ID NO: 50333 - DNA, 1501 bp, Oryza sativa
acccaaaattaattcagcagcttcagtcacaactaaaaagttcagagagcttgggagctgagcagaacaaacaattcttgcaaacgtatgtaagttgagtccgccccaattcatgcaagtttctagcatctatagcttctttcataattaaaatctccccacaaacaacccagcttttcatccgatgatgaataatgctgagatcaaggccaaagcggtgactggtgatgacgccaaccggcggatggagcagccgctatcctgactctgctcggaccaggggctcttatgcaaatactcagacgctaccattggtaggctggtagcgatccaatgttttgcaaagattttgcttctctcatctcttgcttttggttaaatcttatctctcaactctaaaactgggtataacatctcctctaactttaaaaaccgatgtaaattaacacctttagtagttttgaaacggtttctgctcacgtggttggtcaactggtccacgtgtgttgatgtggcatcccgttatcaaagaaattgaaaataaaagtggggcacacaagtaagtgacaagagtaaaattttaaaaattgtgaggcccacttgttagcccactactcccttctcaatcttgacgtgtcaccgctggcggcagtggacagtgacggtgatgacatgcatcacccacaatgacaacgagcactgccgtcgcacacgctgtcccatactcgtgcttgaagagccccccgtggcggcgttgaagttgggtccggagacggcagtgtggttggcgacggcaggggtagcaagggaaagagagtagcgaagaagatttactgcttccccatgccaccggcctgtctcaccttctgagcgtcctgctgatatgagagtatcacctacctctgattggctcgccagggaagagaggaaagagaaagaggaggagaggtgaggaagaagatgaaagaggaggaagtcattggcatgtgggtcccacctgctgactcagtgagtcaaatctgccacatcagtagaaaccactccccaaacacccaaggagttgatttacgccggtattcaaagttgagggaggcgttaaaccggttttgcggttgagggttgtgattcaatcagaaccagagatgagggaggccaaatagacttactcattttgcaaaatgtcgtacactggctttaatgggctaggcccacttgtccattgggcgcccccctataccttgggcttccaaccaatccatgggccgggaaggcatcggacggccgagatcctcccatccatcgcggtgtcccgatcgcggccgtcgcaaagtcgcgcacgggacacaagccgaggagggttttgaaaccatcctgggttttccaccttttccagcggccgcgacaagtccagcgaggcgcttcctcctctcctctcctctcctctcgcgacttcgcggcggctcgctcgcctgatccatccgtgtctcgcgcggcggcgcca

SEQ ID NO: 50334 - DNA, 1501 bp, Oryza sativa
gctgcgatgaaacgaggaattattattcatacggcaacttagagcttccttgcaaaatggctgccaagttccaacgtaagtgtagagcgtgactccaggaatcaagcgaaactttaacattttagccctttcacaaaaaacttattctataagtagaccggacgaaaactataaccaaatcttagtgccatagaccttggtgctgacgcccaacatcgctaagatttgggcctcagcgtagcagggtctggcgctgaccaaattaagctataaaaaatatagatgagcattaccatgtacaacatattgaagcggttcagttgaaaagtttgtgtcttttccgctagagaaaaagtcacggcaggattaaaaaagaactgaaaatgtggcacggcaaggattgatttgaacacagatcactagtatgaaggcagccaccaccaaccatgttcatcttttatttaaattgtatatcacaagtcttggtgccataggccttagcgctgagtaggggtgaaaaagggtatgaaacttttcagatgccggacctattttcgaaaacgaatctgtcggttagaatttttcggaaacggaacaaattcagaaatattttctcggaaacggaatcaaaaatgataagggcagtttccatcggaactttgaatcggttggaaactttctgaaaattttctcggaattttcagaaattttgtgattgaaatatcctggattatttttttaagcactaaatagtgaatatcacggtgtttggctgctattttttaaaaaatatttgttatgcaaatctgaagttacataagaatatttttttcatgcattaggatttatcaacaacattactctcttaaatatagataatttattctatagattgtgttttgtgatgtactattgagacttaacaattggacttatatgattgtgttttatgatgaattgtcgaccgttgagacttgagaattggatttatcagtttgaggggtttttgtattctgataaatttttattaccgtattcacgccggttcgttttcgctccgttttcggttccgataatattcgattccgttttcgtatccggggtttccgattccgaaagaattatgaaaacgaaaacgataaagatggtttccgtccgtttccgtaccgttttcatccctactggtgagatgttagcccacagtgtaaagatatttttttatatagtttttatcacagcctatttttgaaataagttttatggatgggctagaatgtcaaaattacggaggaatcaatgagcgtaagcaaggaatctacatgctgcagaagagagtattcctgtcaaataagcaaaatcccaaaccatcgccatatctataatttttcacatattttgtgcgagtggctgacattgagcttgtacatatcgacagcaaccgatcacagaaaaatgaaatcctatctgaacgcacacactttctgaatgcacatgccaagga

SEQ ID NO: 50335 - DNA, 247 bp, Oryza sativa
acactctactcatggtaccactagtatgaatttaggtagatgcttcgccgcttaattaggaaacattaggtggttttacaactctagactttgggaatattcatatcacctggacattatggaatggtttgattattgtggaattggattcacacctccccctctattgaaaacccttaaaatggttttaggctgggctcggggtgcatggttttgatagtatcacctcggccatataaggaccggt

SEQ ID NO: 50336 - DNA, 1501 bp, Oryza sativa; identical to SEQ ID NO: 42865

SEQ ID NO: 50337 - DNA, 1501 bp, Oryza sativa
cgaaacgtcaggttcaggaaggatacaccagcaggtagtccaacaccttctagagactctaaagctagaaacagatgtgcttattgggttgtctcgcaactagtctgaactctctctagaattcatataaaaacaagggacaatcttcaatcttaatacccaattatgttggtggagtttccgtattattctataactcgtaagtacaatggagatgatagagatcaacgctgataattttatccttctgtggtttactatgcagattgcaatgaaacaatgaagaaaaatgcattatcgaatttggatagatatgacctggtgacgtacattaccctgcaaaaaaatgatctgatttagcttgtaggaaacctctacgcaagtacgctaggaaagtaagagaagagccaactcacacccagaaattttcttactgatcaataggatctggaaaatggctaaatttttaggcgtgacaaagcggtatcagagtttgtggcgtgacaaagtagtattagagctaacttgactataggttaattcaattggtcaaaaccccaaggatatgttttctgaaaacttaacaatgtctcctcccaacctcgaagctctttgcaaaatggtttatcaatttgcaaagaccatctgatatcacctttgatgaactaccaatttgggtccaggtgcatgatctgcccccgatggtttgggaaggtgattaacgtagttgttgatgaagatggtattgcttgggataagttccttcaaactagagttaatttgaatgtaaatcaacctctgccaaggggtattaactgttaagctccgagtggatgcagatgatacggaggggtaatggtatgaggttcagtatgaaaaaaatccctcacttttgctttgtctgtggaagattatttcatacaaaggagggatgcaagaccgagaaagaggatatttttaaaaaaaaatcagaagtgagttgagtggttgcgtgcagaacaggtgaaaacaaagagggctaggcggctagcagtcagtgagcaagatcaggttcggaggggagcagctatgggagcaaagcgagttctcctgattatgcacagagatgcaatgcagttgatcgtgatctaccaagaagacatctttttacttagaagaataaacctgataatagtgctgagagaggaggtggaaaaggagttgaagaagtaatcagttcagtgggacaaactagggtgtgggacagactaggtgatggtgatgatcttaacatgaaaattcagcactttaagaggaagccaagagatgttgaaaggttgaaagttgaacgaggttatcagtgtaattatttatttgatcagtacccaccatgggatagcccgctgtcaaggaagagaccgttaaagcaagtttggaggaggaagagaccttaatggggaaatgttgatgaaaaggcccacagggagtgcacgggggagggggcgttgttgacggtgggagg

SEQ ID NO: 50338 - DNA, 1501 bp, Oryza sativa
aggtcccgggggtcattttatagcggcaaagcgcggcggctaggcccacggcgagcccggcgagatggaagatttagggttagaggggaagaatcgaattcgaatccgggctatttccatagaaatttgcgatagttccaaaaaggaaaaggaagaggagatccgggggatcatttcccctcaaacaatttggccggagatggaaaggggtggccggatttggaaggggcagcggcagcttgcggcgcgggtatggcggctggaggttgaagacgactgacaggtgggccccacctatcagcggaaaagagagaggagggaggggtgcggcggtctgggccggcatgggccaagcgcgcgcaagccggggagagagagaaaggccaaacccaaaagagagattttaaaactttttctatttaaattattcatgaaatgcaattctatttattaaaaatacttccttggctcaaataaatcccagaaaaatttaggaactatagaaacaatagaagtgttttaaaaaattatctagcctactgttatattggagtttattaacttaaaattagatctcttgttttaggcttttaaaattatttctaaaggcggcgaaagtggtttgtcccgaccacaaattcggccgaaccgccccagcttccacatgtaagctcatcttggtcgccccagcagttacctccttaaaatatggtataatttatcaaagatattaaaagttcaaataatattaataatgtggactagtgttaagagatggtctcctattaaaaatctaaaaagatagattgaaggttgtagagttataaagaaatgtgatatgtcttatggattcaacggatatcaaatagtgttgttcaccggatatacatattattatccgtgtctgttagaaaccccgataccatattcgtattcgcattcggaaagattagccgtgtccggacttttcgagaattatccgcttcaaaaggaatccgtatttatttttctccacagcgaatagaaactatccgctccgttttaatccctagctagggcgggcttgcatctgtccatctaacttgcttgacattttcggtctgttcatctatatctcgggttggtacgtggtactagttactactagatcagcatcgtagaatatctggtgggagtacgcgtaggagattggaaggacagtgtgatccataagggtacaatatctgccaagcacgtgctttccctgagctaactaaattaatgcatctaactagtactgtacttgataagatcgggtcagcaaaggtggacaatatatactacttcctccatatttaaatgtatgacgtcattgacttttcgattgactttttgactgacgtttgaccattcgttttattcaaaatttttgtgtaaataggaaaatatttatgtcatgctttaaaaacatttgatgaagaatcaagtcataataaaataaataataattacataaattttt

SEQ ID NO: 50339 - DNA, 1501 bp, Oryza sativa
ataatttttatattttcaaactcaacaacttgagagttattcatgatttatattttcaatgtttgacttaaacattatcctaaacgacttactttacgagtatgaagggaatatgtgttaagcgagtgtactcgtaagcatatgtgctcgtctgaattgaaaaattaaaaatctgtcgtaggatgttttctaaactgaaaaaaaaataatatatattttaattatttgcagcagcacaacgtgataatagcaggttgtatggcgcattagccttggactgatcggtcctggccgaagtgcaacgctgtaaacgcagagcccagtgcaccgcaacggaggaaaaccgattggccgccgccggtgtcgtccgcccgcgcgggggactcacgtacatcgttgtaccgcgcccgccgcactccttcgctcgcgcgacgtcaaccacacacaatttcttttagagaaaatataaaaaagcaatccactgctccctccatcacataatataagggattttaagtttttgtttgcactgttttatccctcgtcttttattcaaaaaattttaaaattattttttttttacttactttattatccaaagtactttaagcataacttatcattttttatatttgcacaaattttttaataagacgagtggtcaaacagtacaagcaaaaactcaaaatcatttatattatgggacggagggagtacaaactagtctaagctaataaaaaaattttgagacacatgacacgtactttaagaaatgaaaaccagcggcacgtccctaatctcactaaagtctggttgaaaatccacctacatgtgcgtaatattcgtggacaccaggatttaaaccatattgggtgaagtcatgcactcacaactccaccaccacaccacgggtgcttccccaaattgaacataaattttaattagcttttaacaattcttagggtgaaatgatcttttatagcggttaacaagtaccgctaacggaaacctaccggcagtgatatgtctagcacaaagacacttgtacaatatcattatcggaaagatgggtttgtcaatgattcttcttcgattgatacgcttgtcgatgatatttttaaaatgttctcttttttaatacttcctctgttccatattatatctaaatttattaatattcatatgaatatgagcaatgtaaaaaaaagtatgataatatgaaacggaaggagtataaggaattagatcgcgcgagcgacgcggacacactcatgccgctcccgcttgcccactgacgcgaagcgtgctcgagtgctcgaccagccttcgtctccgctcgcctcgccgtcgccgtacgtcgccctccgcgacagcctgtgctcccgtggctccacccgctcgcctcctcctacaaatcctccatcccgcctcacctcacctcacctcacctctcactcactcacacgcgataaaagagtttgcaacaagtggtctccttcca

SEQ ID NO: 50340 - DNA, 1501 bp, Oryza sativa
ccttttaaggctatgttcgggagccggcacacaaaacgaagcagcgttttagtgcgtgattagttaagttttagctatttttttaaaaaaatggattaatatgattttttaagcaactttcatatagaaactttttaaaaaaaaaaacgcaccgtttagcagtttgaaaagcgttcacgcggaaaatgagaaggaggagtcgggaacttgtactaccgaaagtccaagataccatatctctatctctcttctattaactctactctacttaaatgatactttttctctaaagtctttataagttttatgtggagtatccaaacgaccaatttgataaatttttgtttttaatttttataggatttcatacagaatgaccttttatcctgtgtttttttatttgtatcttttattttatgtttcaaaggagtcctgagtacaaagtgagttgagtaaatttcaaaaactctatgtacatgcacaaagtaaaagaaaaacttttagtcccctcctccgcaatatcaacaaaagtaggctggttgaatattggcaattttgcctttttcaattggtttcaaatggtggctggcctggccatcaggggcctgctggtgcagctggtttacccgttgacggctgcggcatgtgtgggcgtgtaccaacaaaaggtggttttcgtgcttcagctgatgtacggtccatgttaggtagtactcccaccgtattttaaccgtattttaatgtatgacgccgttgactttttaatcaatgtttgaccactcatcttattcaaaatttttatgtaaatataaaaatacttatgtcatacttaaagaatattttatgataaatcaaatcacaataaaataaattataattacataaattttttgaataagacaaaaggtcaaacgtttgtcaaaaagtcaatggcgtcatacattaaaatcttttttgaataaaacaaaaggtcaaacgtttgtcaaaaagtcaacggcgtcatatattattaaaatacggagggagtactactccagtactagagaggaaccggcgtgttgtagcgttttcttatatactgtacttcattttgtagtccacaaaaccgggctagtaccggtgttcaattcatacggacaccatgactttgttggagcacaacacttcgtattctcgattccatatattactgggtacacttgctcatataaacacacacaaactcaccctataaatgctcacacccacactcatatacagactgagccgatatatctttatatcaatgaagtcaccataattaacttgtccactgagtatatcgtctagcattaaaacaataaatagtcgtaaatgcaagcacttgaatccaggtgggcatgttatgccaccaaacatactttttctattccagtcgaacgatattttctcaggtgcaccaaccttttctcattcccccctctccttttcccccttatggaccaccttctctcaccgaagc

SEQ ID NO: 50341 - DNA, 1501 bp, Oryza sativa
ccgagacaatgcccaggctgatcaatctttgctgttgttaacagccaaaacatgaatctatttccctatgcttccttgcgatagttaggctgagtgaatactaccaaggttgcgattttttcagattaaacactatatgacaaaatgctaatgaacgaaagatagatatgcgcttttccttgatatgttctcattttgcctgtcagtttattaaatatttgtaggccgtcaacttgcagcttggcatttggattattgcagtgctaattttgctatttattttggcttgccatattgggtcgatttagaatatatgtacgcttcagcatggcatttggtcttggtggtttgattttgaactctctgttactgcctatcaattccctatgtgcatatctttttttttaaccttctttccggtttggtgctttctttcataaacaaaatgcattatagcctcttcattacaatttgcaagtacactcacatttaaagaactccatatcaattggtcaaaaagattaattatgactagatgtgtagtgcattttatctgctttcttttatggctcttcccatatagtttaattagtattacctgatatagcaaactggccagtacctaatgtgccactttatggatgcataaatttctctttatatgtatactacttgattgctacacatataatgatgttttggctgctataaaaaatatattactttcattattatagttccagtaaaccactaattactttcataaatcagtttgaatgatgtcagtctcttctgggccatcaacacctaaaccagcttgcaagcgcaggcaacccgagagagcttttataccttcaggttagctccaagccatataaatgcttatttctacatttgaaaccattttcctattgagctctcctatttgtcaacagatgattctgttgtgccatatctatttcctagggaatattcctagcgatggcgttgttctgctggctgatgacgccctctcccatgtttgtgatttccctacaagttttcatttgccatcaaggcgctctatacgtcgaagactacttactcagtctgctggtataatatttgttgttttgatttttttttccgttctaattgtctaccctgttgttttccaaatgtatggcatttctttccatttattatgcataatcatcactaccaattcaacctaccgcagtccacatttacatatcaatttcccatgttattatcctaattcttttttgaccaaaaattgttgctcatattctaaatcaggatttccccacccggatcctgtaacagctgctcaatcacgtcgaaagcgtaagcttgctatggctgccaaatcatctagaggtttgattatattctttatccactcacatgtttatctacatgtgcactttcatgccttatacaaaagttttttttccctaacacatgttgttttctctagaaattaatagtaccactgaaa

SEQ ID NO: 50342 - DNA, 1501 bp, Oryza sativa
ccggtgtgcgatgccgcggtggcgtcgagcgtgcatccacatccaattatggaaaaagtccactttcaatccatcggctatgggcttacgacccatgcgccgcgccgatgaccgatctgcttgcggcgtcactgtcacaccatgcataccagccaccaccctgactttggcctcgtcccgacagcatccgtgtcactattcatcggcttggtgtatctccgtcctaaaatataatataaatattttgtatcaaaaaatataagcatttttaaaaattgatatagatattaaaaaaatgattgaaaaattgttgtgatcggttgataagacaaaataagataaaataattaaatggataactattgtgatttgttgagaggaggggataggtggagaaatgtttttttttttcagaacagaggcgccagtaatttttagctgagacggtcgtgcattttgtttgcttgcgtgtgtacgtgacagcaccgagcagttgccgactaacttgaagccgtgaagcgagtgaagctgcgaaacatacatagggaaacagcatgctctcgtgaggagaagttgacttgagcaaatcaaatggtcctatacctggtttaattccgttaaaaaaaatggacatcggcgttggccgccagggtttatggacaagtcaccagatacgtgccgtagcggagacaagggggagcggctgcgagacaggagctgggtggtggccacaacgggcggaggactaggccttgtacaacgctccaccgtggagtgtggtcttagaccttcacgtcggattcgtgtgctcgtgacagtgagaaccgtggtcttgcgatgccgtgcgtgacctatagaggttccggtggtctcatcgcgtctcagctcaggaacaacgacgccacgacctggaaccacgcgttggatgagtccggagagaaatgagtggcttcggtgagagaaggtggtccataagggggaaaaggagaggggggaatgagaaaaggttggtgcacctgagaaaatatcgttcgactggaatagaaaaagtatgtttggtggcataacatgcccacctggattcaagtgcttgcatttacgactatttattgttttaatgctagacgatatactcagtggacaagttaattatggtgacttcattgatataaagatatatcggctcagtctgtatatgagtgtgggtgtgagcatttatagggtgagtttgtgtgtgtttatatgagcaagtgtacccagtaatatatggaatcgagaatacgaagtgttgtgctccaacaaagtcatggtgtccgtatgaattgaacaccggtactagcccggttttgtggactacaaaatgaagtacagtatataagaaaacgctacaacacgccggttcctctctagtactggagtagtactccctccgtattttaataatatatgacgccgttgactttttgacaaacgtttgaccttttgttttattcaaaaaaga

SEQ ID NO: 50343 - DNA, 1501 bp, Oryza sativa
agtagagttaatagaagagagatagagatatggtatcttggactttcggtagtacaagttcccgactcctccttctcattttccgcgtgaacgcttttcaaactgctaaacggtgcgtttttttttttaaaaagtttctatatgaaagttgcttaaaaaatcatattaatccatttttttaaaaaaatagctaaaacttaactaatcacgcactaaaacgctgcttcgttttgtgtgccggctcccgaacatagccttaaaaggaattcaaaacttgaggtttaagctcatgcttgaaatcctccaagaagtggaggaaaaaaaatattcgtccgaaacttttccaaccatcaaatcctacaaaccaaagggcattgaatccttagaaatcctatgaaaatccctcgttccaaattaacctttaacattgcagtttgacatactgaagttcgtgattaattttggatggtttatctatatggaaatttagtgtaaaaagttgtacttcctctgatcaatatgacgttgagtgtccaagacatttagccagtgcggagtagtatacttaataaaaataatgttggcggcataacaaatcaatgtgtattaataatatatgacatcgagaatacggagtacaccctccttttttcatgttacttatctcttagctttgtccttagctaattatttctaactttgacaacaaatttttcaaaactagtatagttttttttaaagaaaacgtatagtttaccatcatgtaaattatacattacgaaaatatttcatatggtgaagctaaaaatcataaatcttatcattgaactatataatttttttagatattagtggacaaatatacacatatttaatttaaaacaaaactataatgactttgtattaacactatgattgtagtacgattgagcggctcaggcaccaccctggttttgtggactatgtaaaaggaaaaaaaacgctgccacgccgtttcatacggagtactacggaagtaccctaacatggatgtaccccttccgttgggtaaaatctaaatagtgctcgcgtactatttgtccttagggcatgtacaacccacagataggggttcgtctccaagaacctcgaagttatcatccagacagatataaagacagctcatacaacccatagacagaggatctgtctgtaagctgtttaatgcttttgcatgtagctttgatcaattgcaaatacgtttgtgtataccattgtgtggctatatatttgaaataatactatcaagcatgaataagatacatgattataataatttttaggaaccataaatataataattatattacaatgcctttagtctaatttcgtcgccaaacttttcaatcaccccttcagcaaattttatagtataaaagtgaggcttgaattcacgttcacattcacagaaacgggcatgcacataactgaagcattcacataaaggagcacatatacataa

SEQ ID NO: 50344 - DNA, 1501 bp, Oryza sativa
ggctcgggttcacggtggaccgggtgcacagggacggtctacggaacgaacggccgagatctaatctaaacaaaacggacggccgagatcgattcgatccaccgcgggtctacggatgacgcggcgctgacgttagcgatgacgtcatcaccggcgacggctcggcacctcgggctcgccggcgaacgacggcgcggaggcgcaaacggagggcatctacgggtagagggcgacgcggtgaactcaccgaaggctcggacgacggcggacgtcaatggacggcaacggcggtgaggtcgaagcggcggcggcgttcgggtcgacaacgacggcgatgctccggcggtctttggcggaaacggaggacgggacgaggacggcgacgacttggcgatcccaacgacgaccttcccgagcgacgacgacgaacggagcggcggcggcgcacggctggactcccttcgggagcggcggtgcacgggctctagtggctagggcgctacgagcggtggcgagctaaagcgagggtggcgacgaagagaggaggtcccgggggtccttatataggggctagagggcggcgatggaggcccacggcaaccggcgacggcgatggaaggtttagggttagaggagagaaaacgaatccgaattgagctcgaatccaacaatttccaaacgaaattagatgaagtttctataggagaaaagatagaggagatcaaggggatcatttcccctctaccaatttgaccggatcgggaaaggggcgatgtaatttggaagggggcggcggcggctggcgcgctagggcgtggctgcggcgtgaggaggaagacgacggccctgacaggtgggcccacctgtcggtgggagagaggagggagagcgggcggcgcggctcggcgggctagatgggccaggcgctagcaggccgcggagagagagggagtgaattgggccgactttcggcccaaagccaaaagaggattttaaaacctttttctttttaaattattcatgaaatgcaattccatttattaaaaatacgtccttggctcaaataaatcccagaaaaatctagtaactatcgaattaagagaagtatttaataaaattttatctagcccacttttatattggaatttattatttaaaattagatcttttcttctaggcttttaaaatcatttctaataattccatttaaacaacaattcataaatttaggattttcagggtgtgacaaagtagcaaatcttgcaaagtagaggcaatagagtttgccaatgtcgaaaataatgaaggtgaagtcgctccacatggtgacaaagttgcatagccgtgatgacgtgaacacaagttggcagcaacagaagaaaaccggtggcgaagatgtgtagtcgtgaagatagatactccggtcagctccagaaaaaaaaatagtcgatgtcaaacaaggcggccagcaatgaagacgatgacatccctcagtagtggt

SEQ ID NO: 50345 - DNA, 1501 bp, Oryza sativa
ggtgaagtatgtcacgcccgaaatttctatccaaaattccaaacgcttacatgtgtgtaaattctcgtccaggaatcagccgaggcacataataacaaattgataatagagtgcaattattactctaattaataagggaatataaagtcattacagaggcaattattactccaaacaataaaaatctaagcagcggaaaataagataaacagcgcaggcgactccatcccacaagcagcttgacaagggctacgcctaatcctccacaccttcagcatcactgtagaactcctcctctgatgaatgattgcaaggtgagtatatgacatactcaacaagccacacaacaaatatgcaaatgcaagggataacaaaggatggcataatatagtctcatttgcataaatggcatttaataaatacttcagaatttaataaaacagtaaagtatttaattacacaatattaatccaacgctatacaacatacccgttgcataggcccaaccattcttaacaaccattcccagcggcacagttctatctccaaaccaggaatataccattccaaaccaggagctaaacaagttattaccaattacagtatcatttattatggtgagatgtatgaaactaatcacgaatgacattgttagacccgcccataacagcgggcacggctattcgaatagttttactctggccagaggtgtaccactgtacccacaagacacaacctcaacatcatgtcaaccatgcgtcgcgatacttaacaagtacccgaatagagattgtgacaatacccttcgcataacacaattcaaagcagtgcacccttcctggatcataatcacccccttataaacaaggcatggactccccagcgacccctgtgggcttatctccgccacttcacagtctggtgctctacaatgaaccatactatacaaaaagtaaagccgttgcccacgctggcttgtggttggcacggttaatgtttcacaaccgaaaatcgtgaactggtccttaattgtcatgagcacgaccatcaaaaccatgtgctcacaacccaccattatcaagttttagttggcaaattaattaattaaccaatcacgattaaccatcgtgagctatcattaagccatcattaaataatagtgaatcataagttatcccatttatatgagctaatgtctctaagcatggctaagcatcctaagcactttagctaaaaccatataatgttctagctaatccaattattaaccaaatgacaaagaataggtaatcaataacaaaaagactataacaaggcaataggttattcccacccggtgacattcaaaaataaatgcgatagttgaatagaaacaatagctttaaacgggatcaacatgctcaaagggttttttgggatctgtgtgacttgccttactggccttggaactcttcaaaatcttctcctgcaaaatcggactctccgggaacgtcggaatcta

SEQ ID NO: 50346 - DNA, 1501 bp, Oryza sativa
atcgccggtcgggcacaggcagaaccgcgctctgcccatgagctcgccatggtccacccctgccaagaggagaccgtacaccagcacctcccgcacggcgccgccatgcgcgacgcctcctgcagcgaagaacgcgaccagtgtcaggggcaggaaagagagaagaaagaaaatactacaaagaagcacagtgtcaggggtattttggtactttaacactctttctctctctgttttcaccgaaaataataaaataatacatcgagtgtccagcagctaattaccatatttttccagtgtccacaagcaaatacatgatttttgggtgtctcatagcaaatgccacaatctttaagtgtcctatagcaaatgggcaaaatttgatacacatcccccatttggttacatatagtggtaagtactgtacatatcaatcatacgtgcagctgtgcgaccttgcaacaaggacaatgtcaacaagcatgcataacggttttctggtgaagtgaaatcttgtgcccattcctcgcggtctaaccagaatgccatcctgaatgttcattgtttatccttgctcatgaaaaagagaggaaaaaattgattggtgttgatcaggacctagattggtcatatggcaccatgcttgctctccactcttcaatcagtgattgtcaagagatgtaattacattttgaccggtagacacaagtatttttttttcggggaccagtacgagtcattgagggtttataaatgtcggtttcaactaaatgaactaaatcttaatccgcaaagtaacacatgccaatccctatgcagattgtgaagaaatagccaatatttgcgagatcttttcgagaactaactccttttgagatcacgctccggccgaaaatgggttctcacttgtatatagtgtaacatgccaactcctcgcacaaaactccactcgattgcgcacgaattagtctactactccttaggttctccgcaacaccccccctcaagtcatgagccatcatcaacaattcatcatcatcattccctttccacttcgctctcactccaaaaaacacaactcgctcacacttccaaaaaacacgcacctcatcagctttcctttgcttcccttctactcccatccaccactccccctgcctgccctgctcatgtttgcaacaaccaggcccatggccccccaccacaactaactcctcactactgaaacaaaaagaaaaagaaaattacatctcatattctcactcccctctagcatctcagtctatatgcacactgttctctgccacgcggcggcggtgtgggacccacatgtcattcacccataaagacagtttgtgatgttgcttaatcacaagttccaaacgaatgcttgtgtagatcacccccttaaatactctctccaccactccaaccctcaccactcttccagtgtgacacaataattatcttaatttttttttccaatctgtatcgaatttgt

SEQ ID NO: 50347 - DNA, 1501 bp, Oryza sativa; identical to SEQ ID NO: 42842

SEQ ID NO: 50348 - DNA, 1501 bp, Oryza sativa
aatttctggttccatcaagaaaaggcatacttttgttgtgtatttgataaaaggttccagataaattaactatgtttaccagattattttactacgaaagcaaatcagccgagtgtatatatatatatatatatccaaatagtcgaaaatacattcaatccattatttcattcaaattgcaaaacacatcatagaaggataaaataacattgatcttgatcatctctaggagttcacaatgaaacatcaatactgaagttccaacaacgcatcaaagttatcaagacggaagatttccgttctatgttttgattattattgctagggagagttcagactaaggataaaccaacattcacccttgtttaattacaatcttttgagcctcgggaagatgttggaccattgtcacctgctggcatatccttcctggaccggacatttcgcttatagaccaaggtgggtttttcctcgctgaaaagttacagtaggcatcaattaagcaatatgaaatgctgcatggattttagcaattacagcaggcatcggtttgggaatatgttgttaccatgcaaattgtgatgtaagaatagcatatatattaatttaatgcaaggattgaaaagtcatgatttgcacttacagaacagtggtttccctctccggtggtatcttcgcacaggcatagcagaatagacagccgcaccttgatattagggaaaaaaaaggtgatgcaagagtttaattagcagcaacaactggacgacacatacaaatataaagtagaccttgtaaatcagacagcgcatattgtttgaagtaaatatgtcacatatgcaatattgataagaggtagactcttatgttgtaattttgtattttttatttgaataaaatttatgccaacagcaggggcctccccaactgtgttctgctaaaaaaacagatacaaatattgcattgatgtagttactgagaatgtattttagcaaaatggataaaaagattcttaaaatagtttacatgagtcaccaaggcaatcgatgtaataccaatcctgaacatgagttttgctcttttgcaattaatctagtgggttgacaacatgtcaacatccctttaccaacaagaggactaactaatagaagcagtgatcagatatagtgtgacactaagagaaatatattctaaccatgtttcaatcttctagcattaatttgagatggcccatggttgggcttttaggacaaaattagtcaacatgacagatgaatctattctaagactgaaggacatataacaaaaacaaaataatttgaaattataaaagtcacaataaactttatgatattatttcatcttataataaactaaaattatattccatctgttataggaaaaatgtctaaatagctaattagtatacctaatgggcacatagaaatctgttaaaaaaacatatatccacagtaatatcgatacaaaaattattgcacaggac

SEQ ID NO: 50349 - DNA, 404 bp, Oryza sativa
aataaatacaatacccttggaatactctcgagtgaaatgctacaatggtatatccgtgcgcttgtggatgaactctgtaaccataatataccagaagtatttctgtgccattgctgggaattatatttctagtaatgtcgttaagaaataccaacaaacatttctggcgccattgccgaggaagattcgtaatagagattacctgaactaatagcaggataaccttggttgttttcgcttttattgtgaaaacagggtagtgcatgactggtttcaacttgtcggaaaacttcaaagaaaatccaaaagctttcgtccgaagcgtcagaccgcgagtcgttgctctgcagaaaactctacgacatagaaaccagtcgtaccagcaccaccaactttcaggacta

SEQ ID NO: 50350 - DNA, 1501 bp, Oryza sativa
gatcactgataagggatgttaggtcccgatcttctgataggtattgataaacagtcgatttggacggagtcatgacacaactcgatccggcttctaaacgaacacgctactgagccacgcaatcgcagcaccacgtatcctctggttatcaatagcgccgaaacccggttgacctcgccgagaaagctaatccctgcatgtgaatcgaagaacacaagcaagaacaagatagattgcatccaaattgcatatgaatgattaagcactcgaatttggggttccacaaaccgatctagcggcgaaactgctcttaacagaataatctaagcaaaacctgactctaaacgatggctactgattaagtatgattagggacgtcctagggttgccctagggcgcacacccccttgggctaagcccacgacacaattacaaggctcaaaacacaaattggattcggactggatgaggtgcgcggtttgttttgctgattcctagtagctcggtagaaagtttgacgtggaaccaaaaccatctgaaggtagactccataagctttccaacaagtactcatgggccccgaaattccttctagatttgtgactgggtccgtttgaagttgatgctgtcaggaggcccgaatccgaatccaaaacatgtagaactttatctcttgtcttctatggaccaaaagtgacatggtgagatgaaagaatacttggagaaggtcttggtttggtcccaatcaacttctttaatcatccatgcattctttacgcttggtctcttttctttcgcccaagcaagcaccgctgcaaacaaaaacacacaaaactcattgtgtagcagcgtttgttcaaacatataacaagtaaatctaatatagaacatatgcacctttgttgattaatacataaggtagtcatggttatatccgagctagttgtatcctcatcaatctcctttccaatggacctagtctcacatcaaaattctttttaaattcttcataagtcaacaggaatagtagaaaaaactgacttccagaatatgtacgagtgctacgtcgccatattttaggcctgctgggtcatttatcaagttggagttcattagggactgtatttaggcccatcaggccctgtatcgtgttggattctattagggactcatccaatggtacttggtcgaccctagagcctatttattcagtagtcattatcctattagagttaagtttttcttagataaatttgtcattgcattcaaaagcttggctagaaatactatgtgtatccttcattggaaaaaaaactctaaaagaagtaacatcccgagactacataattgtacgaacatgcatgtcagatatctcagatctaactattgaaaatgtgagaatctatttccaagtctaggcattgaaccttggtggaaaggttgaattccaccaagccaatggagggatgctgaaagaaaccttgtaacttcaggtattttg

SEQ ID NO: 50351 - DNA, 1501 bp, Oryza sativa; identical to SEQ ID NO: 42844

SEQ ID NO: 50352 - DNA, 1501 bp, Oryza sativa
aaacgctgctacacaatgagttttgtgtgtttttgtttgcagcggtgcttgcttgggcgaaagaaaagagaccaagcgtaaagaatgcatggatgattaaagaagttgattgggaccaaaccaagaccttctccaagtattctttcatctcaccatgtcacttttggtccatagaagacaagagataaagttctacatgttttggattcggattcgggcctcctgacagcatcaacttcaaacggacccagtcacaaatctagaaggaatttcggggcccatgagtacttgttggaaagcttatggagtctaccttcagatggttttggttccacgtcaaactttctaccgagctactaggaatcagcaaaacaaaccgcgcacctcatccagtccgaatccaatttgtgttttgagccttgtaattgtgtcgtgggcttagcccaagggggtgtgcgccctagggcaaccctaggacgtccctaatcatacttaatcagtagccatcgtttagagtcaggttttgcttagattattctgttaagagcagtttcgccgctagatcggtttgtggaaccccaaattcgagtgcttaatcattcatatgcaatttggatgcaatctatcttgttcttgcttgtgttcttcgattcacatgcagggattagctttctcggcgaggtcaaccgggtttcggcgctattgataaccagaggatacgtggtgctgcgattgcgtggctcagtagcgtgttcgtttagaagccggatcgagttgtgtcatgactccgtccaaatcgactgtttatcaatacctatcagaagatcgggacctaacatcccttatcagtgatctctttaggttttcatacatacatatgtagcacattgggagtctgaatgaattctgggcaacgattttagtgtgtgctgttcctgggtttcaaggcaggttcaaacttgatatgaattagcccttcatctcctagcatctctccaattgcttattaaaaaaacagagggaacatatgtaagtaacaagacactacctaagcgtgaacaacatttagtttagccaagatgcttacctgtaattttcttttcttttgcaatccttgatacaatcaaagacgtatgcgtgcacgtacacgtgcatatatatgaatgcatatatttccatcacattatacaatcatagaaaggatgttattccgcactaattaagctgatgcttctcgcgatagagttcagtcccactaaatacacgtgtttgcgtgttggtgtgtgcattgttatggtagatcattgttacgactaattattatttcagtgatagacgatgtattcgtcaatagtgagatatctatagtaacatggtgaatctcaagctatgctggtcctcgaacagggtcggccctggccctatgcagctaaggcaaccgccgagggcccatgatggtggggggtggcaactctgaaaatttaaaatcctttgatgaagt

SEQ ID NO: 50353 - DNA, 1501 bp, Oryza sativa
ttggtgttgaaaattcaccagttttatagttttgtaggttttgcaggaaaatctataggaagctggaaacaacagtgcaagcctagctttctgtcgattgttgctctacgtggtaagcaaagttcatggtgtttttgtagctcatgatgtgatttatgaataattagtactttctctgctacatattttgtcaaaatatatgtcattagattggtgtccagtgaatctattaggttgtgtgatcaatgtagataaatttgaagtgtcgactcttttctgaagtgatcagtccatattgcagccttcagtgatccaaactttagaatcagtgagtttcagctctcttttacttttgaggagaggaaaagagaagattgagaaggcacgcaaaacgaggtaagccattaccacatgattaattgagtttcaactattttaaatttcaagaatggattaatatgatttttaaagcaactttcctatagaatttttttttttttgcaaaaaacgcaccgtttagtagtttgggaatcgtgcacgcggaaaacgatgtgctttctctccaatcacccaacgaacgaacgctctgactaatttggagtattaaacatagactaattacaaaactaattacacagatagaggctaatttacgagatgaatctattaagcctaattaattcatgattaattactgtagcactacattgttaaatcatggactaattagtcttaatatattcgtctcgcaaattagcctccatccgtgtaattagttttgtaactagcctatgtttaatacttcaaattagtgtccaaacatccgatgtgacagagactaaccctgtatccaaactaccccatagtaacgatatgtctaaccctatcttcctttgtatgaaggacatgcaatacattcgtgtgttcttgaaaaagtgtgtaaaacatatccattctaaattcgggggaaagctccatagatttgattttggtcagtttgtaaagagcggtagatctctggtttagaactcagacgatcttcatagtcaaccttcctagagtaacttgggagtttaaaaaactattgaatcaatgttcctatttttggaggctagaaaaggagaaaacatgattgttgaccctgtaaactatggtctcccactgttgtctgtggttttgtttttcaaagaatccttacgctttgatagctcaagtgaaactgatcatgcaatgggttttatgaattaggaagtcttgtattaaatcagtatactgtgagcaacaagtataattagttgtttgattctcaacatgattctatttatctgtctatcaccattgttttatgaaatatcgccatagcattagcacgttcatattactagtatagtaagtcaattagtaggcatctactctctctgtttcatattataagttgttttgactaatcaaactttaagtttaatcaagttagcatagcattttaaatacaaaacaaata

SEQ ID NO: 50354 - DNA, 1501 bp, Oryza sativa
gtttaatgttttagtatggacaaaattcacaaacttgatattacagctggaaaataaattatttcagtgtatcgtgtgaatcgggttccactcatttgtgaaaatatttacatatgggctagcatcattttttttcatgtgtccgcagttgattagtacagtattacctttttgacatatgcagttgtctgggatactatatcgctagatgtttgtagacgtttgacagtgtttatgtattttgcagcttgcttcagtgttcatgtgagaggatcagagtacatccctttgcttggctcatctgctgatccagattactctttttttggtgcctcagactttgaccaatgaagcctttgaagctagatccccaaactgacatgttagacgaactattgctcttagcttccagcttgttcaccgcctgaaatcgttgctggtgtactacagcatggaatgtgttaaatggagcttggaagattgtttttttataaacttaaattaggatttcgttatctccactccaatggtttctattaaccaatatctatgcttttgtctgacgtcttggatatctccatttaagttaatagaaataaaggaaaatctaaataaaaaaaagatcaccaagctagggaattatttccattatagaaaaaatagcgtaaagctaaacccatattattactgatattttatacggtttacttttaatctttacatctcttgttggattggacacttcttgacaataagattttcaacgttcttcgcactgctgtacatacgttggggcaaaatcaactttgctggatattttgtatttttgttttctattttaagtgcacggaagttttttacataatggataaaccggccgctgcaaataagaagcacaaagccgtacttaattattacaatgattccacgctaatttagaaagataaatatgtacactaataggttcgataaatctaaagaagcacaatttttcgactcgcgtatattctattgttaatattgttatattgctatgattgttgaacaccttcattcttgaaaatggattcggatattctcttgtatatatattttttcaaaaaaaaaatggttcaaggcagatgattgttaaaaattatagacaaaattaacaatacaaaagtatagtgatatctaccgctctcaaaaagtcaagtttatatattgagaaaaagaaaagatgaacttacgttctaatagtacaagtactgtttatagtttggatctatcattgtggcattgttgtcttgggaaaaacgaccgaaactggccacacacggaagtgggaaacggtgtgtagcccccgttccgtcgccgttaaccaagaaagccccacgaccgcgtggcctcgcgagtcgcgagccccagactccacaccacacagcccccctttcccctcccctccacagccgtcgaaaccctagccccaaggttcccccacgcctcgcgctcgccgtcgcca

SEQ ID NO: 50355 - DNA, 276 bp, Oryza sativa
attttgttatgagttgttttatcactcatagtactttaagtgtgatttatatcttatacatttacataaattttttgaataagacgaatggtcaaacatgtgagaaaaagtcaatggcgtcatctattaaaaaacggaggaagtagtataagtaaaaacttaagatcacttgtattatgaaacggatggagtactaaatagtgtcaaatagtgtcaaatctacttcaggtacttctagattgttttttactgtgatggagaaattactactgtagg

SEQ ID NO: 50356 - DNA, 1501 bp, Oryza sativa
gttaagtatgatgcgcgatcacgggagcgcggagtgtggactggaatggagtgcaccacccaacgagatattaccactcttaggacaagtactatgagcataaagcatagtctcataggtgtcacataagctaaaatagtgaggtggaggagagaagagatgaaagagatatgcagccacctctcagagcatccgcaatggttatctataggctctctacaagatatccaagtcagcatattttcctatttgaaagagattaaatgaagagagagagtaaaactatctactaacctggagatagtctatagaaaaaaacgatgcaatagattagagagatatagatacccatatagacatactattaaggtgatttactattaatctagtctattgctgagatgtacatgttttatagaaagcaccttactttactattgcggtggatctcatgcaagatgcaaccaccacacaaaattcaagacaaaaggagagagaggaagagtagattaggcaaacaaacattggggctagtgtattagaattagtatagatgtgatatattgtacatattacctctacatttattagttgatgatgtggtcaagattagatgcaacatccacctcttttataaaacttgcctttatgctccgttcggtagtacaagttcccagctcctcctcctcgttttccgcgcgcacgcttttttcaaattgctaaacggtgcgtttttttgcaaaaagtttctatacgaaagttgcttaaaaaatcatattaatccatttttttaaaaaaatagctaaaacttaattaattacgcattaaaacgctgtttcgttttgtgtgccggggagtgggctcaggcacagtagactataagctaactttaaacatatatcgataatataaaagaggagggagaagagtaggctacaaatttattcagctgaagcacgaactcgaatacaagtatttgtatgacaggtggaaccatataagtatatgtttatagataactattgtatgaattgactattaagttggttataagtgatttggagctagtagttggctatactattaaacttgctcttacatgggtaattattaaagatttatcactgaactacgagtaataaatctttaattgttatatttaaaagtggcaaataaaagagtgctcgcacaagatttttttttctaaaactagttttacatgcaatacgttatacgtgatcgtgagatttttttttctttcacttttcttgagagtttttttaagataggtttttaaggaaggaaggagaacaactaagctggtggttttttaagttccttttcttaaaaaatataaagaaatatagcggttttttaagaaacactacgcttttaaactacttcagttgcctttgtttttataattttgtagaaatacattatgttttaaaaatatacccgtgtcaccgaccaacgggagattaaaacatcgattttgcta

SEQ ID NO: 50357 - DNA, 1501 bp, Oryza sativa
catagaagtaccgacaggatctttgttcagatcactagtaataggagatggtccattccatccatccggttttaggtttttatattttgaaatggacgtagtattatacttagcatgtcatggattgaattattgaagtaagcccccaccttcctggtcggcgtagtcccttgaggccatctctaagtttgtaatgaaaaacaactatagttcacctagagcgtgaatactctattttgattttatgaaccacacctcaaaagaaaatcttagttttgaaagcactaaagcaactagaagttcattttccggcatttattttttttgtttaaaaaaatactccatgtaagaaacaaatcttcagctttaaaaccaaacattattcaactactataaaagctatcaaatttaaccttcaacatggtttcttctcatgttgaagaaatgtttttgagttattttaaaacacagatagatcatatgatccaattaaccctattctgtgaaagggcatctagcctaatggttacaagagtctcagtagcacctgagtaggggtggaactgagctggaaacaagataaaacttgagctcggctcggctcatttcctggctgcaagccttcttattgaaacacctcttcatatatattttataattattagaaaaagtaaaaacaaatcatcaacatataaaatttaaataagtttgtttattcaattcttcaaaatcttaatgataaatttcaagttgacaaataataacgccatataaagtaaaataatcgatataaacacacgatggcctaggctcacgagccaaaacaagcggctcgcgagctagctcggctcggctcattttcagcaacgagctgaaaaggaggcttgggcttggcttgtttggcttacgagccgagtcaagccaaccaagctcgagccaagcctaagctgagctcacgagcctaagcttttttttccacctctacacctaaggtcctgagttcgacaccccatgggaacgaattttctaggatttagcggcgctgtactttcagtggtaggcgacgtacccgtcgacagcgaggtgctgacttcatcaatctctccaggatttgccggcctagtcttcgaagatgctcataggggtagggtttgcgtgcgtgtgttcatagggtgagtgcgcgtgcgttgagagtttctgcgttgtactgtgtaattcaaaaaaaaaaaaaccctattctagctacaaagaaataagcatcgaaacacaaaggttcatttgaaaatctctgaaatttcatcaaacacccctgtccaaaattcataaaaaaaatttgagctgtggcgccatctcccatcccacccagcttttgctgtaccaccatgccgcgaccggagctacactccaatctcccactcgatccccacaaaaacaatttgggtaaattcgacaacgccgctacactccaatcttccactcgcatctcatctcgcatcaacca

SEQ ID NO: 50358 - DNA, 1501 bp, Oryza sativa
gtaggaacatgcccaatatctctattgatgagttaataagtattgcaagcttaggaaaaaaacttaaacctactaccacttatgaggttatctgaaaaaaaaagggtacttgtgtatgaatatgacgaactaacaataaaatatgtgacatcagaaaatgagtattttatgatggtatatccaatttactcattttactaaatgtcatggaatggtgccatactatgttgtcttgtgaggaaaaattggctgcacttaaactaaaatcagtatgcgttattctgacatttataaatcaagtcactgatgatgcatcctgctgcacaaactatttggaggtggttatatgcttaacaagaaataggatgaagttaacaaaaccaaaaggcatgttcagcatacatcttatatgacagaacaaagttatccatgtaacaggttaagccagaaacatgaacatgatccttaaacaaagtttacctcattaagcatcctgtggagttcatcccttgcctcaaccacacgatctctgtcgttgctatcaacaacaaagatgagaccttgagtgttctggaaatagtgcctccacaaaggtctgatctgtagtttagaaaacataatgttatgagaaaaaaagtttctaaaaccctagagctgtggccatatattagtatgaagttcatatattccctactgtctgatgtgtttaaaatagtccaatacagcacaatggaaaatctactgctgattgcagaaataccttctgaagcgaaaagtgattttggttacaaaaagcaagaacgaattggtttttaccttgtcttgacccccgacatcccagacagtgaagctaatgttcttgtattcaacagtctccacattaaaccctagacatcaaagaaaaacagtaacttgatttgctctctttacaagcattatttcaaaaatgaaaaactatctctcatctgtctaacagtaatattttgcacttgcacatagagccatacaagcgtgcaaccatgtttgttcatatttccaacattatcaggttgcaatatgaaaatggatacaaaataatgcaagtgagccactaaatacaattgtaaactaagacatccaccaagccaccaatggaaggaatccagccctttttcatacaagggaccttacttctatgtgatctgtttttctttttgactacactatagtttgaacccaacttaccgacaacaaagtaggagtatttgaatgtacttaacagacacatccagtcaaaacatataaaatatcaaataggtttttacctattgttggaatggtggtgacaatctctccaagcttgagcttgtagagaattgtggttttaccagctgcgtcgagaccgaccatgaggatcctcatctccttcttggagaagaggcggctgaaaagcttcgtgaaagtgaggcccatcttgccgcagttgtgcaagaccttaaacaatcaagaatcaatatgagat

SEQ ID NO: 50359 - DNA, 1047 bp, Oryza sativa
atttgcccttctgagttgttagacatatcctatattcagaagggcaaatgtatcttttttacttagagttaacggtcaacatacgggagtggcatgagaggatgtgcaaattttgaacaatggtatataggggaaaagctaatttttaatggcataaaagggattagactagtggtatataagatattctctctttaaataaagagtaaatttcactttggtcaacctttatttaccaaattttcacattggactagaattagacttatattttcacttaacaccatatatagttaccatcatttgcactttggaccgggtttcacaaattacacatagtataatgatcgtagagctgatctcatttcttttttgtgttagaaaacttagaattcaacaatttgtactaacactacagttgggtttgtaaaacatgtaatatcttttctaaaaaaatagttcttaaactcaatatttctccaattttgtctatagtataagggttgtgaatgttcatatgtagtagtaatgaagtcccattaatctgataggatatcctgtaacatgttacatcattgttcttgtgctaagcatatttgcatggcaaaaatttccatatcattgtttcttgtaaaatgctaagcacctagataacaactcgtgtgatggtaactataaaatcaggtccaaagttcaaagaacggtaattatacgtggtgttaagcgaaaacatgagtctagccctaacccaatgtaaaattttggtcaataaatatggtccaaagtaaaatttactcttaaataaatgattggagtgggtaaaatgtacttacgaccccactcggctcgtcaacctcaacgatcactcatcactcactctaccgtcgtttttaccggtctgtccgcgggagacacaacgcacgtacgcacatggtggccggccgtcgccgtcctagctactccagtagatcgataatctagctatctagctgctagctaagctaggctctccttctggtgaaaatctcgtcatgcattgtatgcagg

SEQ ID NO: 50360 - DNA, 1501 bp, Oryza sativa
tcaatctcttcgtgggcaggcctgtggcaacaattcgtcgccaatttccaaggaacgtacaagcgccacgcgatcgaagacgacctacacgcgttgacacagaactcaggtgaatcattgagggaatatgttcgacgcttcaacgaatgcagaaacacaattcctgaaatcaccgacgcttctgtaatccgcgccttcaaatctggtgttagagatcgctacactacccaggaattggcgacaagacgcatcacaaccactcggaggctattcgagatcgttgagcgatgcgcccatgtggacgttgcggtaagacgcaagaacgacaagccgaagaccgggggagaaaagaaatcagccacagacgcatctgagtcaagcaagaagaaaaatcgcaaaaatgggaaaaggaaagctcaagccgaagtcctcgcagcagaatacgcgaaccctcccaagcgcccagacccacaaggcaacgacacaaagaaatcttggtgccccatacacaagacggacagacattctctggaagattgccttgttttcaaaaagtcgctcgagaagcacatggcgtttgaaaaaggcaagcgagtacgcgttgtcgagaagaacgaagagacggctcctcacgaatcggattctgcgtatccagactccgacctccacgtctcacacattttcggcggctccacaacgtactcctccaagcgagaatacaagaaagtggaacgtgaagtctgttcgacatggcggggggctgcacccaagatgaagtggtctgagcagaaaacagagttctcgaaagaagaccaccccaagaccgccgttatcccaggacgatatccgatcgtggtcgaacccactatttggaacatcaaggtagcgcgagttctcatcgacggtggcagctcgatcaatcttcttttcgccagtactctaggcgcaatgggacatccgcaaagtgagttgacaccaactgatcaacccttccatggaattactccctaatcatcatccagacctttgggcaagattacgttgcctgtgactttcggccgagccaacaacttccgaacagaacagatcaccttcgatgtcgctgaattcgatacagcttacaatgccatcatcgggagaactgcacttgcgaagttcatggccgcacctcactacgcgtatcaagtgctcaagatgccgagactgaagggaacaatcactattcagggaaacgcaaagctagcagtgcagtacgacaagcggagcctcgacatagtcgagcaaacgcccagcccacccgccacgactgagccacccaagaaagtgagcaagacaaataagacgccgaagccggacggtgccatcaagatcgttccactctccagtgccaatctcgacaagactgtcaagatcgaggcgacactaaacgagaaataggaactcgcgctcgtcaccttcctccgcgataatgccgacgtgttcgcttggcagccgtctgaca

SEQ ID NO: 50361 - DNA, 1501 bp, Oryza sativa
gcagcccgaagatgtcagtcagagggagagcctacactacatgaagtcacaatgcgatcctagaagaaaaagataaaagggtcgtcaaatacactcacgttgattgcagtttcacgctcggctgtccctttctcgcaaagggggacatggacgttgctcgccgttgtggggccgctgatcatcacttgaccgacgcggctctccacggtttcgctgttcaaacctgtagatcgagaaccagaattcgataagtcaagaggaacatgcacataaggaatggaatccgaaatacaagaaaaataccccgaggagaaacccgggtcgcgtcctccggcctagaataatcaaaggctggatgggctcgagcctggagcggctggatccgcctaccaatgaagtcggcagtgacttcataccccgacaaccctcacactcggaggtcatcgatgatatcgatgaaggactgaagggagggggttaaggcgggtttgacggtccaagacgaaatcttgtctggttgttcctcagggacaacaaagactggatccgaattctctatctgaaaatagaaccacctcgcccgccatttgctatgagaaaaggggcactaaaaggggatgtatcgcgacttcaggccatcccgaagtcggaaaccgacacatccggacacctttttaggttccatccagcgcaactcgtagtagaaacgaaagagatcaagaaacggctctaccccaatgtaggcctcacaaagatgggaaaaaatactgaggaaggcgatggaattggggttcaaatggagcaaagaaagaccgtagaaattcaagacgagaagaagaaactcggaaggcggaggaagaaaaccacaaagaatatagtcctaaaccgcaaccatgcggcccaagacaggttcgggttcaaccatactaggacaggtatatacctcctagttctctctccatggtcccgcgaccggggagagcgtcgtcctcctgcagcttcttcagggacgcgccggtggaagtggacttgtcgagatccatagccgccggagatcgctgaagaagggactgagatgagcaagctagggtttttgcgggagcggagaagacgaggagcgcttggaggctggaaagtttttcacaacaggcggacttcaaaatggatcctcaaaactcccttaaatagacgcactaccgacagtatgaattccaaggaaaggagagagatggccgccggaaatttctagccccgttacgcgtggcagttttcggacttcaatttaaattcacttatgaccgttgaacttcgcacggggttgtcgattactccatgtctctacggttctcacaccgagatcgaccagtagagaacgacaataaccccgacatcagaagtcgcgatcggtcacatgagttcatttaagcagaagtcgggggctactgtcagggttacggataaggtataccctctacccttggatatacgtcatgtatcgata

SEQ ID NO: 50362 - DNA, 438 bp, Oryza sativa
attttttagaaaaaaatgataattaatttattatttgacggcaaacattgattggtcatagctatggataattcctcataggaaattgtgattccatagtgaaagagaaaaaacttaagttataaaagacattacatacacaaaccatatataattaatggctctactgatttatatagaaaaattggtaattaatttattaaacataatatatgaccctcgagtttagaccattatttgtaaccattggatatgtagaagatctaacatattgtgtagagtccaactaagcaaattattcgtcttccctcaccatggatggtagacatgttaattcgtgtctccggcagcatgctcacatcatcatacttagaagaaaaaaaagtgcccttcatgtatatacatgtaactacctcatgcccctcttttcattaaaga

SEQ ID NO: 50363 - DNA, 606 bp, Oryza sativa
ttctctttgattcttgggaaaaaagaaagaggagatcgagaggaccaaaacccctcaaaaacccgaaggaatcggagtcggattgaggcgaatttggaggtggaagccggcggctcgggctcggtcggcggctggaggtaggagatggatccgacaggtgggccccacctgtcggaatccacgagagaggggagcgggcggcgtcggcttgggccggcattggccggttcggccgcgcgagagagagaggatgttgggccgaaaacggcccaacggcttagggaggggtttttaaacttttttgaataaaacaatttgtgaaatgttgtttcaattattaaaaatacttcccttgctcaaataattcccagaaaattctagaaaatagaggagcaagcatagtatttaataaaattttatctaactcatttttatattgaaaattttcctagaaaattagggtttagcttgtaggcttttaaaataatttctaaaaatgatttaaaatatgcatttttaatttaatcgatttttagggcgtgacaaacctaccccccttaaacggaatctcgtcctcgagattcagaagaactggcgaacagatga

SEQ ID NO: 50364 - DNA, 1501 bp, Oryza sativa
atggtaggatggctcataccttaatgtgatccgagtggctttttcaagcagagatgttgacctgcagaacatctcagaaggaacacacctatatgagttcgactgctagtcacagtctatgaggtttgggcgatctctagatactcatgaaaggcctggagtttgacttatatgctccaaacagaggggatgcgaacggcagcccagtaccagtcaagggtttgagtgaaacctgatcacacaagactgacaattcaaggcatagtccattgttcagttgtggtctgatgtagctcatatcctagtggaagttcaacttaacagtctccaccaaaacacaggtatatcaaacaggcacaaccttgagaacattttttatgagccttgaaatttggtggggattgttagaataattgggctaggcccgatttattctattaaatctcaaaggtccataataagtgttaaggataataataccaccttaggaattaagtgaggagtatctcaacctaaatagggagttattggaggctccctgttgaccggtcgaggtgggagtcggaaagccacacgcgcgggcgcgcgcgcgccgggccagggcgtgggcgtgggcgaggcgtggctggcgggcgtgcgtgccgtcacgtcacgtctctattcttttgcaaccacgatcccacgttcccacgactgcctccgtaatagcgcgtgcacgatcccacgatcccacgacgcgtgtgctgcaacttgcggaatctctccttctatctaaggaggccgctagtccgatcagaatgattcgcttgctttcctctccctggtgttcttcctcctccgcgtgcgcctgtgctgtttcgcttcctcgcttctgatcgcttgcgcgcagaaggagcagggcctccggaaccacaccttcgcctgagatctgcaccgggtaggcgggtgattagggttttggggagtgcttcccgcacgactgctctgttcgttgttgtctcatccaccatgtctgcgcctggagccggagcctgatctgtcgccggcgccgctgctgctgtctctggagatggcgcgccgggaaccggagccgttgcgaacgtcaacaccaacggaagcaattctacctcacaatccagcggagggccattctcggggtatgtccttctcctgttgttaactcattcgttcataccgctgttagtcgtgctagtcgcaagtcaattgcgtccttggtatgtgcatgatgcttatgataccttaagcatattactggttatgctacatgttatcactagatcaccccacattgttcatgccatggttattgtcttaatattttggattaaaatatgccgatatatgaccatatttccaacaatccaaaaacctgataggtcattttcggtagttggctttgctgctgcactgaaaccacatgcatttgatggttctaactataagaggtggaaagcacgtgcactattgtggttgacagcga

SEQ ID NO: 50365 - DNA, 1501 bp, Oryza sativa
cgtggcttgctgagtatgtcatatactcaccttgcaatcattcatcagaggaagagttctacagtgatgctgatggtgtggaggattaggtgtagccctggtcaagctgcctgtggagtggagtcgtctgcgccatttatcttttttttttctgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccaggcgtgacaagttggtatcagagcctccttgaccctaggttatgccaaatggttacccatagaagccctctaaaaatattggaaaagtagaattgttctcctccctttctcttttaattaaaccaaactaatagcacatgcacttcataatctcttttagtggttgtcattcaaaatttattccagtgttgttagtactgtacatctaatactgtactaatggctcatttaccagcaaatgttttgcaacattgttttattttgctgcaatgaaataaatttagcatgttgattttataactttcttttatttcttttggaacctgttgttcaaaagtacaaaatttgtgaccttgtttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggttttgagggatttgtccaggagttgcgtaccataggatttgggactgcccctttgtatgcccagattcctcatgatcgtcacgaagagaagtgccgagtcaaagtcaccttgaacagtaatagtgaagatatcccatcagtgatgttcgaagctggaggaggaaactacatccatgcatgtcaggaggtggcaaggatcgccataggagagctccgcgatcgctacagtgatcagttggctgacactgagtatcgctaccatcctcgccaaccccagggaagtgaccgtggcagctaccttgagactgaggggattgagaatgatgctaccacaaggcatttggttgagatgctgtgggctatggatgaaacccgcgcggaggttgtgctagcagctcaagatcgtgaagaccggaatcgtggtaagatttgcaggctagaggacaaggtggatcgtttgaagaaggaactagccgcgttgaagggagaagcaccaccgcagaaggccaggattcatcttaccgcaaggaagagagctctatttgtccctcgctaccaattggcgccaaaggtccgtgtggtggagaaagaagttaccccagccctagcggatcctccggtcgtcaatgtaag

SEQ ID NO: 50366 - DNA, 169 bp, Oryza sativa
tgcagcccataaatatttaagagaatagtaaaacagttgtataattaaccaatattaaataaacaccatacaacacacccgtgttgcataggcccaaccacatttgaacaaccaaccccagttgaacaaattaaacctccaaaccaggaattatccattccaaactagg

SEQ ID NO: 50367 - DNA, 1501 bp, Oryza sativa
ttacatcaattaagcatttcacccagatcaagaccagtcctataaatctcaaataataacaagaaacaaccaaatgctggaaaaaatggaaaaatatttgacccataaatctgaaacaatgctggcccagttttagagggctatcggtatttccaatacaaagtccagctatgttggctttacagggaacaagtccgaacgtaaattatgcagttaacccacaataataaacatacaagtgtaatactatggtttccccaaaaagtgccctgtaaaatgccatggaacatatattcatcatttgggaaagcgaaaataaacagatagttgatatgtatgactgatagcatatgttcatataaacaccgatagcaccttgtacatattaacaatagcagaaacaataggtcaaactgtctttaccttcactgcatgggaccaacgaaaatggatttccagattgaaactacaaagcggtctttttgtttgaagctatgggaccaaaagtccagtgtcctcgatgcaactgtctgatgaactgacaataatcagataatgcagttacatatgaaactacaaattaagagctcacctcgtcgattggcactgtctatcagtctatggcacaagtactgctccagttaactccttcctagctatcctgcacctcggtagcgaactgcaggcctatctgcatgatcattcttgttgaagtgcagtgatgctattagtataactttatactgagattttggagtccttccatcaaccgattaaaaattgcaatatacaagtagaaaatcatgtttatttacctttagaacaacggtcatgagccactgatttaaattttctgaacctctcttccaatcttccaattattttttctattttgtcttctctctgtttttaactttttttttctcttttcatcccttatttttttttatgctccttcccctcccttaaggctggagctcgcgactcccatcctcttgcacacgctgcgtcgtcgtctcccagccacaccatacaagctgccgcatcagagctgtagctagctagctaggtggtcggcaggagcaacttgctaaggaggctatcgtcgtcgtcgtgtccgctcagcccgtgcatgtcgttgaagggaagcccagaatggggatgggcagcaggcggcgtcggggctcgtaggagagtaggtggagattgtgagctgtcatcgttttgctcagatctggcgcccctgagctcgtccgacaaccggtgcggcctggacgggaaggcggcggcggcggcttggagggcgagtcggcgacggggatcggtggcggcgaggagcagatcggcgcggtgttgacggtcgttatcgatcaatttcgaccgtaaatattaccaaaatagaggagaactagtgatgcttgcaatgcataaatatgttagaataataatattccactagtattaggtatactaacctcttgcagggaatgacactaaagtg

SEQ ID NO: 50368 - DNA, 452 bp, Oryza sativa
gatgactttatttcctatgggttataatttgattagcatgaaccttatatattggattggttcggctaaatgctatatgtaagtttgcttagccatgcttagaaacattagctaacaaaaggagttaaatataaattatattacataattgttattattaattagggttatattcaatggtagctcacgatggtaaatcgtgtgatgttaattaattgataattaaaacctggataaggtgggttgtgagcatatggttttgatggttgtgctcatgacaattaaggaccggttcgcgagctactgttgtgaaacatttatcgtgccaaccacaagccagcgtgggcaacggctttatcttttctatagcgtgattcattatagtgcgcccgactgagaagtggcgagaagtccatgggggtcgctggggagtccatgccttgttttaaagg

SEQ ID NO: 50369 - DNA, 605 bp, Oryza sativa
attgtgtgcctcggctgattcctggacgagggtttacacacatgtaagcgtttggaattttggatagaaattccgggcgtcataagttggtatcagagccacattgaccctaggttatgccaaatggatacctatagaagccctctaaaaagattgaaaaagtagaactgttctcctctctttctcttttaattaaaccaagctaatggcacatgcagtttatagtccctttaattgttctcattcaaaatttatttattattcctgtgttgttagtactgtacatctattactatactaatggcccactttctagcagagattttacaacctttcatttatttatttatttattcaatcatgttgcaatataatttagcatgttgattttataactctcttttattttatttcttttgaaacctgttattcaaaagtgcaaatttgtgattctgttttcaactgtttcaacttatcttgcaagattggtttactttatttatttaccttttactttgattttctaactttattcaaattaatccaaaaacttgtgctattaattggataaatgtcttaactccctcctttcacttgtctttaga

SEQ ID NO: 50370 - DNA, 1501 bp, Oryza sativa
atgtatacttcaatgaaaactcatgagcaagcaaaataatgaatagcactaagcatggtttctcaatttctcttctgtccataaaattcctcaatttctcttcctctcccacagtgaggatgataagcttcacagcagtcccagaaagtgaattttatggcagaaaaggaaaaatcataatttgccctgaaagcaaatgcaaaaaagagcctatgtgtatattatcatgggtaaacatatatgactattcagctgaacccgttgtgtgctggaactagttttgctgaaagatggtagtgttggttatgggacctggcattcttcactaaaattccatttaaggttttataacagagtaaaaaaaaactgatgttagacactatactgaaccgatcactgcatccggcaagctgtacacggagccaaccaaatgaaattattcgtgttggccatttcagttagcctttatgtacttgaataataacaagcaacaagagctaatgatctactgtcagatgggatccaaaccgctaggcaattcaaccagtcttatcagaaagcttgtctttatcatggattgactatacatgttagcaatttctgttgcatattctcaacttggacgtatgcatcacatatcaccaacttgaatgcctacaccacagatctatataaacaacgaaatgaggataaacaggtcttaccttcacaacaggggcatatgaagaggggaatgggatcagtgcggcgtcgtgcgatccggcgcaaagaggaccaccgtggagatcaacggagacaaacggatccagaagccagacaccttgtcgattgcagactgccattgcgcgtggagaaggggagtcggcgatgtaggccaccgcggagtgcagtggtgggcccaactttttgaacctgtgtattcgaaatgggaagggttaaaaaaattgttcatacacctaaaagcctaaaaattagcttgtatagttctgaaaattaaacaattatggtaatatggtatgaactaagcaagcaagtatactaaatcaatgaattgtagttcccaatcctaaaatcttcattacaagtatcaaattttgcgattttagtcatagagacaaaaaaaggaataatgagttttatatccttactgtcgatgctaagtatatttaaacatagagaccattataagtcagtcagatgatataatactagtactctagaataaaatgtcatgaaaacttgggccaagaacaattctgttatataatttctagatgaatgaataatatagtgtactgaaaactatgatgtaccaatcaatcaaaacataaatgattcaggcattggattactgaaggaattcctgaaagttgaaaactcttgagaaataatctggtgaagtggtgatgacatgttgatatatcccttctcttttgctgatcttttcagccttcgggaggaatatttacctgctgaggaggtgctgaggaggtggccgaga

SEQ ID NO: 50371 - DNA, 1501 bp, Oryza sativa
caattgatactatcatgctcaaacagattagtcaatgtgacattaacctttgaatgcatatcaattactattattgctaaatcagggaaacaagtttatattacttcctctgtttcataatataagtcattttgactttttttttccagacaaacttctttaagtttggcaaaatttatagaaaaaaatattagcaacatttacaacaccgaattagtttcattgaaaccaacatttaatatattttgataaaatgagtgttttgtatcgaaaatattgctatatttttctataaactttgtcaaacttaaaaaagtttaactaggaaaaaagtcaaaacgacttataatatgaaacagagggagtattttatttgatcttagagcaaagtataactccaaaccagtcagcactttgaattcaggaatcgggatgcatgttaaatttgttaattgaaataggttgagttgctatttgtaaaacggtcagaacgaaaccataaaaacaaaaaatttagttctttgtgtgattaatcattccgacatagtagcttccttacgccacaattaaaagcaaaaaatatagtaggtaaccaagtaatttggtttttgaaaggaaatcagttttcagttgaaaataaagcataaggctgaaccatgtcaaatttcataacaacacaatggagtcatagacaggttaccagatgcaacttctctttctcgtgtgcctgcacatccttcagtaagttggcaagatcgccacgacaaatttctggcgttgataggagggctaccatttcgagaacctatagggaataatatgaaatatataactttgtatgataaaaggagatgagtcaggtgataactgcctaacttgtttcgagcaatcattgaactccgccgtaacactcgcgcatagttgttgaaaagctaattcacctccattagccatgtattcagaaaaacccctgcataactttcaaaatgagataacaaaaagaatggtcggaaccctcaaatatgacgatgctgttttaaataaaagatttccatcacagtatccaaaataaaccatgtatgcgatacaattagatttgagcgttgattttcagcacttcaagattgtatgcttgtgagttgtgagttctactttttaagttacacttcaacatgaaacagctttgctggctcaatgtagtgattatgattttaattctgtacaaaagatgagttaggttaaccagcataccaacattatttaattgctgttagcaaatacgacagtcagtgacatctttccatatgtgatatcgtattttctgttcaacatgccacttgaagcatataatgagttcagtaataccgacgcattcctttcgtttcgttgccataatttcagttattttagcgttgcataagggtgatactacttccgtgctccaggaaaaggttttatcattttgttaataacttaatatctccaatagctcatcttttct

SEQ ID NO: 50372 - DNA, 1501 bp, Oryza sativa
ctaaagaaatttgataagaaaaatcaaaacgacttagagcagatacaatagcaggctattagccagctgtaaacatattttactaagataaaagatgagagagaaaagcagcagactacagatctatagccagctgtagcacggactccaagatgtaatgtgtgtatgacgtatgtgaccatatattaatagtatagtaagcaactattgtatgaattggctattagattggctatagatgaattgaagctagtagtaggctatactattaaacttgctcttataatatgaaacatttggagtaggtacgaggcaagaccactcctaagctaagggcctgtttgaggagctttcagcagctgcagcttctcttagaatctttagttaccagacgctccctaaaactgtccagctttttacccagattctgagaatctatagctatagaatctggaaaatgaactagaagccagaagctgggtttcccagtttctccagattctcacaaactagcttctcagcagctgcttcttagaatctcaaactcatccaaacaggccctaagagcaattgaaaccccacccaagcaatcatcacaaatcaattttttagcttttcaatataagtctagaagtaagtgattttcacatgtaaatccgtccccttgacgaaattgaagtacactccttgtcgtttatcgtgtaaaccatccatgcatctccacgaaaacgagaatgactatcaattgcttgaatcggatagtttcttgcggatcttgtgcaagttcggaattccatttcaaaggccggaacttccgattcggcatgtttcaccggaaggcttggctgcggtgtgctcccgtgttttcgtgcaaacacctaactagaaatccgtatgattgtaatatacatgagaattaactaggattatcacacaattttccatgtacctaaacgttcctaaccatcaaacagctctaggtatcgcatgatacttgagtatcagccgatacctactaggtatcagtcgagacctcagagatattattccgttcgaatggggtatcagccgatatctactagatatcagacaatacatgtaaggtatcataccatccgaactagatactgttctcatttgccattttagtaatatgccacttcaggcttagaacggttagaagttgctgaggcccatgaaatttactcgaaaaggaagcaaaatctgatataaattcggtgaggccaccgccggccaccgcgtccctttcatcgcgtggctttcccacacatcgctgtgtctctggacgccatgacaaaacaaaccaaccccttcaaaataaaaataaaaataaaaataataaaaaaaaacaccacccttatctaaattattattattattatcatctcctcccgctcccgctcgctcgcgccattttccagcccaaagccaagcgcctcggctcgctctcgccgcctcgccgcgcgccgcgcgctcgcca

SEQ ID NO: 50373 - DNA, 1501 bp, Oryza sativa
tcctcgtttctcgcgcccactatcttgccccctcgtttctcgcgcccacgcttccactaatcccattcgcccgtttgcggtgcatgaggtggatatgcggccgtggcagtcgagatggaacatctcgtgcgcgcgttaattacgctcgccgaccgaagcgccatcaccatatctccaggaaaaacgaaccggcttgtcccgatttttggaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggggggggggtcgggcccgagggtgatacggccgcccttctctttgtctccccgaggggtcggaccgcatccgtctcggccccgagggtcgaggcgccccgaccccttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggatgagagcctccaatcactcgtccctagccggagccggcgtgttagctcctggagatggcacgttggtcccggtcagatatataccaggcttcatcctaaccattacaagcaagactttgtatgaagaggggcgaacatgcagattgataaactgacgcgtggtggacaagaatgaccgatttgtgaccggtctgacactggtcatgtcgtcagcagacagccatgttcccacgtcgcgcctgcttccgacggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggattgatttttcggatccagaaggaccagagagggagagagtaagagctctctggttctccagctcttttgtagcttcttcatacacagatccaccagaacacaggagtagggcattacgcttctcagcggcccgaacctatatacatcgcccgtgtcttgtgtgtttcaattctcgcgaaccttccacacacagacaaggagcttagaatctcacccagggcccccggccgaactggcaaaggggggcctgcgcggtctcccggtgaggagccccacgctccgtcatctggcgcgccaggtagggggttctacgtgtgttcttctaagctctcgcactctttcgtgtgcgccaagcttttcctgttcagcccaa

SEQ ID NO: 50374 - DNA, 1501 bp, Oryza sativa
ctaagctccttgtctgtgtgtggaaggttcgcgagaattgaaacacacaagacacgggcgatgtatataggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggccgagacggatgcggtccgacccctcggggagacaaagagaagggcggccgtatcaccctcgggcccgacccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtccaaaaatcgggacaagccggttcgtttttcctggagatatggtgatggcgcttcggtcggcgagcgtaattaacgcgcgcacgagatgttccatctcgactgccacggccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatca

SEQ ID NO: 50375 - DNA, 1501 bp, Oryza sativa
tgaaagcaactttcaatgatctgtataaatttccatggacactatggccttggcatgcatgcgtgtagaaacagaggtacatacacgtacatgtatatatgtaccaatgatttttaatgtgtgtccatgtattcatgtctagctgaattgaatgggctctcaacgaattctctgtcggtgcggttactgtacagttcgatcattcgatatgttttcagaaagctctgcagtaaattaaatcaacctcgtgatttttttttttgttgatgtgacgctcatgttagcttgagcttcatccggaagaactatgaggctggctctcttttagagttgaaagctactacttgagcaagccccacagattgttcgaccaacaaacattctagatatatacaggcaacaaagcgtcaaagcaaacggcttttgatctatgtactcgggcctcgtttcagaaatgcaggaagccatagctagctgaaaccatttctttctctcttctgttttttatccttgttctcgttgtgacagatggtaacctgacggctacattgcacggtgacacccgccagcgccaatatttagttttgtcgttcgtgcagcacgtaggctgataaacctgtaaccgggattactctgggctaaaatatatagtgatatgatcaaaggacatgaagtagagcattagctgatcttttggagtaccactttaatctgaagtaaatttgtgcccatttcacggtagtacatcatctttctcaaagttacttgtactacaatgatgtgctttgtctacgaggcaaaaataagataaactaccaacgattaaaatgtaatgaagggaacaatatggtgccgtttgagtttgatgaagataaagattaagtaaaaatatgctaaacaaaaaaatcatcagcacctaattaataaagttttatttattataaacaataaaaatatatttaaattaatattttagaacggccattatataaaatatttttgaaaagagtatcgtttagcagttaaaaaaagtgttaataaaaattgagatgtactccaatttgtatgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgc

SEQ ID NO: 50376 - DNA, 639 bp, Oryza sativa
tgtgcactttgaaagaaatagaagatggtatttcttttcgctttttccatgaggagttcacgctcacatggaagggcttaagtacacttcttagctttctcgattcctgtaagatcgatatccagaaaggaatttcagggttcgagaaaaataggttttgggaagatatttctagtgctccaatttgcaagaaacctagaacggatgatatccataatcctacacttaggctcatgcacaaatggattgctatgactttgtttcctagaggtgatctgagacccattaggggagatgaattaattatcatgtttgccatggttagaaaaatcaaaattgctcctgtgaaatgtatgataaggcaatggttagaaagtataaagttctctgctcctgttgagtgcacttctctgattacttggatagcaaaagggttaggggtcgttagcaaccaaattgcttttatctcagccgctcgtccgcgtattgatgaggcttatctagtgcaagggaatattttgaaacatggggcagatggatctttgatatactttttccccggttgaacaaatgaaatcccgttgccaaatgcggggtatcatttgtacaactgccatgaactaaccattcccctgcaga

SEQ ID NO: 50377 - DNA, 1501 bp, Oryza sativa
ttacttcctgctattctcttcatgttgtcattatttagcattcaaagtattccttcacacattcaaccctgatgtattcttttcagatttctcgtatcaatcacctttcgacctacttctttgcccgacaataaacacctttgctggtatcttctatcagtcacctttggaactttgtcaaccaagtactcttcactccgagagttgtggatgcttctggtgacgatgtggtcctttggtctgctgcctttcagtgaaaccttgaagtgttttcgccaaaagctatactgactgtcattgcctttgatccgaaaaagacatgtctgaaactctcagtccaaacaaatgtctctttggttaatcgcttgattttcttttccatcatcaggttggttattaactcgaggttagaacatggttcctctgaaatgagaccctaggtctcctttgacagtaaacaattatacacataatcccatatcagcatcttccgaaataatcctcatagaacttgtttttattacacatgtctcccttattacatgaatgcaaggccttgccttaaacaaaaagggaaggtgcttaacatcagtacattgcatcctcaacatgaatcttccataaacataacaaactcattgtttataatcatgaatgtatttatttattacatgattgctgcaaactcacgattacacaatgataagtagcgaactgaaaaccacaaacgtggctactcattttgattctggagagatatagctggcattgtcctagtgactgcatccttgattggttctgtgatgatgtgttaggactgcatattgctatcattcacaggagaagcttccttctgattgctatttgaagcagataacggtcttctgcttggtatcgcactcctgagattgattgcccttcgctcggcctggagtaggtcggggagagacacaacttcttccatcgacgacaattctttgctgaggccgtcggtgcagagaatggttggtgttgaaggtattattgctatgatttactgcagagtcaggtgcagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggttggtaccttcgcacagaaaacatgtgaccttgcgggtgggacattcacctggtggatggtcttcttcacaatgagggcagagtgtgagacacctgctagcaatgtgtccaatttctccacaacgggtgcatgcctttgattccatctcttcctcgccgagatgtcggggagactcatcttcaacatccgaggagacttgatctgacccttcactatcagatactctgccaccatggcttaggaggtgctgggtcaactgtcgtgcacctcggaaggtatttcctctttgacgtctaggaatag

SEQ ID NO: 50378 - DNA, 704 bp, Oryza sativa
tcaagcgcttgtggtcatcgccctagtcttccgctgtttctcgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcatgacagaaggcatgacaagcagcaggacaggtatcttgaagaagatgatggtggttttgatccgtattgggattgtgagtttttcaggttctgctggaatgaagggatgaggctgccatcaatagaagattgccctggatgcagtgataatgcaggaagttcgagccgatcttataatagaggaaatcagctgaatcagaaaaggttgcctgttcattagaggttgggtccggtacaccaagagcattttcaggatgaagatgaaggcagaaattcacagtggtgcccttctggtatttttactaaaaatcagaagagaagggtccagaggattagaaatagggagcgttttcaggaggtacaacaagagatcaaccatcggctgaagaagacaaagaccaagcaggagtggcgcgttaagagcaaagtgctgtcagccgatgagattgaggccgacaaagcaaagaggctagccagaggaaaagctattgcatctt

SEQ ID NO: 50379 - DNA, 530 bp, Oryza sativa
gtggctttccgatccccacctcaaccggtcaacagggagcctccaataactccctatttaagttgagatactccacttttaattcccagtgtggtattattatctttaacatttattatgggcccttgagattttaatagaaaaatcgggcctagcccatttattctaacacaaagtaagtaacaacatccatgaagtgacctgcatgagaaaatactcctctctcttgccactcttttttatttctgccctcctctctctgtcactaagtcctctccccactcctctcccctctcccctcactctcggtgagtgagggccacggcggctatcccatcatgggtctggcagagggagcgagaggctgacggaggagtggccgagcgcagatccagcggcggccggctgccgtccccagccctgatccagtggcgacggccctcccccacgcggatccggtggcggccctccccgcgcggatccggtgcccctctcccttccgcgcggatccgtcggtggcggcgacgcaa

SEQ ID NO: 50380 - DNA, 1501 bp, Oryza sativa
tggaacaatagcgcaaaaaatacaggcacattttacagcgccaccgttgatgtttttgctacaggatttgtaacgaacaacatcagttttaaggtatgttcttgtgctcacaaaacttaatttgcttaattatgtatacggcagaagggtttagtttatctactgattcattctgtgtagaatgcatccccagctccaaagccgggtgatcgtgacggacaggctgtagcaattagagtttcaggtgatcaagcagcgttttgggttgcggcatgtatagctaccaagatacattatttgatgatttaggccgtcattactttagtgattgttttattgaaggttcgattgattttatctttggcaacggcagatcattttatgaggtacgtaccacacaaatcttcgatggttctagttacgttttattttcattgagtgagtaacaaacttgccatgcatctaaccaagtttctgtgcgtttttcagaagtgtattttgaactcggtagctacaagcgatgggatcaacggtgcaatatgtgcacaaggccgtgaatacgcggccgatgacacgggctttgcctttgtcaattgtcgcatcaccggcagtgggctgattttattgggccgtgcatggaggccctactcccgcgtggtcttcgcgcacacggacatgcccggtatcattgtgccgagggttggagcgactgggacgacccgcaacgagatgcgtacgtattctttctactactacttccgtttcattttatattagctgtatgtttctaaacatgtatactacggttttatttgttttaacagcacgatgttctacggtgaatacatgtgtacgggtgtgggcgccaacatgaccggtagagtaccatatgccaaaccgctgacggagcagcaggcgcagatatacctggacgcttcctacgtggacgcggatggctggttaaaaccgttcaacgattctcttatagttaattgagtacaataccatgtaaataatggcgggggtgcaattctttgtacttaacacggttgtttagtactactaagggaccacctatatattcgtcgataaattttctccaaaaaatttgacagatgtaattatagtacaatcgtaatgtaattacactgtaacttatatgtaattacactgtaacttgcatgtaactacagtgtaacttgtaaataagtttcatttaattttgaatctttaaatctattacaagatttgttttggtaaggaagaaaaataaaatcacagcacacatatatgtgtaaggatttgtttccacaatctctattttaccgaaataacatattacagagacatttttgaaagttacatacaagttacactatagttacagtgtaattacatgcaagttacagtgtaattatattacgattgtactgtaattacatctgtcaaatttttaggagaaaatttgtcgacaaatatatagcaaaatcgtactactaat

SEQ ID NO: 50381 - DNA, 876 bp, Oryza sativa
cggtgcacgtcgaagtcggtggagcggtaggtggggacgagcaggagcttgacgcatgtggcggcggcgaaggtccaggccgccgcccgcgccggggaggtggcggcggcggccgccattggggacgagtagatctggtgatctccagagaggggttgcgtttcgggtggttgcggtgatgagacttcagaaaattcgtaactttagggctgtttggtttccggagacttattttaaatccctgtcatatcggatatttgaacattaatttagagtattaaatatacactaattacaaaattcatttcatgagcttggactaactcgcgagacgaatcttttaagtctaattacgccatgattttgataatatgatgctacagtaaacttttgataattatagattaattaggcttaaaaaattcgtctcgtggatcatctcttatttatgaaattagtttttttattagtccatgtttaatactctaaattagcgtccaaacatccgatgtgacatggtctaaaaagttttagccccatctaaacaccccctttgtggtagtacacaggatcgttactggttactcattttcatttatcgccaaattgtgagtaaataagtactccctccgtttcaaaatgtttgacaccgttaattttttaagtacgtgtttaaccattcatcttatttaaaaaatttaagtaattatttattcttttcatatcatttgattcattgttaaatatactttcatgtacacatatagttttatatatttcacaaattttttttaataagatgaacggtcaaacatgtgctaaaaagtcaacggtgtcaaacattttgaaacagagggagtactccggataccagat

SEQ ID NO: 50382 - DNA, 1501 bp, Oryza sativa
ttgatggtgtcgcgaagatcgatggggcgccttcgatgtggggagtgtggtcgttcaactcggcgctccctatatcgctcgggaggcgagcgaacagaccgttcatcatgtcccctgctcctgcgactagattcggcgccggcaatgctgaggcttggctggtgatagtcttgagatcgaagatgagggactcggctaccagtcggggtgcgggtgcttgcggagttggccggaaccgaggcagcgatcatggtcttcgtctggttcaagatgttgactacatgatcagcttggttgagtgcgtcttccatgaggagggtcttgaggagagtgattgctgcaaccgcgttctgctaggggtgcgaaagaccgctctcccatcgacgtcttgttgtccaatgagctctctcgctcgccgcctagattccaaggcgcattgtcgtcgatcttcagcctcctttgcaatccgttcgcgatcttgttgctcacgctgtagtcgttctcgctcttgtcgctgtcgctcttcctccagtcggcgacgttcagcttcttgccgtgcgcgatcttggtccgcttctcgggcttggcgctgttcctccgtttcgttgtcagccatgaatacgccgaagaagaggggcgtgtagttatcctcatagttgtcgtcgaagttgtcgaggtcgccgtggtcgtagtggtagccaaaatcgtcgtagtcgaggatctcggttggtcgagaactgatgccgggggagctgaggtaaccatccaactcttccgtcgagactgtcccgagaggttggagtataacgccaacctccctggatctagatcggatcggggccgaagcttgagctcgcctagatcttcgagtgggagatgtcttgactgtgaagacagcggccaaatcatcaggaagtttcatcaggattgagggataggactcgtcgtcttgatctggtcgcggaagagtagattggatctcgtccgagtggtttgaagccgactcgggagagatgatcttagggtaggcctcggccgagttcggaataccgaacggcacggggacctggtctatccccgactggtttgaatccgagtcaaggagagagatcttgccgaagtcgttggtgatgaagttgaggctgccgaaccggaacgcctgcccgggagggaaggcgaagtcgtcgatgccagaaacgaaacccatcgcacttagtcggcgagaacttgatgctgcccctacctggcgcgccaactgtcgaagcaagatttcgacaataataaaagggggtggctatcaagctaggaaagtggatgggttttgagacaaggaattttatacaggttcaggccttcttattcaagaagtaataccctactcctgtccggggatgattccgccgagtgtgttattgattgtataaagtggaaaaaaagaatcgccccccaagaggcacacggaccctccttaaataggggaaggagtccgctttacaaaata

SEQ ID NO: 50383 - DNA, 1501 bp, Oryza sativa
aaggagaaagagtgcaatagggtatgttggaatagaatccaatagggatcgagcacaaggaaaaagagcgaaatgtatacattgcttagggcctttcctcgtggatgtcaggagtggttgagcctgccctttgaatgccccatcaatgttgttgccatctccccaccgtggggaatgccttatttgggagccccgtgtcggggaagccaccccgtaggctccttcagggtgcccctctccgaggcatttttatgggttacggggggcctctttcttccccaaagcccctccaaaggctttcttaggggccccttgtccgaagccggtcttgagatgcacagacagagacaaaagagagaagaaaagggggcaactgcctccctaggacgagggcaaagccgctcccccaatagcgataatatatctcattaccaagacatttagtgccatttcattatttacaagcccaaactaggaattcaggtattcataacaacttagcgtgttctaaagtctttcatggccttatgtatgtatggtacatcctgacccaattaggataagacttacgtgtcgcatgagagctatgtgtgcatgtttaataccagcttgctagtttagcaagtatagaaccaacttataagagcttgtctctccaaccatgtcactcttggcttaaccgttttacacgaagtgaggatgaaagtataatgggatagtatgtgtaagtatgcccgtctgttggatgggttgggttgtgcagttccgaagggcctgctattacagtgtcggtctataagtccatatatgtgctggtttctgcaaccggcactgatgagccatgcttttggtgtcgatttcaaaacaggcacaacaacacatgtgaggcctatgacggagaaaaaaaaagggagtcggctcgatgaattgtgccgatgcttcgagcagcacatccccccatatccacatccatggcatagattaagaagccatgggagaaaaatcaagaacgtccattgtatttcatggaaaaacaaatcaagaacattcatcacatataaggccctacatcaacaacaataagctagctacattgcacacaagagttcatattcagatccaacaagaactcataggccctagaacacaaactcccatacatttccctttccacaaaaatcgagaaatcccaagacaaaaacgcaaaggagagcaccacctggagacgaagtaatcgggccttgggcctggttgctggatgatggtgagcagttgaggtcctcgccgttgttgctagggaatccccgcaacagggagggggccagttcaaggaggagtcctacctcacgaggcccttgaagctcttcatagttgtaacatcccggcctagggcttaatagaattaatagaatactcatatcaacaagttgcaacttcttttccggaagccaatctccaaagaactccagggttaagcgtgcttggcctggagcaatttggg

SEQ ID NO: 50384 - DNA, 1501 bp, Oryza sativa
tacatacataaggccatgaaagactttagaacacgctaagttgttatgaatacctgaattcctagtttgggcttgtaaataatgaaatggcactaaatgtcttggtaatgagatatattatcgctattgggggagcggctttgccctcgtcctagggaggcagttgcccccttttcttctctcttttgtctctgtctgtgcatctcaagaccggcttcggacaaggggcccctaagaaagcctttggaggggctttggggaagaaagaggccccccgtaacccataaaaatgcctcggagaggggcaccctgaaggagcctacggggtggcttccccgacacggggctcccaaataaggcattccccacggtggggagatggcaacaacattgatggggcattcaaagggcaggctcaaccactcctgacatccacgaggaaaggccctaagcaatgtatacatttcgctctttttccttgtgctcgatccctattggattctattccaacataccctattgcactctttctccttgtgctcgatcccttttggattctgttccaacatacctccatttattaaatagatgacgtcattgacttttagacacacatttgatcatttataatattaattttttacataattataatttattttgcagcgagttattgtgccactaaaaagtattataaacatggtttatatcttatacatttgcatacaatttttaaattagatgaatggttaaatatgtgtccgaaagttaatgatggtctctattaataaatagaggaagtatatgctatgtaactttactttagcacacggcagtatataggaatctactgaaatgaattaaggtcatcacacacgaaatttcgattactgatcagtaccaatggcagctgggatcacagattagattcagaacaattatactaattcagagtaattaaggatataaaccttcaataaatagaaatccttatttatatagatcaagtaacttgcactggaagcacaaatttcttaactgtaatagatcaagttatggtaaaaaaaacgtaagttatatacacacactcgcgcgtacaaaaattaattttcacccaagtaattaattcatcagagaatatatgcaggacttgagttgcatatatactccctccgtcatctaatataagggattttgacattttgcttgtcctgtttaaccattcgtcttatttaattttttttagaattattatttatttttacttattttattatccaaattactttaagcgcagcttttcgttttttatattttgcacaaatttttttaataagatgagtggtcaaatagtgcaagcaaaatatcaaaatcccttatattaagggacggagagggagtagttattattttcagtttttcaccctgataaataaaaaatgcagaatcatgatgggcaataatgcataatgcacatctcatgcaaacactgcggttgtca

SEQ ID NO: 50385 - DNA, 1501 bp, Oryza sativa
tttttttatatatagtatttgtatttctatacataaattttttcaactttgtttttttattttttaaaattgtatggtgtactgtagtatgaagagaagaaagagaggagaaagggggagagaagggagcatacagggggagcaggtgggcctgtgatcgccgcccattagccgtcccccttctatattcaactcctttaatgattgggctaccacgtgaaaacacttagaccaagtcgatctgtcattatggaaaaaccgcttttgaaaccacccaaagagtcaatttgaactggtttttgaaattgtgcaaggtgttatatccggttttgtgattgagggatacgattcaacgaagcaagagaggagggagcaaaatagacttattccaatcaactaacaagcaattttgacgtcctaacatctggacgagctaggcccggtttcggacctcagatggcctcacaggccttacagacaaagcccacaagatcaccttgtaagacagcctggtttatgggccaccgtgtagtcatctctgggtaaaaatggacaattgtgttcttatttctgttctttaacttcagctacgattttaccttttgttttaactttgtgattttgtaatacttcagttaagattgtatccctattttttgaagtttttgattttgtcatttttaactgaagtttgtatgtgctcttgttaacatgatttaacggtgttcgtccctacttttccgaggacattatgattttgctccttttttttttacattaagcttcattttataaatgttgcccctattttaatacgaatttccacttgtttagtaaaaaaaaaactaagggatagagcaaactcaaaatgaattttgaccctacatagttagtcatcttaacggaatggggtaagcacaagcttcagctcaaatataaggacatgatcttaaagttaaaattaaggataaaatcgtaattggagcaggggaagccaccgatattatgcacatgtaagtgagctttcaatagaaaattaatgggattagatatatgccactggtttcctatatctttgagcgtgtgttagggatgtattcattagtgtatgaatgtggtgttgtgtgcagtggtgtgtgtaaacatatttgtatgtcgttcaattgttaaaaaaaagtaacaggagtagaaaataagggtaagaatgcaaacaagaaagctatttttttttggatggatcgacgacttgaacatgtgtgctagattgtactacctctgttttctagtagatgacgtcgttgatttttgaaacacgtttgaccatattgaaaacatttatgtaactatcttttacttattgcgagttgttttatcccttgaagtactttaagcatgatttatgtattatgcatttacataaaatatttaaataagacgaatgattaaacacataacgacgttatttattaaaaacggaaggagtaaaaccacaaagagcatt

SEQ ID NO: 50386 - DNA, 1343 bp, Oryza sativa
gtgtaacattccaaaggacaatattgtcattcagtaagcacaccctctctccttcattcaaagaaaataagtaatataataatatgtaagaagtaccaatgtaaatgagcatagaaaaaataaaaatcaatgttccttggcaaaaaaaaaagtgtgaagcaaaattactgctttgaatggttcccgagtgttatgatttacttattggcaatcattcggattctatagttcggcattgccaagcacaacacaaacaatatgccctgatacatgtgttatctctctctttgttttttttttgtcattgttgtcagtggacctccgttagcatataagaaaagactattttgcccctaagatatcacacaagcagttaagcaaatgtattgcgctaagcatagtgagattcagttccattctttcactagcatcaaaataatagtatatttaattgcattattgagaggactctacgcgtcggaagccttatgccccctacatcccggcaagcgtgcatgcccaccaaactcttgggagagcatgcatgttgtttccgttgcttgctactccatcatgttcgactgtacacccatccatctctcgctatacttttagtaaaactttttattatttttttctaaattacttatttaatttacaattcgatcgtaccaccgttgttgtaactaaatttttttaaaaagatccaaaataattatgtttctttgataagaaaatatattattattttcctaactaaaatatttatatattgcacatgcatcattgagttgtaactattggaacatcatgaaaacttgctggaacatcaaaagaataccagtataccacatgcaatattttcaaatgaattagtaaaacatccaaatagcaccatatgcaacatttaaaaaaaaatcatagcaacataatagcttacaatgtgcaaaagagttaaaaacattgagttgtaactattgaaacaacacaaaatctagttgaaacatcataagaataccatatgcaatattttcaaatgaattagtgaaacattagaaatacttagtgaaacatccaaataccatacgcaacattttaaaaaattcatagaaacacaataacttatattatgcaaaagagttaaatttcagtggtactactaataagagggtagcgcgttgattagccgatcgcgcgcctcatcccgatctggccgacctccctcccacctctcgattcccacgccctcccctagtaattgttttactagcaatttcatatcttattatatataccgtcctattttttctgaggagttaaattcctacttttacggatgtagt

SEQ ID NO: 50387 - DNA, 159 bp, Oryza sativa
ccggtttgtcctctctctgcgcagtaccgttggtttaattttggaacgtaaggaatacatttgggaataagagcaatacatgcctagtatatacgaaggtgagaggctaaagctagtcgacatggcatccagctggaaggagagctacctctctacaga

SEQ ID NO: 50388 - DNA, 409 bp, Oryza sativa
cctcaaagacacaatataataatacattttgaaaggaaaaaaaaaacatagaaagcaagggatgaagaaatgttggagagtattccaaactcgcgtacaagggaggacgcagggagcctgacaaactccatggaagggttcatatccgagctccactgagcccctccaagaacacgagcaaaccgtgcccgagggagatcggattaatcaacagcgctctcggttttgcaacatcgcatgcatccacagctcatgtgatcacgcaaccaatcaatagaaaaaacaaaacaagtaaattgagcgagcaagaagaaccggagaattcagagaagcgctggagatcaagaaccgtaagggggataaaaaaatagacgctactaattccatgtcaagaatatcaagatcgcga

SEQ ID NO: 50389 - DNA, 1501 bp, Oryza sativa
agattgatagttacactctgaaatagggtcaaatgagcaattgtctcttttttatatatattagttagagaaaatatggcaattttttttaaaaaaaaaaagtggggataccagatttattttttagatgaagatctaatggttaaaattaacgggtccactgatttaaaggaaaatcgacgatgagattatagaataccacatggtgacctaggagcgtttgtaaaaggtcacgtggcggctaccctgcccgatcctgacccagttatggtgttctcctcctttttttttctatatattagttagagaaaatacgacaattttttttaaaaaaagtggggataccagatttatatttattttttagatggacgtgccgacgcagaacgtgttcgacaacgcctactaccccaaagcaaggtcattaaatgggaatacatgttttatcatgtgctacactaagttgtgatttgtgaaacatgtgcacaaatctctacaaacaataacaaagtttatgcttctctgctgccatgaaaatattgtgattatattattctactatttaccattgatgaacacaagttctacgtatttacaatcatacttctctttctcccacattttatttttttttcaaaccaagggaggctcccacgatatatattaatttctgaagtttatataaaaataatggcaaacgccaaaaaaggggaaaaattggaggagctgaaaatgaaaattacagtagatcaatccttgagactaaagggctatgtatctccttgagccgaagtaaatgtaggcttaaatcggacttatgatttcttttctaagaaggaatagaaggctaaataccctgaagaattagaccattcctttccttccaaatattctaagcagctaagagaaaaagttacataaagcatggatgggagaatgaagcatgctgtgattatatcattaggtatttaggtgagggacatttgcttatttgatcctgtttcgaagcctaacaatcaattcgaccctactttttttagttttcttatttgaccatgtttttcaaacatgaacaatccatctaaccctatttctactgcaccgttaaagtttcatttggaaaaaaacaagaaataaaattactttttgtaatgaccaaactgccctcaaagaaaccctatccactcatatctctctttcacgtattccatcacacactctctctctctctcggcgagcagtggcggcacgcacggaggggatcagcggaagcacgggcttgtggaggaagggaacggcggcggcaaggcgtgaagggaagggatccacgccagtgccggctcgcggagggagggagcggcggtgacggggcgcgggaggcatctgcgacggtgccggctagcaggggagggagtggcggtgcctccgcgaggagggagggagcggtggcgcgcagggagggagtggtggcggtagggctcagcagtggagggatctggca

SEQ ID NO: 50390 - DNA, 1501 bp, Oryza sativa
tcacttgtctcgtgagtgagcagcataatagcatacacccaactctcaagggttccagggaaagatttatgcgattggcactataatccttagtagtagcacccacaacacaacccagagagtggaacacttttttttggtagcaaaaggttgcgagcaagggacagatgtccgagccaggagccacacgaaacaatcctggtacagatactttcggcgtttctctcgctacatctacatgtgtcacgctgccacagcctacatgttctctcatgcgtgcaggcaaccagcttttcccgtttatgctagtggtggtcacgcttgggcatttcccttccctcaccaccgttctttttttctcttttacatggcgtgtgtgcaaaactgtgcatggccgccgcgacccgagacgggaaacacgcccagaggacgcacattctccccctcacagaaagcgcgcagaaacgcttgccgggttgccgctccaaatttgcgacgtggggctcgttcgatatggcttgagcctagccgaacaatttcggcttcatcttatttgcgacgtgttgtaccggtgcgagatgcggaaaggaacaccggtgactactggtgatgagccgtgagatattcgaaagacgatgcgatcttgctctcgccgaggacggcttgccgagagaatttctcgcctttcagtagcctccatgctgcggaagtacgtatagtcccttttttgttgtagtggtgcgagagcccaaaagcagccacttcgcacatggcagcggcgcctttccgcagcacatatcactatatcacatggggggcgaaccaagcgtaactgaacggtaggttacacgagatgtacgaatacgacccagcggtaagcagctatgcacgcacggctgcagctcgacgtgcaggtttgcatgttgtatcttgtatatgctatgttgctatgcacgatgggagtgtgtttcatgtttgatcgatgtgtcgaggtaatagcgaatcggtgatttgggggtggatgccacttttcaagcctaagctaggcactgagccacacacgatgtgtagccgccttagggtgggctttttggagtgtgatcaaaagctagcacagcgccacctttctctcggatcagcgtgacggttgttgtggacgagaaacagagagccacgaaactacacaggtgcgacacaacagaaagatttttcacctgaagcaccaaattacacttttagaccgagtaaaactgggcacttccttttagtaaggtaagccgaattgtataatagcatatagaaatacaattaggaaataaccgaaagtcagaattaaaaataagaaatattagaagtagagtatagagtctatatagaaatacaattaagaaaaaaatagaaatttggaattaaaaaataaggaatattagaagtagagtagagttcatattgaaatttaaaaccaactaaaattcggaataaaaaggagcctccacgttcg

SEQ ID NO: 50391 - DNA, 1501 bp, Oryza sativa
atgtatttttgtgtctaatcaaggctttagttcgtggcattcctctatgaggaagtttctttttaacaaccataaatcaatgttagtctaaatctcgattctgagatttaaaaccgtgtactatcagcttttaaccatctcagtggttctgaagttcatccattagaagggccatgtgtgatttttagctggcgtcgtcacttttagggatttgttgggagtgtagcgtggtttggcccattcccgctactcggggtctgtttctagccgtcgtagtttctctaagcttcaacttttttcatttgctttttctccctccccctagcataagttggtctggctgactgtgtcgtataaataaaactatttttcttctaatatattaacgtgcaatccttttacgcgttcgcgaaaaaaaaacttttaatgttctaagaggctgttcatttcaaccttgtacctattttagagtggctttgaatgatacgtcactaacgtggctacgtggtccgcttgcagtcttgcaccaagtgatgtaggttgcagatctgtcttatgaaactggtttttttttatacaattttaaattcaaaactagttttgatctcgataggctgaaattggatggtctaaacgcttgaaattaaataggagtatatggcttcaaagttaaggctcgatttcaaacttcgtggaatttcaagttgtaaaatgggcttttccttaatttgtttgacctagcacattggagaagtcgatgtatgctgctattttactattgcctatagcaaaacacaattatactatagtagttccctgcgcaattgcaccggtgctaattgtattgtatctgaaatgtagaactttctcttagttctacccttgtgcttatttctaaaaagaaaattgtatttatggtgcagcaagagtagaatagcttcatcttttcgtttatgcttataattatcagccaaaatttaaatttttaaacttaaatttaaagctgattttagggttttttcattaaagtttatttttttagcctttacttttagatcgctaaaaaaattttatttacaaattactttccgttcgtaaatatgtcgtttggtttattcggacagaaggtatttccgcttaatttgtttgtgacttgagatatacagtagtactatcgaaagagagcattatcagtcccacttaaaaccctcttccgccaaagtgtgggagcccaaagcagaggtcctactactctcattttctcaagtctcaagtgacttatgcctttgttttttttccccggaattccatccattttttcaaagaccaaaagtcgccaagcaactgcccgcgggagctctatataaagcaagcaaaccaaccccatcctacactacctcacacgcctctcgcgctgctcaatctcccacactgctcggcagcttagctagctcgcggctcgcttgatcacgccattttcttcgattcgatcgatctcctg

SEQ ID NO: 50392 - DNA, 1501 bp, Oryza sativa
acgcagttatctttaactgcgatgttgaatccaaatttggtactgctggtaacacttttgttttggcctgcaatgcttcatgacttcatgtgcaattttcatttcgaaaaatgtccataacaatgagcacatgggaccatgagacaatttagcagttatttgtaagatctgtgcttttcacttttagaaaaagcctttgtgaagatccctagttatttcggttgctcaagtagccgagtgtgtgtttgttcgaaattagttgtgtgttaaaattacgttgagaagtgctacggaaagaaaataattactatgtgctttcttagttgatcttcataaaatttgtccaattattatagcaggattacagaatcacagttttttttgaatatttttaaatttaaagttccaaaactttttttttaaaaaaaacaagctttttgaccacactactagaggtagcgttgcaaggcaacattgacaacagtagtgtcatgccatcgcgagtagcatggagaaatatttgccagtccatgatttttcaccgagatgataatgttttcttgccatgctaattaaattggtgttgtaaataggttcagatctagaaatgagctttcgatgggtttatttttaaaaattaaatttagaaaggttttaaaaaaatccagaatcgtgagtgttgttatggcccactaggatacctggccattcttgtaggatcgaattgaaaaaaaaaagattgcataataacgagtaaacaaaataatacactttttaagggcaataagcaaaaaagcattttcggagaggcagagacaatgaagacttgaagagccatgtttcgactcttgcactgttgtttaccaccttttggaggatcttaaggataagcatatgccttgacatggaatgattaattaatactctcttcgtactcataaaggaagtcgtttaggacaatgtttaagtcaaaccttgggaatataaatcatgaataactctcaagttgttgagtttgaaaatgtaaaaattatatgaatatatttgtcttaaaatatattttcataaaagtatacatatatttttttctcgaacgcgcaaaaggattgcacgtcaatatattagaagaatagaatgtttgtcacacgacgcaatcagtcagaccgacttatgccaagaaaggaggaaaaaagactaaaataaagaagagacgaaaaactactgtgacggttacacacaactccaaatagctggaaggggacagagccactaccttcccaggagaaccccaaaaatagctataccagctaaagaccaaaggtggccctcagagaggatggactcaaggaaaagtatacatatatcactttttaataaatatttttatagaaacaagaagtcaaagttatgttttggagatcgtgtcgctgtccaaaatgacttcatttatgagtatggagagagtaacttgtaactgtgtttaacatcaaatgtagggagt

SEQ ID NO: 50393 - DNA, 1501 bp, Oryza sativa
tatttcaagtgcttttcctttgcttaaaactatggtgacattttgtatgtctttcacttctgtgttcattatatatttgaactcaacatagagtcagaactattaacttgtgctggcctgccacgaccagaaaggtaaaatatgtgttcacaaagttagcattgaagttgacccttcctgttgctacactattactacgaagtttgacatatgagtaattaggctgcgttcgttcgggtaacattgagggagataacatctcgttttccgcgcgcacgctttccaaattactaaatggtgcgttttttgtaaaaatttcctataggaaagttgcttttaaaaatcatattaatccatttttgaaatttaaaataattaatactcaattaatcatgagctaatggctcacctcgttttacgtatcttcccaatctcctcaatcaccttctcctcaaactcacccttagtcttgctgatcaagtgattctgccactgttggtttacatgacatatatgtaatacagattacatgagaaaaagggtagtgtttgaaataaaacatgccaattccaggcattgcttctttgttaaacacatgacatggttgtaattctctcttgttttgttgttacagactgttggaaacaagtgctttgccaagtgcgtgacaaagccaggatcaagcttgagcgggagcgagagcagttgcatatcacgctgtgttgatcgttacattgaggcaactggtattgtcagccgagctctgttcagttccacacgctgagcgacgatgtgtagccttcagttgctgcttaaatcagaattggggaaaaatgtttttcctagactcgttatttttgcctttctaatctgtgagaaagagagcaacctttatattaattaagtggcaactattagctaagctggttttcagctgttaaaagccgcaaattctgccttgcagtttctcttaactgtttgtttcttttgttccccatggggcactaccctatcctgatggtagtagcatcgtttgcattgcttgagaggactgacctgtcctgccggttgctcaagaactcatgagaggctggttgagtaaatgagtacatcctgtttaagttaaactgattccagtcgaaagtcgaaaccagctttgactataagtcactgacggtctggccccaccgttgaatcagcttcaggcggccaccaactgcagcagcccggcggccgcatgcccgcatcgtcgcccgttcaaccctcgtgccgagctgacgtttaccggccggttgccgtggcacgcgcgcgttgacgcgcctcctccttcgccgtccctcctacctgctcggcctggctgctcgcgttttttactctgaactccccgacccgatcaaccaccgcggcgcgtgagtccattcatccccaaatccacccgagaaagaaaggaagcaaagcgaagcgaatccaacgatttttcccatggagcagcccaagccgc

SEQ ID NO: 50394 - DNA, 1501 bp, Oryza sativa
aaggagaaagagtgcaatagggtatgttggaatagaatccaatagggatcgagcacaaggaaaaagagcgaaatgtatacattgcttagggcctttcctcgtggatgtcaggagtggttgagcctgccctttgaatgccccatcaatgttgttgccatctccccaccgtggggaatgccttatttgggagccccgtgtcggggaagccaccccgtaggctccttcagggtgcccctctccgaggcatttttatgggttacggggggcctctttcttccccaaagcccctccaaaggctttcttaggggccccttgtccgaagccggtcttgagatgcacagacagagacaaaagagagaagaaaagggggcaactgcctccctaggacgagggcaaagccgctcccccaatagcgataatatatctcattaccaagacatttagtgccatttcattatttacaagcccaaactaggaattcaggtattcataacaacttagcgtgttctaaagtctttcatggccttatgtatgtatggtacatcctgacccaattaggataagacttacgtgtcgcatgagagctatgtgtgcatgtttaataccagcttgctagtttagcaagtatagaaccaacttataagagcttgtctctccaaccatgtcactcttggcttaaccgttttacacgaagtgaggatgaaagtataaatgggatagtatgtgtaagtatgcccgtctgttggatgggttgggttgtgcagttccgaagggcctgctattacagtgtcggtctataagtccatatatgtgctggtttctgcaaccggcactgatgagccatgcttttggtgtcgatttcaaaacaggcacaacaacacatgtgaggcctatgacggagaaaaaaaaagggagtcggctcgatgaattgtgccgatgcttcgagcagcacatccccccatatccacatccatggcatagattaagaagccatgggagaaaaatcaagaacgtccattgtatttcatggaaaaacaaatcaagaacattcatcacatataaggccctacatcaacaacaataagctagctacattgcacacaagagttcatattcagatccaacaagaactcataggccctagaacacaaactcccatacatttccctttccacaaaaatcgagaaatcccaagacaaaaacgcaaaggagagcaccacctggagacgaagtaatcgggccttgggcctggttgctggatgatggtgagcagttgaggtcctcgccgttgttgctagggaatccccgcaacagggagggggccagttcaaggaggagtcctacctcacgaggcccttgaagctcttcatagttgtaacatcccggcctagggcttaatagaattaatagaatactcatatcaacaagttgcaacttcttttccggaagccaatctccaaagaactccagggttaagcgtgcttggcctggagcaatttgg

SEQ ID NO: 50395 - DNA, 1445 bp, Oryza sativa
cggactgtcgtaaggaactcggcagttgttgacaaccaaatttggtaatatcggcatcggaaaagaagattagatcaaagtggaatcggagacggagatcgatttaggaacagagcaggaatcggctagagtccggatcggctacagtcaggatcggcagagttcgagtcagacagggctagctgatacagccgattccaagaatacgactcggtgtacatcatcgggttgagttgatatgcttcaagatgattgccacgcatggatagagtccttagaaggcaatcgtatctattaattaggatattttatgtaatttccttagagatatgtttgggcaaaagtctgccgcaaaggcttatggtatcttagagtttgttagagataagaagtcgtgtccactatggacatatcttgtaattctcgggtataaatagaccctgagccctatgtattttttgaacacacacgtttaatacaatttcggcgcatcgccaccctttttcgctttagttttatttcgacgagttcttgctttcgggttgagctgcatcggtttcgatcttcaacaagaggtaaaacttgttatggcgacttgtgttttcgggattagtgcttccatctttatgacactctaatcttgtttatgtaattcgtcaagttatcatatatcttgtataatcttcggtaatatcgtcatctaacctaccatcggctaacatctgttagtagaaggcagccgattaggttagatagcgacgttagtttggattatataagatatctaccactctatgaaacatctagcggcttgattgtctagatattgttcttcttttcatacttaatgctgcatctgttgagtttgatctattaagtcgtgcttagaatatcaatctctagcctgccttctggttgccgattagggtagcatcggggtttcagctgatcttacctgatttaactatagttatcctatagcatcggctatgctatgaacgtatttagttctattgttaatttgtatttcgatctaagtgatttatactatctcggcatggcgaccgatctatcccaatcacttgatttaagtatatatcgacataagggttatatattgttaatatctacagccgatcgagtagatttatttcttctttaattattcatgactgccgatcgatgtacgcatgacatcggcctaaaataaatgatatgtcatcggcacctagccgatcggctatcatttatggatttaatcgcggtttctttgtcttcgtttcttgttgattgtaggatcaatcaactggcacgctcatacatctgaaggcgagttttggaccttcactggagttaagcagatctcccaggcctcgtgttttctatcaacacgcttttggcacgcccggtgggaccgattagaagtcagaaaaccgttttcctca

SEQ ID NO: 50396 - DNA, 436 bp, Oryza sativa
ccctccacgacgccctcaaagtaatagcttgggttctccatcttcaattggctgtcggctggcacgatttctatcttgtcgccttgccattgaatcaagcattgatgcatggttgaaggaatacaacaattggcatgtatccaatcccttccaagcaacaaaatgtaagaacccttcccatcgatgacaaaaaatgtagtaggaatagtcttactgccgactgtcagctccacatctagaacacccttggtttctgatggattgccatgtttgttttgatgagatcttcggcgtttctgcctaacttcctgaacatagcatcagacatcaaatttactgcagctccaccatcgaccatcatcttagacatcggcttcccattaacatagccatttatatacaatggtttaagatgccgattctccgtaccctcagg

SEQ ID NO: 50397 - DNA, 214 bp, Oryza sativa
gtaggatcaagactgccgactggaccaaggaagtagtgattttcatgtgataagcttggaattgctaccagattggatgaatgctacaaataatcgagaatagaggagaagaaaatgctatgaggcaagagaaaaccaatctgtggtaaaagaaagagatctagccgatagagacttacctcagcatactcggctggtggtgcagcagacggga

SEQ ID NO: 50398 - DNA, 230 bp, Oryza sativa
ccgagcatgatttcggtagcaccacctatgtggtggacataggcgaaccttaaccctagcttcggcgagtcgctgcaatggatagctttgtgaccttctcccgctgtcgccgatgttggatcctcctagcggcgagtgggacagtggcggcattcgaggtgtacaatatctactaccacctggccatggtggcctggcgccaccgcctcgtgcagctggttggcataagc

SEQ ID NO: 50399 - DNA, 1501 bp, Oryza sativa
catcaacataaaaatcatcatgcaatatcccatcccacacaggttaagaatttagagtctagccaagtgtaatacatgtcccggtgctcaataaccgcgagcacgtctattcgaatagatttggtttactcacactgcagtggatgtacactttacccgcgctccgcgactgcccaacacatgagcctcgtcccaacacatgagacgcgtcacggtaaagcttttcgataacctcgcattggcagtacccgctccatgaacttaaatcctcatgcactctaggcgtccatgtttctagcagtgtgaggagttctggcgctcccgggaaagagaagtctcacacatattaaattatggttcaagttaagttctctctctcacacactcatggcagtcctaccaatggcgacaccgatgtagggcacgcctctcggccctacctcaacggctgtcccatcgtagcgcacctgcctcactcaggggtgaaccatctatgcagggatactgccttcgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattacattcccaaaggtaattgcccaagcatatagcatttgataaatatgagtatgcatgattctagaatggcatttctaagcaattgtcataattgactagggactcataaataatcatggttacaaggattttaagggtaaacaataatcaaggcatggcataatcacaagtaggatgttcatcattacatgcaattttatttgtaaacaaaacaatttcgcaattgggatcaacatgttcaaggaatggtgatgacttgcctgctcaggataatccctattctcgatataatcttgatcaaccttcacctcctggaagttgcagacgttgcctcacgactaaccgatacacaaagtctataatacgcgagaaaaaccaatattcaagcaacaatcaaatatgcacaaacaaaatatatttgctgaggtcgaaccaaaggttgctcatattattcgcgcttgctaatggactctaatcaagctaagagctaaggtttcttagtctttctgttgtcatggtggttcagtctagctaatggctaaggaaggattatggttacacatgcatctatctaaatagaacggttatacattagaggttctgttgccggatggattttggatcggtcaaataattactgtgaatcatttgtattattattttattaatggaggctttattttaattatgtacatatttcacttgtcaaaataaattataaaaggttaacaattaccca

SEQ ID NO: 50400 - DNA, 163 bp, Oryza sativa
ttccaccgccggcgagctcgccgtggacaagccatcttggagctcctcctctccatctaactagcaaaatggaatccccatacgccgtagatgctcaagccctcaccaatttggtcggaaaccctccccatcgccctagcacctagccacccgtgcccagcca

SEQ ID NO: 50401 - DNA, 211 bp, Oryza sativa
cgaaagctaacggccgtctgccacgtcattttcgccgccctctgggatggcgatttttaaaaatcgccctcccagagggcggtaggcgaccacttccgtcaattttcaaaatggaaaattatttttgtaaaacttttaataaaaaaattaaaaataaaaaaaattctggtggcggtgggtggccgagaggctgcacagctatagacggcca

SEQ ID NO: 50402 - DNA, 732 bp, Oryza sativa
cattaaacacttatttcccatggcttgctgagtactcctgtactcacccttgctctatataaataatcccccccagttgctgaagaagatgaagtggatcctgctgatgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccaacatgactgtacctctactctataataaagagacctctgttgctgtgataatctgtcttcctgtgataccagcactgtttcttgggactggtatcaactaacaggttaatttggagcgtcgcgggctagttccggtcggtactagttcggggcgtgacaagagatggtatcagagcacaggcttggccctagggcgaaacccgacgtttaggacgaccctaaggatactaagttcaaaactacttgcgaaaagctaaggcttcttttggtttccttattttcaatagtttgtttctaaaatggttactgatctttctccctctttcaaaattgtagatggcagtgaacgccagcttcagttcccacggttttggtgagggtcaccacgttgctcagcttcgtgacctcgcccgctttgttggcttctcgtgtccggagtacacggggtactccgtggaccgtgttccccctcgttg

SEQ ID NO: 50403 - DNA, 1501 bp, Oryza sativa
agcccggtccaccggctctctctctcctcccctcccgcgcgcgcgtgcttgggccgccttgggccggccggcccatttagctcggctgagccgccccttttctctcgggccgcgccctagccgcccgaggaaaagtctaatttccctccccctcttcttttctttttcaaaaaggatttaattaaattcttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagcccaagatctcgagcaaggcaagccacctttgaacatcttgagcctatatttgaagttaattatgttgcttgaaaaatattatgcattgataggatcgcacttaatctgtttgtcccgtctacaaggcagattggcggacctacctagtttgttgcatttgatccttcctttgttaattgttataccatgttcccttgtaaccatctagttgcgcctcgatattcgtgcactctgtgcgagtatcgacggtcgccttcaaacttaaaatttgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggattttcatccgaacataagacaagtacgaccacatgggtggaatgggacacccctggctgagtaactagcttatcaggggagccttgatgccgagaaacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgccgttgtgaaaaaggggatcgatgtttgagaaatctacagctgatgggatcagctaggcccgggtggccgtttgaaagttgttggcccggttggccgtttgaaagatgttggccgggtaccaatcttggccaattctaaagactgatacattgcacatactccgaccggacgagacgcactgtctcatccgtgtcgtttgagaagcactcacttagttgttttc

SEQ ID NO: 50404 - DNA, 544 bp, Oryza sativa
cctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggggttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggc

SEQ ID NO: 50405 - DNA, 550 bp, Oryza sativa
cccctaaaaattttgtgagtttggatgagtacaaattatgagcttacattttccgttctaatgcaactgttctaacattttccgttctaatgcaactattctaagagtgtttggatgagattcagtaacaaagttacatcggctaaaaacaaaaatcaaaattaacaagttgaaagtaggtggaactgggcagaggcagatctaaccctgtttcggttgaacccccaaactttttcgagggataacgcagaatagctgatgaggtgtgggtagggagggatgctcaccggcgagcgacgatgcggtggaagcaggaggacgccgggcgccacctctcctcgcaggatggggatcggcgcaagcggcaggcgaggagacgaaactcgaggccgaggccggatgggatggattaggatgctcaccggtgagcgaatgcggcgggagcaggagaacgccagcgccacctctgctagcaggatgccagcggcagggcaggcgaggagacgcgagtcgagggcggcgggcgaggagacgggacggataggggagg

SEQ ID NO: 50406 - DNA, 784 bp, Oryza sativa
ttgatttaaatgtcttttgctttcaggttggataggatccagaacttgttgaagaagcacatgcagttagattcgttggagtgaattgaactagtttgtaggaatgtcataggctgatagatagaaatgtcagggtttctggctgcttagaacctggttaggaactatcaaaaatgagccattttagaaaggtagcctttcatagaaaaaagtattggccatttttatgaataaatatatatttcttatctcttcaatctgacagaggatttgctagaatacatcggtttctgttgctttttcctatatacatctgtacaaattagagttgagtttaattgacaatggcattcagaatataggttgatcaacttatgcttctagcgaaaatcctttatgagttgtttgattcgaggttattgtagtcaaatccagacatgaagcatgttttggttttgaatttctttgacctttacacaacattatttttcaacattattaaaatactttggtagtgtacgtgattcttcattcagaaaatttatcattttaagtattgtaacaactattgtggtgaaatatgtgatattttggaggttctgggtctgcatgaatgggaggaatatagagtaagacactgctgataatttatgttgttctgcctatgcaaaactcagattcatgttgcttcgctcaggtcttgtaactatcagcatgtcacctgtagcttcttgaggctacaggtttaatctccatcattgggcatgtttaatctccatctttt

SEQ ID NO: 50407 - DNA, 224 bp, Oryza sativa
gaattatccgatccgaaaggtatccgtatccatttttgtccggagcggacggaaactatccgctctgttttcatccctactatacactggaagacaaattcgtgagacccactagtaaaaagtctctctctgtcagctcgaaagacaactgactgccatgggtctcatttatgtgataggggagacacaggtcactgcttgaggccacaggcagcggggcgtga

SEQ ID NO: 50408 - DNA, 1003 bp, Oryza sativa
gggatcccggggaataattcccccccactttattgcgcgcgggaacggcggaaggtgtcgggattctcggcggcggcggcgatagggcgcgggcgagacggcgggagcggcgggagaaagggtggggcccacccgtcagcgagggtggcgggcgggcccgcccgtcagcggcgcgcgcgcgggggaaggccggatgggccgcggggagaggagagggagggggagggaaatgggccgagccggcccgagagggagagggagggaaaggggactttttagagcttttctttttataaaaccttttcaactttgtttatttcttaataattattatttgtgctctgaaaattccactaaaatttatttacgcattttaggcttttaggaaatatacaaaaaccgtctaagccttgtttgacttttaactttgcacattttaattgttggaggctttcacacggattttaattattctaggcaccatttagaggatatattttagggtcgttttgggacgtgacaccttctttgatatttattgataatcttggctgaattaagctgtgagctccgatgactaccccgatcggctgcctttccggacgtatgcaccatgttaataggaaaaggatggccatccaccttgatcggcttcttagagtcatcaaactttattttccctccctcaatagccaacaggatctattgcctgaagactttgcaatcattagtagtatgagatccagaattatgccatttgcaatatttcatcttccccaactcctcagccgatggaattatatgaccagcgggaagttgaatttgtttttcccgaagtagcaattcaaaaattttgtcagctttagtgatatcaaaatcatatttctcctctttcctagaacttttcacccattgacaagtgacaacctccttgcttcttgcccactcggctgctgctacttcagaatcatcttcttcagactcatacatatagggatataca

SEQ ID NO: 50409 - DNA, 703 bp, Oryza sativa
gaaattggcaaacactaaaatgcgtacaagaaaaattcgaatgtggcccggggaatttttgttaaattctccttggtctaaaaggagccctcaaattttacttgaattttcagagcaccggaaataattattaagcaacaaaaacaattaacaaagtttattaaaaagaaaaacctaaaaataaccctccttcctcctttgggccaagtctggcccaaagtcctccctctctcccctcggcccgcggccgaagtctccctttcctccctctctttctctccctctccttctctccctcctcttgggcccccttcccctcggcccagcaccctcctccctctctctcccgggctgtctctcccccccctcccggcctgcctggcccaagccgcctccccctcctctcctcctgggccggccgcccggcccaacccgagcggcgccctcccgcccgtgccgcgcacgtgcgcgcgcgtgcgcgccgttgccgcgcgctgaccgcgcgcccgaccgggtggggcccacgcgtcaggcgcgtcgtctccctcctccagccgcccggccacctccctctctccctcccggaaacctagctcgctccctcctccaaatccgcttgattcaattggccaattccaaaattaattggggggttttaatccccattgaatcctcttcaattgcccccaaattcccccttgat

SEQ ID NO: 50410 - DNA, 1151 bp, Oryza sativa
cctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggggttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctgggggagggcgatttttgcctcccccctataaagcccagtcccccctctctgaaatttcattatattcactaaaaatccaaaaaaaacgaaagagagagagaggggagggcagcagaaggggagcggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 50411 - DNA, 1501 bp, Oryza sativa
ggaaataagtgtttaatgcaggctacaaagaaagggctgctgtttttgcaattgattttatttgaactcttttctgaaaacaactaagtgagtgcttctcaaacgacacggatgagacagtgcgtctcgtccggtcggagtatgtgcaatgtatcagtctttagaattggccaagattggtacccggccaacatctttcaaacggccaaccgggccaacaactttcaaacggccacccgggcctagctgatcccatcagctgtagatttctcaaacatcgatcccctttttcacaacggcaatttcacaaggcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtttctcggcatcaaggctcccctgataagctagttactcagccaggggtgtcccattccacccatgtggtcgtacttgtcttatgttcggatgaaaatccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcaaattttaagtttgaaggcgaccgtcgatactcgcacagagtgcacgaatatcgaggcgcaactagatggttacaagggaacatggtataacaattaacaaaggaaggatcaaatgcaacaaactaggtaggtccgccaatctgccttgtagacgggacaaacagattaagtgcgatcctatcaatgcataatatttttcaagcaacataattaacttcaaatataggctcaagatgttcaaaggtggcttgccttgctcgagatcttgggcttgatcctcgaaatcctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaagaatttaattaaatcctttttgaaaaagaaaagaagagggggagggaaattagacttttcctcgggcggctagggcgcggcccgagagaaaaggggcggctcagccgagctaaa

SEQ ID NO: 50412 - DNA, 1501 bp, Oryza sativa
agtggctactttcccgatcgctcccctctctcctgtggcagcggcagtcacgattcgcgagattcctcatcccgcaccgtgcgctgatgatccctcttcgcctcctttcaccaatccgcggcaatggcacaatcgttgtcatcttcacgtgctcttcctccgttgcaatttgagacagagaggaattgcaatccctgacctggagcttttttggccatagatgtgaggatgaaagaaagagatgaagggggatgaacagagcaattgcaatcttctaccctcttgcttttcccatgcctcttgctgtttgtggctgcaatggtgagtactgaatctggtgttgacagtccttaaatcataatatctaaccgccaatatctgcatataatgaaataaaatatggtatctgtcgacgggggatatctgtagaccggataaatagggtattggagtacgttggtacaaggttctacacgatacgacatcataacgtataaaagataaggattatactggtttagccccctcgtgaagtaatagccctaatccagtttatatgggattgatatggaaaaccatagaatacaaagagaacagatggatccgacaataccggcgagatccttgtcgagatgattcaacgagatctcccgacggctttggctggcgtcctctggcttcatagactatggtgggtgtgctggcgctatgattcgatgatcatgaactcctcaaggggtatgccttttatactgtgaattgccttagtcttcaagtagaacccggagacaacaaaccctccacgatatagaattatccctatcttttccgagtaggattctgatagttactagcctgtaagggtattttccgtaatattttatatatttccttatcgcatacggaaacaaatcataagatatggggtataccaatccagtatacttggttaatcataggataggatgtatgtctcatccgtaaccctgacagtatccaacttagtggtagagattattactaatcaatttcactagtgttaatgaaatatgtgtatgtgggtattttaaggagaaaacacacccatcatgtgaggaaacacacctccgaccaattaggcgcgagtacacggatggaaggacccataagtcaggtgaaatcgtcatgaaatgagttataactgtcttaaccgtaatcaggacccactatatcaggagttcaggacccactatattatagaacttgctccaatgcaaagacctcgggctccacaggcacggaccatatgaaggggagaaaaacatgacaacccaactaacgatacggatggacgatcctcggttcctcaccacacatcctacctaacaaactcgagggaaagaaaaagtagtacagtactagtgcatatttattttagaacagactgaatcatcaacggaccagggaagcatggccttgaagcttctctggctgcatgccgacggacactgccagtgccacc

SEQ ID NO: 50413 - DNA, 1501 bp, Oryza sativa; identical to SEQ ID NO: 50412

SEQ ID NO: 50414 - DNA, 319 bp, Oryza sativa
tgcacaaacacacggctttatataaaagtccattaaacttcttgcaaacacttctaatccatcacgtggcatcctatatatactcctaagccatcatatgacgctctaataaattaaaaaatcatataattttgataaaaggaaacacatctcatcattgattttcacttgaattgttgatatgttattttaggctattggatttatctcatcaaaagagaacaacaggacctcccccgttaggttagattgatctaattacccagagcctcaaaattaaagaaaaaaaattctatgatgcacctcctgcggttgcagg

SEQ ID NO: 50415 - DNA, 1501 bp, Oryza sativa
ccaacggaccaacatcatgttgccggtcaggatggccaagatcattgcacaaaagcagctacaatgccttaccggttgatctgctcaggtgacaagttaatagtacagaatcgaggcacacattttacccagtaggatctacggctctcaaggatgaaagaactggttgcaacgacacagcatcaaagttctctcccacaggtcgaaaaggaagggaaaaatcctcacacaagaaaaaggggaaaacgccgtcatatacacgtattttctctaccgcgctatttctcttgctctaatacatgcacagaacaagactgcaagggtgatggacagaaaactggaattaactcggagcttgctgcttgccctgactcatctgaatattccttgtgcgttcatctcatctcgatcgggcgattccctttactttctcaaggggaccccggatgctttacttgcgcctatggcttagctcaggacgggcacattcgccgcgacggcgacactgccggcgtcgagcctgtggcgctgctcgtttcttgcagcgcgctccctcgcattcgtggcgctaaccctcactgctgcttcgtccatctccatctggtgatcccggcactcctcgctgcagaatggcgtgttccctctgtttgttcacaacaaaaagaaagctcagtcagaaactattcagaatcagagctcagagaagctgatcgcttggtgatcactttgtattctcctgcctaattatccaagtgattcaaccgataggagcaaaattgagcgtgaaacagacctgtacatgaagatgtcgcagttcctggtgagcggcttccggcagagggagcaggcgtccatggcgtggccggacaggcaggcctcgccgccgtcgagtggctcgatgtcaaagaacgaagaagaggacgacgacgctgacgccatctcggttacaacttacaactcgagctgaaagatccgaggagagaagaccgatgagctgagcaagtcttggggatcactgccaatacgggagagacttgaggctctcctcttttataaaagagaaagggggttagtggtggttgctgagtttggtgcagggggatgcgcgagaaaccacggctagatttccaggaatccgtggcaaacaaagcacggctcgcatcgccagcacacacgcgggacacggctaaactggccgaaccggcgcggctagggccaacacaagaagtgttgccccggtttttgtttgtttggttgctcgcgattagtctcccctggttgccttggagaccttggtggcgccggcgttgtgaactgcaatgctgcagaatccaccggaagatctgtaacaaacggggacccggtttctttatgcgcaaattcgattctatggggacctcttgttgtggccttttgctagctgtttggttttgtttattgcgccggtctcgccacgtgttgaggagtgcacatgactaggacacattaaattacaccttca

SEQ ID NO: 50416 - DNA, 1501 bp, Oryza sativa
gtttaaattttcattgctcgattcgtgaatgttcaattcttacaattaaattatgtacgggtattgtctcccatccttgtaaattttatggaatgtgttgcatttatatctaaaattgtttttctattcaaacctcttttgttttttgattccttgcaatgaaaagagaggtaagcttagtattgtgttttgtgtgattgaagtatatagggacgatggtgtttccatcaagtttatattataaagctaggttctaaaatagccttatctaacgtggatttgagaaaatgttttgaaagtgtattttatggataaatttgaataaagctatattcatctcctcatagcgcggtacctattttcaccaataaaagagatatgagcataagtaaggaaagaaagagagataaacatgagaagcataaataaaaaataacataatttttagaaggtagagaaaaaaaagttatatattgttctttctgaaaaacttaataataagcttgttagatctaaagttattactaaaaagataatttatttgataatattcttattgaattttaaattatttctaaaaaaaataattcatttgataataggttttttgattttaagttataccaccaaaaataatttatttaataaagatttttttgtatcgaatttttgtatggaattatgtatggagaatcatgaataaagttgagccactgttgaaagaaagatatgaaaatatgttttctctaattttaatttaagactatcattttaaataagaaaaaaaagtgggtgggtttatctaatttaagatcatttaaaaaatgatattgaacattttcttaatcgactttgttgttcaattcctcttgttaaatatggacagcctgattgtaatgaataaatgggtcattttcggtttctctaccctcttcctggtattatccaggttagtgctagggttaaaaatagtatctgaaatgtaacaattaggaactaaacttagtccctgtcacattcgatgttgggacactaatttggagtattaaatatagaatacttacaaaactaattggataaataagagctaatctgcgagacaaatttttaagcctaattaatccataattagcacatgtttactgtagcatcacataggataatcatggattagttaggctcaatagattcgtctcgcgaattagtccaaggttatggaatgggttttgtcattagtctacgtttaatacttctaattatatggattagttagggataatcatggattagttatgctcagtagattcgtctcgcgaattagttagtccagggttatggaatgggttttgtcattagtctatgtttaatacttctaattagtgtgcaaacatccaatgtaatatgcactaaaactttgtagcctcatccaaacccttaagacaaatatacctaaatctaaatgcaaagaacgtggaggattggttgtctcatataaggaatg

SEQ ID NO: 50417 - DNA, 624 bp, Oryza sativa
acctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggcgttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcc

SEQ ID NO: 50418 - DNA, 1501 bp, Oryza sativa
tcgtgtgaaccgccgcccgtgcgcccggtccaccaaaccctagcccgctgacgcaataaaccctcttttccttttcaaaaataattcattattgcgtcataattcaattttaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctactgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgcttagaaacattagcacacattcgggataactaatgactcactaatatttcatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcagttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatctaggaaggtgcgctgcagtggattgtgttatgcgaggggtattgtcacaactcctttccgagatactgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagtaaatgatgcttaaattggtaataatttgattagctcctggtttggaatggaatattcctggtgtggagatagaactgtgcagccggggtggttgttcagaatggttgggcctatacaacagggtatgttgtatagcgttggattaatattgtttaattacttaactgttttatcgaattctcaaatgtttgctaaatgctgcttttgcaaatgcaaccctactatgccatcctttgttatcctgtgcacttgcatatttgctacgtggctcgctgagtatgtcatatactcaccttgcaatcattcatca

SEQ ID NO: 50419 - DNA, 1501 bp, Oryza sativa
tgacaagttggtatcagagcccctttgaccctaggttatgccaaatggttatccatagaagccctctaaaaatattggaaaagtagaactgttctcctccctttctcttttaattaaaccaaactaatggcacatgcacttcataatctcttttaatggttctcattaaaaatttattccagtgttattagtactgtacatctattactgtactaatggctcatttaccagcaaaagttttacaatactgttttatttaatcttgctgcaataaaataaatttagcatgttgattttataattttctttcatttcttttgaaaccagttattcaaaattacaaaatttgtgacctcgtttccaactgttttaacttatctcgcaaagcttggtttactttatttacttacctttttactctgattttctaactttattcaaattaatcaaaaaacttgtgctattaattggataaaggtcttaactccctcctttcacttgtctttagatgccgcgttacaagcctgagtacctgtttggtgttgagggttttgtccaggagttgcgttcgatgtcctttgtcattggatttgggactgcccctttttatgcccagattcctcatgatcgtcatgaagagaagtgccgagtcaaagtcaccttgaacagtaatagtgaagatatccccttagtgatgtttgaagctggaggaagaaactacatccatgcatgtcaggaggtggcaaggatcgccataggagagctccgtgatcgctacagtgatcaattggccgacactgagtatcgctaccatcctcgtcaaccccagggaagtgaccgtggcagctatcttgagactgaaggaattgagaatgatgctaccacgaagcatttggttgagatgttgtgggctatggatgaaagtcgtgcggagactgtgttagccgctcaagatcgtgaagaccggaatcgtggtaagatttgtaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcataagtagtgatgaagaagaagaatccaagcgcaacaattccaagattgagtgggtagcaactcaagatgataaagacgagccttcaatcgacctccgatgcttggaagaactagagtgacttgttaagtcgttgtcttagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtctttagtttgtaataatgaaactcagttaagatcaataaaagt

SEQ ID NO: 50420 - DNA, 1501 bp, Oryza sativa
ctgcccatagtacaggaagggcacaaatgcagcagcaaacacagcagccacaccagcccccatcagcaccaaccttcccaatcccctcaccacaccccggccacagcaataatgccggaaaagatacacgaagtagaccggcgccgccactaggaacaggtgcttcgagcacagcagagcagcaaaaacgactccgccggcgagatccctcccctgctcaaggaagtgcagcgacagcagcagcagccccatcaggaacccgttgtactggaagtgtacgtggtccacggcgagcagcgccggcgaccagaggacgagcgcgagggagaggaacggccgccgccgccgccgcgtgagcgcgtccgtggccagcaggaggacggaggagaggaggaggaggaggtcggagaaggcgacggtgaggcggaggtagaggaggtaggcgaaggagggcggcgcgtcggggacggggagggagacgagggaggcgtcgacgaggggcgccgggagggcgaggaggcgggagaagtaggcgaagaagggcgggtagtcgagcgtccactgcgacgaggcgtcggtgtaccaccgccgcgcggggagggcgtgggtgagggcgagccagtagcggtgcacgtcgaagtcggtggagcggtaggtggggacgagcaggagcttgacgcatgtggcggcggcgaaggtccaggccgccgcccgcgccggggaggtggcggcggcggccgccattggggacgagtagatctggtgatctccagagaggggttgcgtttcgggtggttgcggtgatgagacttcagaaaattcgtaactttagggctgtttggtttccggagacttattttaaatccctgtcatatcggatatttgaacattaatttagagtattaaatatacactaattacaaaattcatttcatgagcttggactaactcgcgagacgaatcttttaagtctaattacgccatgattttgataatatgatgctacagtaaacttttgataattatagattaattaggcttaaaaaattcgtctcgtggatcatctcttatttatgaaattagtttttttattagtccatgtttaatactctaaattagcgtccaaacatccgatgtgacatggtctaaaaagttttagccccatctaaacaccccctttgtggtagtacacaggatcgttactggttactcattttcatttatcgccaaattgtgagtaaataagtactccctccgtttcaaaatgtttgacaccgttaattttttaagtacgtgtttaaccattcatcttatttaaaaaatttaagtaattatttattcttttcatatcatttgattcattgttaaatatactttcatgtacacatatagttttatatatttcacaaattttttttaataagatgaacggtcaaacatgtgctaaaaagtcaacggtgtcaaacattttgaaacagagggagtactccggataccagat

SEQ ID NO: 50421 - DNA, 748 bp, Oryza sativa
ttcctgcagccccaaaaatttggcgcccaataagcatggcacaggcctcgaccaaagggaaacaaccggttaaagagctgttgcatctgcaagattatttgttgcaatgagtaagacaatattgtgccaattatgcaacctacgtgcacaaactgatagggaactacttaattataaacttcaccgatcttctaattctgaacacttgatgaactacaggaaaaatcctgaaatcctctcaagaaataatttcctacttttaagtgaactgatgattacagatggattacagtatctaaacaaaaaaaaaacataccaattcgtccattccaaaggtaaattaaccgagcaaaactcacctgcccatagtacaggaagggcacaaatgcagcagcaaacacagcagccacaccagcccccatcagcaccaaccttcccaatcccctcaccacaccccggccacagcaataatgccggaaaagatacacgaagtagaccggcgccgccactaggaacaggtgcttcgagcacagcagagcagcaaaaacgactccgccggcgagatccctcccctgctcaaggaagtgcagcgacagcagcagcagccccatcaggaacccgttgtactggaagtgtacgtggtccacggcgagcagcgccggcgaccagaggacgagcgcgagggagaggaacggccgccgccgccgccgcgtgagcgcgtccgtggccagcaggaggacggaggaga

SEQ ID NO: 50422 - DNA, 1501 bp, Oryza sativa
atcactgggcaatcgccctggcgatcgatcgcccattagcctcccccggttcaagtggcctccatgagtttttttttatgaaatctgcttcacaaggaaattagtaaaatactatactcctgcgttaaatatgattcaaatctataatttcatgtttgctgtaaatgagtactaagtctgattttccaataatgctatatgggttttctccccctgaacttataaatgtcactcttgcacgatgcgtggggagcaggcaggagagcacgtaggcacgtactagagcgaagggtcgcacgaggggatgttctgtttcacgtgcggacgtttgcacgcggcacaaacacatttgtgattattcacaatgtacacccatttaaaggaggtggcaatttattgaggaaagaattggaatatagccggaagtacattaaagagtcgattttcatgatcaatcgcattgaatttagaatttattacattgatcagtttccttttgaaggtcctttctcttctataaatctcagtgtacctggaggagccaaaccacaaaaaagcatcattagcttctccccggcctgagaattcccgatgcatcccatcatcgctacactcctcctcgccgccgcaatagcccccggtctcacggtgggttccccatctctcatcaacgagacatgcaccgcaacttccaactatggctactgcttgggcgtgctctcggctgatccggcaggcgcctccgccacggacaagcgtggcctcgccatcgccgcggccaacatcacgatgcgcaacgtgacgtccacggtacgcgtcctcaccgagctggtagaggagctcaagctctgcatcaagtactaccaggacatggacgatctcgtggccagcgccatcgacgacctgcgtgtcgggcgccccgccgttacctcgttctacaaactgcaccgggcctcggacgagcccggcaactgtgatataatgttgtttgagggaagcgcccacaagaacccggtgagctcggagaacatgtacaacgaggccatttcaaagttaaccagcgacatcgtgtaccagttggtacattaatacaattagcctaagttgcatggataggtccacctccccctcctcctccttaatcttactctacccatgtattgtattgggaggctgtgggtagcatcatgccatttccaggcatcagctaatacagtttgctggcaaggctgcgtctgattgtttctatgaattctgttgctattgttgtgcttaacaaaatgttaaatgcccatagtccatatttgggggtgggtgggttctgatgcgcgactgttcggagccccaaaaagatactgctgagaatttgagagacctcggccactccagcttttgcgaatctccgctacagtcgcctcgttcattctccgacccctcttcctcctctccggtggatcaccaccaacgatggatgaaaggggggtcggatgtctcttctcat

SEQ ID NO: 50423 - DNA, 1501 bp, Oryza sativa
tatattagctgtatgtttctaaacatgtatactacggttttatttgttttaacagcacgatgttctacggtgaatacatgtgtacgggtgtgggcgccaacatgaccggtagagtaccatatgccaaaccgctgacggagcagcaggcgcagatatacctggacgcttcctacgtggacgcggatggctggttaaaaccgttcaacgattctcttatagttaattgagtacaataccatgtaaataatggcgggggtgcaattctttgtacttaacacggttgtttagtactactaagggaccacctatatattcgtcgataaattttctccaaaaaatttgacagatgtaattatagtacaatcgtaatgtaattacactgtaacttatatgtaattacactgtaacttgcatgtaactacagtgtaacttgtaaataagtttcatttaattttgaatctttaaatctattacaagatttgttttggtaaggaagaaaaataaaatcacagcacacatatatgtgtaaggatttgtttccacaatctctattttaccgaaataacatattacagagacatttttgaaagttacatacaagttacactatagttacagtgtaattacatgcaagttacagtgtaattatattacgattgtactgtaattacatctgtcaaatttttaggagaaaatttgtcgacaaatatatagcaaaatcgtactactaatatgtatatatctggtatccggagtactccctctgtttcaaaatgtttgacaccgttgactttttagcacatgtttgaccgttcatcttattaaaaaaaatttgtgaaatatataaaactatatgtgtacatgaaagtatatttaacaatgaatcaaatgatatgaaaagaataaataattacttaaattttttaaataagatgaatggttaaacacgtacttaaaaaattaacggtgtcaaacattttgaaacggagggagtacttatttactcacaatttggcgataaatgaaaatgagtaaccagtaacgatcctgtgtactaccacaaagggggtgtttagatggggctaaaactttttagaccatgtcacatcggatgtttggacgctaatttagagtattaaacatggactaataaaaaaactaatttcataaataagagatgatccacgagacgaattttttaagcctaattaatctataattatcaaaagtttactgtagcatcatattatcaaaatcatggcgtaattagacttaaaagattcgtctcgcgagttagtccaagctcatgaaatgaattttgtaattagtgtatatttaatactctaaattaatgttcaaatatccgatatgacagggatttaaaataagtctccggaaaccaaacagccctaaagttacgaattttctgaagtctcatcaccgcaaccacccgaaacgcaacccctctctggagatcaccagatctactcgtccccaatgg

SEQ ID NO: 50424 - DNA, 1501 bp, Oryza sativa
ttttttttaatatgcaaaagtattgctatctttatattaagagtaagtggcaaaatattgtagtagaaacttaaatgttactctcttcgtttcataatgtaagtcattctaacatttctcacatttatattgatattaatgaatctagacataaatatatatatatatatatagattcattaacatcaatataaatatagaaaaatactagaatgacttacattgtaaaacggaggaagtatttattactatctcctaacaaaacaaatttttctttcaaatgccgttccaccattctcatttcgacccaagcagagatcacagtttaaatatgccaaaaaaaaaaaacagcagtagttttggagatttaacgcttctctcatctcagcaaggatatatactaaattaaaattcacgacatgagaggaatatttttttttgtttcctttcaatttgcgactcaatttatcatcatcatcatcatcatcgtggaacatttacagacacgaatcacttaatcagcatcttgatgcttgcaaagccagcttcagattcccaagtaatcaaaagttcaaaactacctacgaaatcaagcagcaaaagaagcaggatagtatcaatctaaatgacaatcttagctagggccccagcagcagctgaggtacatcaccctcctcatcccctcctcctccggcctctccgccgccatcgccgccgccggcgaggaggcgccggcgccgccatgcacctgcagcatcagggtgtccatggcggcgccgtgcagcgaccggagcgcgtagttccagcggcagaggcccgactggtccttgagcccctccaccgcgcccacgctcatcgccgccgtccaccacgccttcgccgccaccgccgccgccgcgctcgccattgctaatttgcaatgcctctctgaatcaacctctcgaacttgatctatagctgttgatgcttcgacgattcgatgaagcagtagtagctgaggagatgatcgagatggaattggattgagaagtgcaagaagagtggagtttatatagagttttcgtgggcgaaacaggaggcggggaggcgatggtttttgccgtttttctgaagaaactggaggctggagatatctgcttatgtcactcatctcatctgctaaatttggcgctatgcttctgtttttttgtttgtttttcaggtgcacaaatcataaacagggcataccaattttaaatttcagtatttgattgattgtataattattttctgagttttttttctccccttacgtttttttctatagagaacggcatttttcgccccttttgtcactgaaacacttcaccggattatttactccacgtctttaaaaatatattttctcaaaaaaaaagtttcttataccgtattgcttaaatctattgttataagttattttgctaatgctgaaaatgtaagccttacactatattttgttttcttcgagttagacaacatc

SEQ ID NO: 50425 - DNA, 1501 bp, Oryza sativa
acatccttgggttctcctgaggaataaatcaaattatagaatgggatatgtattgcattatggaaacgcgagcaaaaatgaaaataaaaaattaagcaatgacatacaactaagttgttgtctatgttgggacagacggaatatcaccttccaaatgtctcttgtgaaaaggatgtagcaatttggcagcgatctctacaaccgcattttggatgctcaaaccattcaggtagacataatggattggatctccagtgtaagtttgactacacttggcgctcatactccatcaatgcttgaataattgtgtggtcatctcaggttgtgttatccttgcaccaatggaagttactctcgccgtatcgatccactttacgaagccacatttcgaaagcccactgtgggcccagtcgaattcccgtggttaaattggttctgtcaacctcccgccgttcgagagcacccgcctgttgctacacggccgttcgatagggtcctgtcgaactaccgcacttcgataggcccctattttgaaaaagagtaaattgcacccacggtgtatcaacttggcaggtgggtgcaatttggtgcaagaactagagaaacgagcgttctagtgcatcaacttcgcaggtatgtgcagtttagctaaaaaaactttataagtgattgcataaatgcaacaacttgcaagatatgtacgattttgatacaataagttaagaagttatgcgacaacttaattatttggagcacttttttatgcatattcaatttttaagttcttattttgataatatactagcgtggatttgtatataagcatatttatatttttattctaataactaataactaaaagtcaattaaactagatgtagaaattattatatttcggttgagatttaggaatgtgaagaaaacaaaaattcttaaaggtaattggttataaattggatatgcagtataattcttaaagataaaattcaatattacaaggtaatatccgtatgattgctatgtaatggcatattgatatcgtgagaaaaactcacctagcatatgcttagcttagttgatgcaccaaaatactaaattgtcaagttcttttactaaaatgcacctacttgtgaagtgttgcattcgtacgtttaattctcaagttcttgcactatatcgcactcacctaccaagttgttgtactgtgggtgcaatttactctttgaaaaatctccaacggccaccatttttgcgattttccattaagatagtaatatttcaaaaaaattcagccaaacaatgagggtgacaatttccagaaaatctgggccattcatttgggccacgtcagctagcggcgtggggagaaaaccgcgggcaggtttgagctttggcccgccgtttcgccggcgtaaccagcggcgccgcccaccgcaccgcgccgcctacaagtacggcaaccgcggccccttcctctcccttcacttcaccgagaaatgcg

SEQ ID NO: 50426 - DNA, 1501 bp, Oryza sativa
gaataagacgagcggtcaaacagtgcaaacaaaaactcaaaatcctatattatggtacggagggagttctatagttacctgcctagaacacactgtctagaccatcaatgtaccagatacatccccaatcttagagacaaaagtagctagatttgtacaattaattaagtgaactactactttgcactactccagcagaataattagcaaaattctatcttccaatcaacttcgcttcagatgcgaaaaggcgacagcctttaagcctcattcaactattcaagccacttgacattctcataacagcacatacccatctgatgtgacattatgcaataaataaatttataattttatcatcaatactgtttcagatagcaatatctgtaccaaattgctatatgattctaagtccagcccagacttgggttgacccaacatgtgccgtccatccacggatttagccactaatccgcgcaatccaacggcccatatttcgtctcatatctggccagcaattgcagcaaataatttcatcctccctctgttttatattatataagtagcttgatttttctactaagtatatttttaagtttaattagatttataaaaagtatagcgatattttcgacagaaaacaaatctattattcaaatatattaattgttggttttaatggtattaattcttgaaatttgacttaaaaaaatcaaaacgaactattctaattaaatgggtttagttaattagtacttccttcatctcattttgattatcctacaagaattttgagttattctcaaattgatcatatctaagcagtgtgtctattcgcttactaggagcaattgctatggttgcatgtctattcggttatttgtacttgatcaaacttcttttaagtttgactttaaaagaatcaaaacgattaacactaattacaagggtttaattgagtactattagattaacactaattacatgggttgcctctaattattaatcactcgcgcctcatcctgcggagaagagcgaacacttctccttctctctcttcttcttccctcatccccgcgcggcctcccgcctccgcctctgctcgcgagccacccatttcccggcgacagcggcctccctccgccgccgccggcgatctgacactggcgcccgcgccaccggccgagaaaggtagttccttttccagtcctgggtaacgatccaaaggcggtttctttttttatcttctcttgtggatgataagttcgaatttttccctttcatccatggcctcctgcgatttatgatctgttgcgagacaaatcgacacgggtgtttgtgggtttggtgtgttggattcgactgtttcttggcctgaatcatctcaggagaaggaattgaatttgtggtggtggcatttgttgtggtgttctttttaggggaattgaagtgtcataatcgatttgcaggagcaggatggaaggggagatggatactgtgg

SEQ ID NO: 50427 - DNA, 1501 bp, Oryza sativa
catcttaagctgataagctctcacccaaactgtgagagcttagttgaccctaatccattttactagcaaacctacattcattggcttgaagcgcaaccacgtgatcatgcgatgagtcctagcgcgacttcgtctgttcacgagaaggattaattcctaattcaaacacaatcgtgcggtaaacgtagataagtactcaaaaaccatgtcccacaaagaggaggtcgagtcgacgttcacagaaaggagtactccaatcgcctagcacagtgcgaagtgatctcggaaatcgacctgtgactgttcacccgtggtttccacgactcgcacgagctaaaagctcacagtaatcaccgttgcagataagcttcagattaagagcaggtataatagcaggctataagctagctacaaacatattttaaaaagataaataaggagagagaagagtagcgggctacagatttgtagccagctgtagcacggactctaagacgcagtgtgtatatgacaggtgggaccagatattaatagtgtagtatataactattgtatgaataagctattagattggctatagatgaattgaagttagtagtcggctgtattattgaacttgctgtcgcgcgatagtgcgatctgactcggctcgcggatcccatccgcctcccgacacaccactagctccaccacccaccgttccgtatcacgcgaacgcgaagtaatcagcgagaggctgccgctgaagcgagcggtggtcggtggacatcagcggccgcgcttttttggtcgcgcgtggccgtggacggatgaggtttattatgccatcgcgtcgcggcgtatacgtgtagcttgtcgcggcgagcgtttggccgacgcgcaacgcaacaatcctgtgctgcttgttccggttccttcccaacccttttgcaagaacacatcccggtcgtggtcacggtctcacggaccttttcctgggaccttttttgcacttttcttcggttgccatcttcgtaaataacctcaacgacaggggtatcactcaaaactatagtacgggtcccccgctttctcttcgtcttccccgcgctgaccgagcttcgcgatctaaaagtcaaaaaccaatttagccgataattcggctagtcattccataataagcccaattcttgcactaaattggggcaatctgctctttgttttcggctggtctcgggggatgtgtggtggtgattaaccccggaacccccccccaattcccagatttaatttcacttgcaatctgtgattcttctggtgaggtgcaagtgcaacgacaggtataattgaactacaaatcgttctatttttcgatttctagaaattaaatttgggatagtcctccagaaacctaatcctttttgtcacttagggtgttcaagtttgttcttgggcgttcttggtcctttggggttccaaaggcgacttctttcgagaggagggaaagaagggaaatgaggga

SEQ ID NO: 50428 - DNA, 1501 bp, Oryza sativa
aatataaaagataattgagtaacatagattacattatgttaatttgctctatttcacactaaatgttttaggttttaatacatttatgtatgaatatatatgtgtccaaatttatataaatattagtgaatttggagaaatcaagaggtcaaaacattatataaatgtggaactgagggagtacaatactacctactcgataggagagctcatgaacataatacaagaattaggttaactgtaattttcagacccaaggttaaatgccctacgctgcaaccgttggcgatccccttgaaattctatctgattagaacagctgaaatactgtaacttataacaaatactcctactatccataatcaacttttgtttggagtttatgagttgtttagttgtcagccacagttaaatacaactaaggttacgcaagttgtagtatataaaagtatgatgaataaattgctagcagcaaaagttagtaaaaaattaaatcaataatatatgggacatgttattgaaaaagtatgataaaccacacaaccaaatataaaaagagttcctttgaaacacatgattgataaaacggagcaataaaaaaaggattatgcaagaatcaacgtgcaaaacatatgattatgaaacacaaaaaataaagaaatgatcgcttaattggatcgaaaaaaagatgtaggaattgtataggacagatgaactcataaaactactttttatgagattggacctcgtattaaaaatcctaaaaaatttatatgaatcgagacattcctcagaaatttcatagaattcaattagttttcaattcttcgtttcaaattatccaataggaaaaacatcctatacaaaattttaatatttttgttcaaatccacataagagaagcatgaccataaaccaaacaatcacttataaacctttaatagatcctctactgcttatgggaaagcaagttagattttgcagtgaaactgactgtgtttagttcagatcaacattgaaagtttgtttgaaattagaatgatatgacgaaaaaaattggaagtttacgtgtatagaaaagttttgatatgatagaaaagttagaagtttaaagaaatatttggaatctaaacacggcgtgaacaaggggccaaaaattgaccgaggaacaacagcaagcaaagcatataggaaagggaagggaaagacagagagagaaaaataaaagaaagcagggggaagggagggaatgtccacctggagcctccaccgccagtagtgcccgtccccagcgcatccgcagacgatcctcccttccaggctcaaaaccacaccacccccaccctagagagagaaacaaacagaccaacaatcaaacatactagtacaagtcgaggtagagagagaaagctcgagacaagctaaactagctagagagagatcatgtcggtggcggcggaggggaaggagaagggggttggtggtgggggtggtggtgcgg

SEQ ID NO: 50429 - DNA, 1501 bp, Oryza sativa
tccatgacgacattacagtcgtcgttgtttacatcgaccatgagttacttcaggagaaaaatgtttctgttcctgaactttcagtccgtgggtttgtcgactcagtaggtccctcgagaatttcaggattcgatgctatttcatgatatggtgacctagcagctcaggttttgtgccctgcattgcagtagcatcagagttttacgctagagcaagcattgctttcaacttggtttttgttttgtacatttacctatttcaggtactaaaaagttggtttcatgcttgcaatatgctcggaataatcacaacatgctgtttttcttctacgtactacatcacaacagatggatactgatgtgaaaattcccaatttttggtaatctgagcaaaacaaaaaatatatttttttatgtaaacactgaggtattggatttttattcgtaagcaggacaacgtaattccgcagcgtcccattaaaacaattggacgccaccgatctagagcgtccggccttctcacggacgcgatgttctcattgcgtccatagcccacgggccaaagggctctgaaaacagtatccctgttcttctgcatcctatcaccgtaaaatccccaatctgaaaacccacgagtaaaccagcggccacaaaccttaacggcgtggcgacggcggtacccatcccgttatttctcttgatcgagccttaaggtatcaagcttgccgtcgtcgtcagttctaagtacgcacccacgcgactagctctcagccatcaggttagtcgtcttacacatgatgagctcttttggttttttcgttggagactaaatcgttgtgcggcattctctttctttagtgatacattatagtgctgctgcattaagcattagttgttaatttttgtgcttatctttataagacaatgacagattagttattagcaaatagcaacatgcatcctagcttcctaacaagctttgtaagctagtttatctgcttatcccagttctgtcaacataacaatgcgactataaggaaacaaaagtgtgaaataatctagaaattagttttacttttgatcaatcatcttacgatgcttgtttataagttcctgaaaaagaaatcagttgtacgttgtttgacatgcttccttaattttttgtatgctacaaactagtaagatgaggactaatcaagatgggttaggtcggttagttacaataagtgatgaggagataggcttactggatggagatcaaactttagttcagcaaactgaactaaatgtttcagaacgtatcagtgccttactatggatgcctcattgccagcacaaaatctcaaaagtttgggaaaatgtaagctattgctagcttctgtcatatacctttccaaaaaaaatgattggactaatttgtatcctacgtatgcaggctaatgatggtgttagtgtcaggtatcaccacgtgggcattctataccattatttatgtgaaccac

SEQ ID NO: 50430 - DNA, 1501 bp, Oryza sativa
aatactttttttttttggaaaaaagtttagaccttttatctcatgcactaaatgtattttacagtttgtatacgatttttctgaatatgccccaagacatgagatagttctctacaaaatatcggaaagatggcatcaaaaggtcctcgatcaaagttagatcatgagacaagagccagacgccagaaggttagcttttagcattggtatttatgtttagtagctgcaaatcattgttatactatttctcttatcttcacacacatttttctttctattccacgcttgcataatactgtttttgattttgtcaggcctagttagagaaggaaaattaagtcatgttcttttgtatatatgtaaatccattttcactttctttgtattgcactgactgaaaagttttgtcctatcttgtgcaggctcttgaagccccaaggggggagcctcgaaggacgaaaactcactgggaccatcttcttggagaaatggcttggctggcaaaggttacttgctattagtacatttgacagatcatgatccttctttcactgagtgaatttgcatggttttataatgaagatatactaatcctattcccttggcttggttaatattaaatgttgtgcaggagtttgatgctgagagaaaatggaagctgtccatggctaaaaggattgctcaaagagctaataagggtgtagttgaccaagcaacaaaggacgagagaaaacagaaggtttgcttgtcttttttttattaattaggcagattaacatgactccatgagagttgtcttattacaattctgtcccatattgaaggctatcagcagctttatcatttatatacatagaataataaactgtagtaatgggaaaggttggaggctgggaaggcgacaaggaagctggactgtaatttattgctggcaatgacccacatggccacatctgcatgcttgccgtttgctgaactgagtgatgtgcatcttagtttatcctcactgcagtacacagggaccttaactgagtaccctttatttattaccatgatctgactttaacctgccgagaataaagaatgaagaaccatagctaactgattgcttaactgcttgctaaacctaaatttggtggagactttgatcaataagatcaggttgacaaataaagcctagaataggttaaattcacaagtactgcatgttttggcataaactatggtcagtctaggaaatatatttcattagtacataagacattatttataacagcacattgaattgaactttgatgaagataagttgagaaccaagcagtgttccttcccctaatttgttctttcaactgcaagtaaatatataaccagcacattgagcgacatactcaatgaccgtagattatgtggatagcaaatcagtattcatgggttttatcttaatgttggctgcgattttcataggaggaagaagttcgcctgagaaaagttgccctaaata

SEQ ID NO: 50431 - DNA, 1501 bp, Oryza sativa
tcagttgcccttttaaaccatcgtcgtagtcgaggaagaagaccgtcgctagagcaggagggtcgccggagaaggaacaggtggctgacgcaggagttgaactgactcattcccatatgccttgtttgagctaacaagcctcttatttaagctcacctttaggtcttgttggagaataacaatagtagcgaagaccaccaccaacatcgcccaaagaggtccgaaggaagaggttcatcgatggcttgacgacgacctcgagctgatcatgaaaagggaaactaaaggattaacctgaaaacaagatgaacccgataaaatctaaaactaaccctactagtggatgagagttggaccccctcccacctcactgacgaccggaaagtcgctgaagatggaagggaaggggtcagacaaggaggaacgcgtgttgatcaaaagtgaatagtgcccaatatctttattataaaactgaagaagtattactgcctccttacctataatatacttataagatttgataaatctcttatacccaaatctagaaagcattgcacattcctactctgaacctgtgaccgttgtgcaggatgaaagcagggcaggatggcacccacgcggcgccggccatggaatctttagtgtttgacagcatgtggtttaagtccaacaacatagattagtaaaactaattttggacggctgcagttaaccaagtgtcggtcggtggctctgtctcgtggaccaatcatttcattagcataacaggcgatttatgtctgatccgtgagtccttttagcagtccagactctagggtgacagtacaatacggagttaactggtaaaaatggaaaaggatacaaaatatttctacgatttattgtccagatgttgtctaactcgaagaaaacaaaatatagtgtaaggcttacattttcagcattagcaaaataacttataacaatagatttaagcaatacggtataagaaactttttttttgagaaaatatatttttaaagacgtggagtaaataatccggtgaagtgtttcagtgacaaaaggggcgaaaaatgccgttctctatagaaaaaaacgtaaggggagaaaaaaaactcagaaaataattatacaatcaatcaaatactgaaatttaaaattggtatgccctgtttatgatttgtgcacctgaaaaacaaacaaaaaaacagaagcatagcgccaaatttagcagatgagatgagtgacataagcagatatctccagcctccagtttcttcagaaaaacggcaaaaaccatcgcctccccgcctcctgtttcgcccacgaaaactctatataaactccactcttcttgcacttctcaatccaattccatctcgatcatctcctcagctactactgcttcatcgaatcgtcgaagcatcaacagctatagatcaagttcgagaggttgattcagagaggcattgcaaattagcaatggcgagcgcggcggcgg

SEQ ID NO: 50432 - DNA, 1101 bp, Oryza sativa
cctcccccccccccccccctctgctgcaaagataaaactaaagagaaaaaggaaaagagtaggagattgctgattagaatggttaaacccacattttttttctcacttacatgtgggccccacatatttatttttttatttttttctgactaggatgccacatcagcgaaactacccatatgtgttatcatgggaccttctttgaacggtttgagtgagtttaggggtagacatttctgcttttatggttaaagggatgttaaaaaaatctcattgttaagttgagggacctccggtgaaattattcctaatttttgttgcccattgtagccttaagcccaacgtcccgaattcctcgtccgccaaccgttgcatctcccaaaccaacgagaccgaaccatctcgctgatgaggcgcgcgtgtcagcgtgtgggacttgggataggatttcaccggcgcaagagacggtcggttcggcagccgactggctcgcgggttcggtattgcggcggaggaattttgcttggttaattctgagtgcaccgcgaagaaggcgaacgacggtcgacggacatgcgcggatgcggtcgagcacagcgcactacagtagcagccgcccggccggcatcagcgaacagaactacagaagtactcatgtgccaggccccaggggcaaccggttacggagcagcagctgcctgtatggtactgtatgactttttgttaattacaaccgtgctgtgttgttttcccatcccttttttatactagtcgaaagaagattagaagaaaaacctaataggcttgagttatttcttttgcaagtgacgaactatccgttctcgtgagtccgtgagttacactgaccacaaatgtgaagcaacgcctgccgacagctggtctgccagatccagcgaaacattagctattctctcttcaagaaatgaaaaggttgaaatgggggacacatgtaagtgactacctctcatcctcttcaccattcctctctctctctctctcttaatggcactctaactcctctccccatctccttggttcaatcaaaatgcagttgccttctatcaaccttggtggtaggaa

SEQ ID NO: 50433 - DNA, 1501 bp, Oryza sativa
tccatacaagaagcaaacttgttgacaactgattatatatctctccaatgattcatgagagaatcatgattgcgatctgaatcgatcgagtttcttgtgctcatggaaattagaatgaatcactatcctacaactgatgaaaatttccccccaaaatttcttgctgcagaacgggaatcttagatccatgatggaagaaaaatctggcatcttctaatgcacgcacttatgcacaactaatcttctactttaagcggttcaatggttgaaccacacatggtttgtctgtttaagtattcattaccttttgtagcatttcaatctgagctcgcttgacggcggaactttctaagtgttgtggtccttcttgagggcattggtaaggcacccagttctctccttggtgggaacccctgagggaaaatagggttcagaacccttggacgagcgacagctatgctcttagcatcatatccttcttgaaggcgccatctagcggtcccgtttctcgcattctctgtctcaactctcaagcaaatggggtattttttgtaaggcggcgggtttgtatgagggacgagtggatcttcttctctctcttctctctcgccttctccctctgcaacccttctcgcgggtgtgtccaaaagatcgtgatttcagctgtttagaggcatgaggcaagagcaggtgggtcagtgacagtttcgtggtaggtttggtggcgttcggtcacgcatagtggtgtcacattcggtacccgtctattggtgtgtgtaggagatgtcagcatgtggtgatgtgtttttttcctttttcctgattataagcctcccaaggttatagtcttgcaattttttttgctatatcaatatgaaacattgcactatttttgtgatattcatttttaaataaaacaagcttggtcaaatggaggcggaggtgacatccgcaatggagctttagggaggcaccaacaccgaaggggagacttgtacaaggcgaagcttgaggagacgttgaaggtggcgatgcttgaagaggatcctcgtggtgcacggcacgacggcgttggcagcagcgcttcttgtgagtaggtatcactggctaggtttgggtagccatccaacctattacccacataaaaacccccttgaagacactaaggccctgtttgtttcagcttaagattattgtaatctagattattaaattagattactctaagctgaattataataatctgacataaaataagctacgagttatttgtttctctggattattagaggcatctaagggtagtgggtctttagccactcaacaatctaaaaaaagctcctctagaggagattattggattatagtaatctggcttatagattataataatgtagcataataatctacttgtttgtttcaacttactcctagtaatctagattataataattctaagctgaatcaaacagggcctaagtagggcacctgagttcaggaa

SEQ ID NO: 50434 - DNA, 1501 bp, Oryza sativa
gcgtacggaaaatatatgtctagatataccatggtatgataaccttgctggaaatgaagatatataagatcaatgttctgatccgctcgatctcaatttgcaaaatattggtcatttcagtatacagattcacggaacaagaaataattaagctatgttttgactatagatactcagatttatatacttgatataattatgttccaaggaattaattagttctctgggagattggcaacactgtcaatctatggagaaactttgttcagcataactggggggggataagagatgtaatagaagcttatttatgaaagaattaatggatcaaattagacatctattttcatcatgtatattactatatatattaattacctattattctcaatctagatcatatatatcattagatatagagatagtaaactagagtttatattagaacttaagaaaacgagcaagactagctacatgtaaagttttcatgctaggtgatgcagataataattaagaaaaagacgttctaatttcaggcaagatgctacattttaatttctgtgcttagctactcaagaatagtacctgtagtccttaattagtaattcagacttttcaattcacaggatagataggaccaaccggcaaactctcatcctagctagatggatgttcatagcctatacgaagatcctcaaaaagaagctaggcagattccctcaaaggcatgctaactgcaccctaggagagaaaacttaaccatgagctatcaaattgcagccaccatctagagggtatatacatgcacacatatagcatggactgagcttgggaagcaaaaactgaagcaaagcagaagaaagaataagcagacgacagttacatgtaccaacacacctcccattcgtcccccttttgttttgcgaaggagatagtagaagactttcctttctcttttcaacttcccataacgtactccctctccctttcccctttcccctttcccaatcttacaaatggaccaaaatgtactcccttgcaagctagctatcctcatcagcatcaatcaatccatctctattctctgaattccaaacccttccagtgcaaaacaaaaaccgaaatgcatgcgcctactctcttactacagatgattgctagttatatatcgacaatgcatatgcatctatatatctagccaaggccggctcatgtcctcccttttgctcccatcactctctgaacacacccacaccgtgcaggccagtagtcctagctagctacactacactacacttgatgacttgatcagtgaaaaggaaaaggggagagagagagagagagagagagagagagagagagagcatataggggagctgagatcaaaacagcacaagcgcacagccaagaacggaagcagctaagctagctagcagccgcagcacaacgacagccaacaagtgtacacctcctcactgtttgctactcccaaatcaacagt

SEQ ID NO: 50435 - DNA, 1501 bp, Oryza sativa
ggcagccatggaggtgaccacgccatggcccctcgccgcgtgccgctcgaggggatcgacggagaagagctgcccgccgggggcgaaggcggcggcggcggcgtccatggtcgtcggagtcgcagtcgcctcgccggccggccgccgcgagctcgtcggaggcgatgcgattgcggagaggagacggctcagcccgtgggctaaacggaggagaggttttacgagccacgccttcatgggccgtggcccaatttcagaagcccaatactctggcccattattgtaagagaattcaataaacaacgagtgcccaattccaataaataccatcaataaacgtgagttctatcaatgtcatcgtacgactttatcctaaaaatatcgttgttgttagagttttgtccctttccattaaatacattgttaatcctatagcacttaacagagggatggcaataaaaccctaacgacaatagtatttttggacaaagttgtttgtacaaatgatatatcctgactaatgaaaagtgaaacccaacatacaactaaaatataccatatctgatgaatattagtcattggattcactaaataaaaaaaagctataatcaattttggccatacgatgaaacttaagtagaaaaaaacatagggtgttctgaacccttctagcaggtaagaagaactacatacgatagaaatgtacaccactgaaaaaccgatcttttgctcgatcggcgaaaattacaaatatctcggttttcttaagaaccggtgctaaagaaggtatttagcatcggttaaaatgtctaacggcacattgctattgttagtaccgatactaaagattatttgtattctcggttcaatttttgtcggaccttgtattttgtgaaactagcattcaccgatggtattttttgacttggatgtttgtcaagtacatttcttgatttttctctcaatgtaaacgggccgaaatatagttcgaatttccggcccaatagggcggcccaaatcgacccgacacgaagcccagcaaaggcaagcattccaaagtggaagtggaaccctactccgccgccggcgccaccacttcttcccccccgacgacacgccggccgccggtcgccggaatcgattgcggcgcgctccccaagcagcagcagcaacgcgggaggagagccgggccgccgccggggagggagcaaggtggtaagctccatccccctgactgggtttcaccctggcagctacccaatgaggagttgcgcttcttctctctgtggaatttctagagtggcttggaggaggcacgcggtggccggaggagctctgagccagcaccaccaccaccagcagcgtcacctggtgctcaggccacccgcgccgccgcccattggccttgccctcgagcgcttcttctccgcttcatcccggcgctccgccaagagatccgccgccgccgcgaagcagagcagccagccaccgccgccgccgt

SEQ ID NO: 50436 - DNA, 1501 bp, Oryza sativa
tttctcggtttttattttgcatctaatccagtgctctctctctctctctctcttttaatccagttgcttacgtgtccggttcaattgcaacgggactctgcaactcgggctgtagcctcttaagagaacaaaagaataacttcttttatcacaccgaatgcacttgtggtatggtagataactccgaccacagggtccatcaaacagcaagcaacaaatttcggtgatacatcgtgattggaatgtgttttcaacaagtgatgttcaagtatgatgcaacaccagtagtaaaatcagggaggccaatggataccttattgcattccagaaaaatggaaaagaaagacagtaagcatctccatggtcatcgtacaatcagcagagcacgttccagaattatcagaagaagaaaaagaccaacccatgaagaatggattggtacaagcagctccatacaaaagaatacattacatcacgaaaaggttactccaaaaattgccaacacactgtagaactgaatgtgtcaacatatgaatgatgttcccagtagtaatttggggagagaacgatggcataatgcaatggtcaagaggggtgagttatcacaagaggtttacatctccgaaaattgccatcacgctgtacaactgaatgtgtcaacatgttcccaccccagtagcaacttggggtgggaaagatggcctaatgcaatggtcaagaggggtgagttatcacaaattagtgcgaggctgggttcccagcaaggcaaagcagcatgctcgtgttgctaaccagagaccatattagtgcctgacaatccatgcgagttgccacatccatgagtacatcattccgacaccacagtagagtgacaccattatgagaggtaggaaaggaaatctgctgccaaatacatagtggtggaatacttgagaccataattctatagcaacaattcctaaaagatagctaaaactgatccacccaatgaagctatttttcctgaccacgctgcctgattcatttactttcttcccttcttgaggagattttgcagcaaaatgggaagaaaatcctacccacatgagggtagcataggtcaacagaagcataacctttataggatattcttggttctcaaacaacaatgggaacaatgaataacatgaaactgcaaaacaaaaaaatgtatgtcaaagcaaaacaaacaatatataatcagcacttcataagtcattgttaaactggtagttcaggttgtcttgaggcaaaattacacgaaattttgctccagttgctaccatagaatgacacaatgagttattaaaatatagttatgaaatggtgttcaactccaactgtccaacaagttagcaaactaagaaatggcaggatattacagcaatagctcattatacatgttaagcagtatgtgactatgtgtctccatagtgaacagattttacgtaagtgaaagtgcagaacagatgaacgccactgg

SEQ ID NO: 50437 - DNA, 1501 bp, Oryza sativa
gggcaggacggggtggtgcggagccaggcgtcgacgcaggaggcgtggaacgcgtggcggcacgccgggagcagccgcagctcggcctcgggcgcgaacggcgagaggcagacggcgcagtcgggggagctcttgggcagcgccgccagcgccgacgccatggtgaacagcggcagcgacgcgatcagccgctccttctcgtcgtcgacctcctccccaccccccgccgccgcctccccctcatggctcctccccaccgccgacgcggcggtagcctccccagcctcgacggcggacgccgtcgtcgcgcgttgggccgccgccgacgccctgggcagcgggctcggagccgggtgcgacggccgcgcgaggcagcggaggaggaagtggatcgacacggaggcgaagaagacgaaggcgaggagcgcggtgatgatgagaagcgacggggagaggttgagcgaagacgacgacggcgccggcgacggcaatgagggcggaatggtggcggcgagcgggtcgccgccgatggccggcggcgcgggcggcggcagggaggccatgggggggaaggagacggtgtgtttaaggctcggccctgcgtgtggtctcgcgcctttatttatgggttttggggtgcgcggcgttggcacggagagcgagcgaaatcggagcgcaaataccaggtgattagccgtgagacgagtagaagtagagcacacacaagcacacacatcactagagaccaggtcggagattactttccggtgagtgaacatgtccagttttttctctctactttccttgttcatctgtgatttgtgtctctgactttggttgctttttctgaccttgattgttctcagtgtcatttctctgtgtcgagatgtggtttttggaggtgtaggacatgagttgtatccgtctcgttcttctctgattaataacatacaaattggagtacatctcaatttttattaacactttttttaactgctaaacgatactcttttcaaaaatattttatataatggccgttctaaaatattaatttaaatatatttttattgtttataataaataaaactttattaattaggtgctgatgatttttttgtttagcatatttttacttaatctttatcttcatcaaactcaaacggcaccatattgttcccttcattacattttaatcgttggtagtttatcttatttttgcctcgtagacaaagcacatcattgtagtacaagtaactttgagaaagatgatgtactaccgtgaaatgggcacaaatttacttcagattaaagtggtactccaaaagatcagctaatgctctacttcatgtcctttgatcatatcactatatattttagcccagagtaatcccggttacaggtttatcagcctacgtgctgcacgaacgacaaaactaaatattggcgctggcgggtgtcaccgtgcaatgtagccgtcaggttaccatctgtcacaacgaga

SEQ ID NO: 50438 - DNA, 160 bp, Oryza sativa
cccccccccccccccccccaaaacgagaagcagcgccaatcagattcccctacaaccccacgcgtttcctcataatcgctacagctgatgcacagggacagggtgaagctttcacaaatttggatcgaacggggccttggttttccttccaagctggtca

SEQ ID NO: 50439 - DNA, 1501 bp, Oryza sativa
cagagtgagttttggatttgaaaattcactgcactacaatgacagaaaccatggctgaagcctgaagggaatatcctagattttttatagcagttgtgaacaccaatgctatttgatatgctggaaaatctcggagaaacgaaggcccaggagtagctgagaaaatgtactgatgaatttatgtctcagaacagcgtataacatgttttctacaacatcatgattggttgttgtcttatatggacatggtaacacaatgattttataccttattttgttgagaaaacagttttacaagtaactcaatagctcatcataaattttctacaatgttggaacatttgggtaccggaaaaatcaccctgcacctcatgaacactgcaagcaaattttgtgaacaccactccattgtcgaaactcaaattactccagcccacaaaaaaatttggtagttttttaagaaactactgacatgtcacatccagaacttgttaagaaatatgtatcagtgtgacaacaagtttgacatggaacagaccacaatgcagattatgggacatcaacgcaactaattacaagcacaaagtgaacaattttaggccaaaataatgtctagaaacaaaaagaactagctaactattgccattcagatttacatataacatcaagaaactaatgagcattcacatagataaatacaagtcgcacaagaaaaagtgtatgcattatttattgtgtttagaagcgtgcaagcccaaatgttgttgctgttgttgctgaacctaacaaaattcaattatatgcagcatataatggcgtgaccttcttcagatcttgatcactcactattgatatcaaccataacaagcataaaagcagctccaatataaatttaacaactaaatcccgtctgcaattgcttttcttcacaattaggtgagcccaagaacacggcaataacaaggacagtgcaatccttagttgcaattcatggtgaaatcacataattaaaaaaaatcgtcgcggttaaaataaactgattttaacttactacacacgatggaaacacgattgggtatggataaattcataaatcccccaattccatacaaatcaggaggaacaaaaagaagacagagacctggagagcgattgaacagtcccgccaggatctgatctttccgactaaactgaactccccggcatccacctccgggactcccgtggcctcccgcaccgccgcatcccgtccatccggccggccggcggccgccatggtcgccggctcgccgccctcctcgtcttcctgcggtctggggacccgttggtaagagcgggataaaaggagggtttcgttgcaaaatctctcttccccatcgcctcgggttttgatctgagccgcacaggggagatcgaacggtcgagatcctgtcacgggtggagtagattgataatacgggtgtagttcgagggtctcttcggaattaaaccagtcgcgtgc

SEQ ID NO: 50440 - DNA, 1501 bp, Oryza sativa
taaatcattatttcaacttagtaataattaaaacgcaacactttcttgtttttcgtacctaactttatctctacctttaataaaacaagataatctttttattaggaaaaaatattattatcttcgctccaaaatatattaactttccattataaatctaggcaacattttgggacagggtagtatcgtatattcaattgttctcactagagcaaaaatagttcagttgttcatcacattaattgcgcaaatcctaattggcgcgcacgcgcccctggcgcgcacgcgccggcccacacgtctcatcctcagccattctcagcgcttgcgctggcgagacgcgcgtttatttttttcggaattttttctctatacgtataaaactgattcggttagttctaggtaatgataataattaagataagatttgtcttttttccgaagattattttaagtaataaattgaaaagaaatatatatgtgaagtcaaattctaaaaactttcaatccagatttgaaaactttcaatctagatttgaaaagtttttgaagttaaattttaaaaactttcaacttttcatcccaaatttaaaacttttcatcctagatttgaaaaatttcaagccagatttgaaaacttttaactcaaatataaaaactttcaactcaaatttaaaaactttcaatacaaaatttaaaaactttcaagtcaagatttgaaaactttcaagtcaattttgaaaacttttaactcaaatttgaaaattttcaactcaaattaaaaaactttcaatacaaaaattaaaaaatttcaagtcaaaataaaaaactttccaattctacatttgtaaagaggtgtgcaaaagattaaaaaaaaatcggaaagaaacggaggaaaaaaaacgcgctcagagaaaaaaaaagaggtgcgaacatgaaaaaaaaatgtactgcgtttttttacacggtaagcgctagggttagtaggaacacgcgcggcttcccgttctggcgcgtgcgcgtgcagtaggaacaccccattaattgggcttcaaatcatacacattgaagcaattaggcttcatctctaaaatgggctgaaggcccaataagaaaagtcctccttatacctctataaagtgattgcgagaaaaagaaaaaaaaagaagaaaaaaaaagagaaaaacacaacaccatcaacccccgcatccgccaccgccgccaccaccccctaactccggtaagccgccgccgccgtcgccggcgggcgccgtgtcttctcccatccgtcgtctcggatcttgcagcgaaatttgacaaagtttccctccttgcctcgcagatttgaagcgaccagaggccgcggctaaggtccgggatggtaagttgtaaaccctcttctcccctcctggggtttcgggtgctcgattggatcgatcccgggtgctagttcttggtttggtttggtgggattgattccggtttcgtgtcttggtggagc

SEQ ID NO: 50441 - DNA, 1501 bp, Oryza sativa
agggcatcaagggcctgcaggttcgagtttgttgccagaggccatcgagggctgcggttctgtacttgtgttgtgttggtgttatttggttggaatgagcgtgatggaggaatttggttgtgcagatggaaaccgccgtggttgggaacgccacaaggttctatgtgatggctgtcacaccaacacggttgtactcattcacgggcatcggttcattagaagtaagtacaattgctcaattttatcagctccaaatttcggagacatacaccattatagaatgtaatgggagcaatctagatcgaatttagtgaaaagaaagacccagatttttcacttcggatatcaaagtcctcatggacggtgtttcttgatttaataacgtgactcagtaacctcgaaagtgctatactacgcgaagtcagtatgcctcttttcttacagagagatatgcgtgattagaacagcttgtgatgccttttgccattttagagagcagcattgcatgccaacagtttctatagaagattttctcttggtttccagaatttcagccctacaagatttatttgtttactcattttctcttgatgtaatatctaataacaactatattgcacagactgtttttgctagctattctgatcgtgcgatacactttatggagctcccaggagatattccaaataggtgagtataagggcaagtgctatggtagatgtgactaccacctccaaatttatctattttattcactcataaactaagaggcaatccatacaatgtatcacctctagtacacaaataccaatatatctaatactctcacatccttcttgaaatttgtgtggaggttgcctcttgatttaggggtggctcatcatctctctcctcacttctttccttcacatcatcactcaatccaatgtggcattcttaggggcaacatatgggtcattatagtacttgccctaactttatgtgatttatacagtactatacagtggtaactacagtttgtgccacccactagaatactttcttttagtgagcttatgacaatgtatccattgcatggaatccagtgaattacatttctttatcaagcaaagaagggctaagcattttggatggctttctggagctggaatttaccatggtgaactgaattttggagctcaacacaggtgaactgtagtttttggatttaagttgattccatcatgtaacatgtaactgaagtggattattaacttatgttttctttgttatctaatccaaatgtcattgaactgctaagctgctagcattctcttagtgggcatatttttctaatagactgagccttggtgtgccttttgaccttataagaaatgtggcaagtaatgtaatcccccactcctaaacataagttctttagggaaatgtaaagtagctactttggcctcaggaaaaacaataatagttttctcatcaagataatcaaattgtcatcttacta

SEQ ID NO: 50442 - DNA, 1501 bp, Oryza sativa
gtccctatgcaacatttcaattgttcatttccttattttgatagttcaatctcttgtaccaattagttacggatgaattcatttacctgtaggctgaaaaaatactggacctccaaaagcggcttagcctaatggacaggaaagcagcaaaggaaaatggcggaaacatgaatggtgaatctattatcagtgcgacaccaattgacaaggtttggtcacatccaaactacgaaatcccgagatctgcatttcttgtactaatgccatgcatgtttcttgtgacagttgaggtcccagctggatgatgctgtagcgagcgagtgccccttctgcggcgatctgatgatcaaggagatttcattgcctttcattctccctgaagagtctgatgaaaaggcttcgtgggaaattaaaccgcaaccaacgggtcagaaaattcttccaatgaccatgtctatatgattctactagtaaaagctgagatggaatagaatgtttttcgagtttgtatgtgattttgtaatgctgaatatatgctctttcatgtccaatttctggttgggtggctttggtttttgataattgcccagctcgtgtatctttctgacgagcagaacattagctatcctatccagaatagtttgtgtacagaaacatcatcttccacttcacttgggctcttgtacatgcctcctttcatcaactttgctcataataaagttgcgatttgttagggcatataggcgctgaattatgtttcctcaatatctgaaataagatttgataacttcagaaaacaaaaacagaaaagcatttttgtgatgtaaacctgcaagaaacaatcgcaaaatggggcactatttgtcacttgattttttttaattacttaaaattaaaaagcacagacgtcctcgttggaaaaaaaaaaaccttcactccggtgctttttactggaagtagaaaataatctaaaccgttgatctcaatggatccaagggtttagatctatttctactaccatctcatataacggtagtagaatcgtggaagggtaatattgtctaggaaaaaatatttgtggagaggtataattgtaattatgcagtaattgtggaaaggccaagaaagaaatagtaaaagtctaaaaatggattgaaaaggataagactggcattacaattaatcaatcttaacccacagcatcacatgggtagggggtaaaagatgggtaaataaaccaactgtaagaacaaaccaagagagaactgtctctgaacaaatgctcctaaatttagcaacttgtcaggacacaaactacaagaacagaaatagaaagaacagtctcatccatcagtgcagccattggacagcattgcgacgctgctttctctgcccataaaaggaattgaaccccacaccccccctcctactcttcctcctcctccctcctcgccggagcttggctgagcttgagctgagctgagctgatcggcggcggcaa

SEQ ID NO: 50443 - DNA, 244 bp, Oryza sativa
agggaggcgtcctctcatgaataattccaaactcttcgcaaaaggatgcaaactcattggaaaaatactccccacctctatcagacctcaaccgtttgattttcctttcaagttggttttctacctcagctttatagattttaaagtaatgcaatgcttcatcctttgttttcaatagatacacacaacaaaatctagtgcaatcatctatcagtgtcatgaaatatttctttccccctttagt

SEQ ID NO: 50444 - DNA, 679 bp, Oryza sativa
aaataataaaactattggcacagatttttttttctctgcatcttcattttttttcttcaataaaactactgtctataacacttgctataagatatttgttttgttcatttcataaaatatttaattcaaccactaatcaagtattaattaaatcagtgacaataatttggtagtaatctgttaatttcaactacaccagtcactgctgtttgtgaggagagaacaccaatttatctcactcatgccacataaactaaaatttactcttgtaaacaagctagctagctccatgctaacagcaagtactaaggcaaaagaggtactcttcgctgtgtcaacaaaaataaccgttggagacagaaacacaatgcgcttttgggattccgtgtggatagatgggcgcagatcaaaggacctcatgccactagtctgtgcaatctcgaagaaaaaaagacaagtccctacgacagggaaaagaaaatgatgcttggatcaacaacttagactttgaagctaacccagcaatctcggtggaccttattgaacaactagtctctttatggattgtcgtgagagacattcacttaaacaataagcagttagaccaaattgtgtggaaattcacaaaccatggagaatactcagcaatcagcattgtcggcttagcaggcacaatgct

SEQ ID NO: 50445 - DNA, 281 bp, Oryza sativa
ctgcagccctgtgtgtctttgcaagtgtctgcaattgtgaacacattgtaaactacaaatttcacatgaaatggaaatatataataatatttatttcaaaagtaacgtaaaattaaagtgtgtcagtactagcgaatcctcgcaataatgaaaacatataccacacaagatttgggaccattaaatcgagcacaaaaacccatttatagagcatcctagctaccctcttcccctcatatctatcccctttccattgtactccccatacaccccttgtgcca

SEQ ID NO: 50446 - DNA, 397 bp, Oryza sativa
gaaagatgggccgagagggattcggcccatcgaacccgagggaggcaaaatagacttttgcggagggattgatttgggaaggatttggattcaggattgaactcgacgatagattgtggatttgagatctgagatggcacggacactagacagcaagcaaagaaacagatttcgcaaatagggtttttaggagatagttttcccgctaggcgccacaacggaacgggcgctacagaatgatagtaaattaaatgttaaaaactctaattaacatatgaaattgccacctgcgtgatttaaaacttttaaaaattgtaagtatcgcatataactagcatacacatgatttaaacttgttaaaacctctaataatcgtgcgtaattaacatatgccata

SEQ ID NO: 50447 - DNA, 483 bp, Oryza sativa
ctgatggtaacgacgttgcggatgatcttggtcagatgttgcaggacgccaaggaggactgcgaaagtgaaaagggagcccataaattggacaagatgttagaggaccacagaacttcgttgtacccaggttgcgagcaggggcacaaaaacttggataccactctggagttcttgcaatggaaggcaaaaaatagggttagtgacaaggcatttggcgatttattgaaactcgtcaagaacattcttccggagggaaataaattgcccgagacaacgtacgaggctaagaagatagtctgcccgctaggactggaagttcagaagattcacgcatgtccgaatgattgtatcctatatcgcagtgaggagtatgagaacctagaagcatgccctgtttgcaaagcattacgatataagattagacgagacgatccaggagaagttgacgggcagctaacaaagaagagaattcctgctaagg

SEQ ID NO: 50448 - DNA, 1501 bp, Oryza sativa
gatcagccacctgtttatacaggaaatatctgctaagtcatgagacatttatgttttaacaatcttatattaaaactcaaataatcttatatgctaagacaaaaatagccatgtatgctaagtgtaactgtcgtatattagaaccctacacaatcttacatgctaagtctaattacaaatctaataatcttatactaaaactcaaatagtgatatatgctaagtctatgtgacgtatattataggaccctagctagtcaataattatatactaagtctaattacaaatataataatcttatattaaaactcaaataatcttatatgctaagacaaaaatagccatgtatgctaagtgtaactgtcgtatattagaaccctacacaatcttacatgctaagtctaattacaaatctaataatcttatactaaaactccaataatcttctactaaaactcaaatagtcatgtattctaagtgtaactgtcgtatattagaacactacataatcttatatgctaattaagtctaattacaaatctaataatcttaattgcattacaaatatatcaatcatatatatataattacgttacttgcctgggcgaattccttcgagggctagctctaccactccggcttgagggacgactccgacaacgtcttttctgcaagatacaaaaatatgtattaggataaacgcgaagtaacatatattgcatttgacgttcacatttcgttcacgatatcgttcacgttcgcgttctcgttaaggtcacgtttcattcacctacgtttcttcgttcacgttcattaacctgcctataattgcatttcacgttcacgttcgttggctcgttcacgtttgtccgacaacgttctcgttcacgttcattcaccttgttctcgttcacgttcgttctctcgttctcattcatgttcgttggctcattcacattcgttcgctcgttctcgttcacgttcattcaccttgttctcgttcacgttcgttcgctcgttcacgttctcggtgtggtggcagcggagcggcggcggggcagcgcggcggcggcgtggcgccgcgcgcggcatcggcgtggcgcggcggtggcgtgcggcgacgtggcgtctcgtggcgtggagtcgtcgtggcgcggcgtcgtgtcgtgacgaggtcggcgtcggcgtctgaaactcggcggccggcggcaaccgagagggagagagagagatcgagattggagagagagatcgagagagaggcggcgcgcggcggctctcaccccagagatgcggcggcggcggaggaggcggcggcggcggcgacgacgacgagcgcgagatgatggcgagatatggcggcggcgtcggcgcggggatgccctaggcagtggcggcgaaggagaagccgagagagatcgatcgggcaaaaacttctaagtgttggtggagaagatgagggcgcgcactgggaatatatatagccctagatctttagtcc

SEQ ID NO: 50449 - DNA, 1501 bp, Oryza sativa
ggtgagcccggtccaccggctccctctctcctcccctcccgcgcgcgctctgggccgccttctgggccggccggcccatttagctcggccgagccgccccttttctctcgggccgcgccctagccgcccgagggaagtctaattcccctccctcttccttttctttttccaaaagggtttaaataaattctttttcctttagaccaaaaaaccaataatcttagaaattcaatatgttcccaactgtaaatccgttggactccgttcaacttccataattcctcaaatctcgagatctatctaatggcatgcttagaggtcattaatagggctttatttttcgccgtttgttgagttgtcccattttgcgtgtcgtttcggagcctgaagacccgcagtgcgaggatttcgaggatcaagctcaagatctcgagcaaggcaagccacctttgaacatattgagccaatatttgaacttaattatattgcttgcaaaatattatgcattgataggattacacttaatttgtttgcgctgtctgaaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacaaaagacttggaaaacccgacacctgggtcggtgcttgcgaactaaatgaatttccaaaaccgcggaccggggaacgtaccgggtgtacggtttcccgctcttgcacataaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttagtctgggacccctctcgtcggcatatggtaaacctgtgtcggctttcgaaatgccttgtcatgaaaacttggaggtctcccgacgtggctgatccccacgggctgggtgatccggttagtaatgtcgtgtgggtaaagtgtaccccctctgcagaggttaacaaactgttcgaacagccgtgcccacggttatgggcggatgtgaggtaattcctagcgtagttttgtttgactactgccttgtgaaactgctgttgtggaaaggggatcgatgttggaaaaatctgcagctgatgggatcagctaggcccgggtggccatttgaaagttgttgcccgggtggccgtttgaaagttgttggccgggtgccaatcttgatcaattctaaggactgatacattgcacatactccgaccggacgagacgcactgtctcatccgtgtcgtttgagaagcactcacttagttgatttc

SEQ ID NO: 50450 - DNA, 1501 bp, Oryza sativa
catcaaccgggactaaagatctagggctatatatattcccagtgcgcgccctcatcttctccaccaacacttagaagtttttgcccgatcgatctctctcggcttctccttcgccgccactgcctagggcatccccgcgccgacgccgccgccatatctcgccatcatctcgcgctcgtcgtcgtcgccgccgccgccgcctcctccgccgccgccgcatctctggggtgagagccgccgcgcgccgcctctctctcgatctctctctccaatctcgatctctctctctccctctcggttgccgccggccgccgagtttcagacgccgacgccgacctcgtcacgacacgacgccgcgccacgacgactccacgccacgagacgccacgtcgccgcacgccaccgccgcgccacgccgatgccgcgcgcggcgccacgccgccgccgcgctgccccgccgccgctccgctgccaccacaccgagaacgtgaacgagcgaacgaacgtgaacgagaacaaggtgaatgaacgtgaacgagaacgagcgaacgaatgtgaatgagccaacgaacatgaatgagaacgagagaacgaacgtgaacgagaacaaggtgaatgaacgtgaacgagaacgttgtcggacaaacgtgaacgagccaacgaacgtgaacgtgaaatgcaattataggcaggttaatgaacgtgaacgaagaaacgtaggtgaatgaaacgtgaccttaacgagaacgcgaacgtgaacgatatcgtgaacgaaatgtgaacgtcaaatgcaatatatgttacttcgcgtttatcctaatacatatttttgtatcttgcagaaaagacgttgtcggagtcgtccctcaagccggagtggtagagctagccctcgaaggaattcgcccaggcaagtaacgtaattatatatatatgattgatatatttgtaatgcaattaagattattagatttgtaattagacttaattagcatataagattatgtagtgttctaatatacgacagttacacttagaatacatgactatttgagttttagtagaagattattggagttttagtataagattattagatttgtaattagacttagcatgtaagattgtgtagggttctaatatacgacagttacacttagcatacatggctatttttgtcttagcatataagattatttgagttttaatataagattattatatttgtaattagacttagtatataattattgactagctagggtcctataatatacgtcacatagacttagcatatatcactatttgagttttagtataagattattagatttgtaattagacttagcatgtaagattgtgtagggttctaatatacgacagttacacttagcatacatggctatttttgtcttagcatataagattatttgagttttaatataagattgttaaaacataaatgtctcatgacttagcagatatttcctgtataaacagg

SEQ ID NO: 50451 - DNA, 1501 bp, Oryza sativa
atgtgtaaataaaaggaaaagatgtttggtgttatcagaattattgaatcggtacaacaacatgtatcataccatgcatcgcatcatggaggagtggtgagaccgtgagactatgagctaagagtttttaatgtttcattaagtatcttgtagtatgctttattgattgaaatttggtgttttattattcttttaactgatgtctatcttcaagtattgatgaatgttgggacaaaattaatacaacaagcatatgtgtatcacttctgtattcaatgtgcccaactgtaagcagtgtttatatatttatacaggatgtacaagagaaaattacatcgctaccctaatcgctgatttatctaggtggctggatggtgggcctgtttatggctctttggtaaactcctcggtgacaggagggctgcgcccattaagggagcggcacagattcccgagggcgcctgctattacccgggtaaaggcgtgctgcgggtaatagcgtacgctgtctgccctcgtcagcggcgtcagaggtggttggcagatgcgtactgtgtatttatggtgttccactatatatccgttcacccatcttacgcctagggctgttgaggccctagcttcttctggagcccttgtacagctccggaggacctggaaggctttgaagtccttggacagctccggagtccacggacagctccggaggccttggacacccccgtagcccttaggtggctccgaaggccttggatgaccctggagcccctaggtggctccgaaggcctgggtcggctccgaagcctatgtttagctaagctccggagtctaaatcagtagatgccttcggtcattcttctgatgtggatggctccggtaggtgctgcatcacaggacggaggctagctccgctacccggagccactccccccaacaaagcaaaccactcaaaaaaaaaaactccagctattctaaataatctgtcctactcaaataaaactaactctttgccaaattatgacactaacaagctgcactggagtaataatataatggaatttctacaattgtagcgcctcccattttttttattaatctcgttcacctttttcctatgattattctatatcctatatatatgtaagcatgctcttatctctcatatctcctcatttaagtagggtttaatatattatttttaattctaattctcttgtaccctgtgtatgaaaatatcacaatgtaaatattgaaacttacaatataatttttgaaatttacaatgtaagtgtaggtaatttacactgtaaaacaatttcattattttttactgaaacatacgattcaatatattctactccatgcagaaatatgatttactatctacgtgctcaaaattttctgaacggttgtcagaccacaaaactaatgcctgaattgtaagatcaactatttgtcttataatatcgttcctcgaggaaaatattgcacgcatcagatt

SEQ ID NO: 50452 - DNA, 1501 bp, Oryza sativa
attagggtctttttaaaaaaatatatataagttggaccacctatataaaaatcatagatataccgctgcgtgcatgatgtctttcttttttttttcagggatgcgtgcatgatgtcttagtcacaaaataaaaaatgtggctatggtatttaagacggatggtgcttgattgaagggtgctttcttttacaatgctctaccattatattagatcacaaagggcccccgcaaaaaaaaaagatcacaaagggaaattgaagaaagttgagtgttcaaagtaaatttgtaaagaaactgcattatcaaaaacatgtcatatatagacgtcttgttattttgccagaggtgtcatctcgcctgcacgctatatataactggcaattacaaaagttgaaacctggcatatggccggtcatatgtgtgctctgatctaaagcctgaatttatctaattgctatttgcccagactgggaaagcagccctcgttgtatcgttgcttcccagccctggttctgagaagaacggtaatcatagcacttgaggagcaaaatttgccatcgttttaagcttagcaggctatattcaattccatgcctttctgatccattttatcagctgctagctctgagcctcgtcgtccttatgttgttgactctcttctacgttggttcatgttatactatttgtgtatataaactacagaacacgaacaacgggacagtatagcggctgatcgagaagaaaatgcagccgttccaaatcaagttccacacattccgacctcctcctgctttgatggtaacttcatgagctggtgggacacttgctgaaggaagatatggtgaaggatcaaaggaatattttcgatggaataatcatttgcacggcttgggtcatttggctgcaatgaaatgacagaattttcaactgaacctacagcacggtggaacatgttgtgaattcgatcttggaaatgtgtaaacaaatggcggcagctcagctagtcccctaaattagatggcccttagtcgtttgttgctgcttgtggccgctggctacctaaaaatcggttcctgtattgtgggggaaaaccttggttcctctgtttgtaaaaggattttccgtttgttttacttgctttcctctataaatgaatggtagagctcatgtcttttccctaaagagcatctctagcagtagcccctactttcgagtccctaaaagttaaataggggctgccctcaatgttctaggaccctaaatatgtctttatgtctagcagtagcctccatatcttagcccctattttttttctcttttattttagtatagaatttatatttatatctagtttaacacatagtaatttaaacataaataattctagcgcatggaattcaaccatattcaaatttgcaatttcaaacaccacgattcaaaattgaattcaaaattttcaaacatgaaaatgatatatcctagaagcaaatattgaacataa

SEQ ID NO: 50453 - DNA, 1501 bp, Oryza sativa
atcacatggcaagctgtaagttattgcctacttcctactagtagtactggtagtaactgaaagctccaagcagcaacaatctcatatcgatcctctagctccctcgtcagattacaggggaaacgttcttgatcatcatctccctcgtcagcggctgcacgcaccaattaaggcctcactctgaggcgagtctttcttcctcacgcaccaaccctctgcttgcccacaagctctggttccttgcggtatgagctgattgaaacatcggattgctcagtggtcgtcatcttggcgtgcactgctgccattcccatcaatccagctccattcggcctcgcctttcatgtccagctagttcaccttgtatacatgaagagaacacctcatctgtgctggttacttcgtcttttcattgcccattgaccaaagaagctatcgaaaggtaaccccattaattcttccaattcttcagcttcagtatactaaattacttgctccaaagacattgcaaaatagcttgttagctagagatcgtgctcctgcgttacataaagatgaaactgagtaaacttctgatcatcttcagaccatgttattattgttaataacttggaaattttcttgcatcacctcccatcatcactttatacgttatatgcataactctcaaagacagaagaaaaactcaagaacatatacaaatgagaatttccaagatgatttctactgtaatattgaaaattataaagtaccatccattcttttcacgccagatgactactttataaggtagacttgcatgtaaggatgtacttcaaatctcttgttcttctagctgtgatcattttattgtttttttttcaggaggagaagggagggggggggggggtccataatgttagttactacagttaaatgcgctaacacaactcctaggctagcatgtgcgaagtagttatagaataaaataagatagatatcttaatgttacgccagcttttggaatcatttctggactgcattaatttttaactctcttctggtattttttgttgaattccctaaaacagtttgctggatggcaacaatagtggatactttggttggatcatgcatcaataagttgcaagcgatcattacagacaaggcaatactcattttaggggtaaaagatgagcttaagaactgcagcgaagaacagatctcataagatattctcttcaggatgctgaggcaaggaggatgaaagattctgcagttcaaaaatggcttgaccagctaagagatgttatgtatgatgttgatgatattattgatttggctagatttaaaggaagtgtcctactacctaactatcctatgtcatcgtcaaggaaatctactgcttgcagtggcctttcactttcatcctgcttttctaatattcgtatacgtcatgaagttgctgtaaaaattagaagcctgaacaaaaagatagataacatttcaaaggatgatgtat

SEQ ID NO: 50454 - DNA, 1501 bp, Oryza sativa
ggagaggctgttgtttttgcaattgattttatttgaactcttttctaagaacgactaagtgagtgcttctcaaactacacggataagacagtgcgtctcgtccggtcggagtatgtgcgatgtatcagtctttagaattgaaacaaggttggcacccggccgacagcttttcaacggccactcgggccaacaacttttcaaacggccacccgggccaacaacttttccaaacggccacccgggcctagctgatcccttcagctacagatttttcaaacatcgaacccctttttcacaacagcaatttcacaagcagtagtcaaacaaaactacgctaggaatcacctcacatccgcccatgaccgtgggcacggctgttcgaatagtttgataacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacctatgtggtcgtacttgtcttatgttcggatgaaattccaaggaaacgatccttaagtgcaagagcgggaaaaccgtacacccggtacgttccccggttcgcggttttggaaattcatttagttcgcaagcaccgacccaggtgtcgggttttccaagtcttttgtaaaactccagttttacccaaattgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccgatctgccttgcagacgggacaacagattaagtgcgatcctatcaatgcataatattttgcaagcaatataattgaatttcaaatataggctcaagatgttcaaaggtggcttgccttgctcgagatctggagcttgatcctcgaaatcctcgcgctgcgggtcttcgggctccgaaactacacgcgaaacgggacaactcagcaaacggcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggatggaaaatagacttccctcgggcggctagggcgtggcccgagagaaagggcggctcggc

SEQ ID NO: 50455 - DNA, 1501 bp, Oryza sativa; identical to SEQ ID NO: 23445

SEQ ID NO: 50456 - DNA, 1501 bp, Oryza sativa
tgcacaagttgaaaaaaggtaatattatttcattccgaaaagatagaacaaccgtgaaaataacgttcaaaccagtcagttcagaggagaatacggtgatggacagaaggccagaaaacaacccaatggtgagaatcgatcatttttctagacaatgaatggtgagcaattgatcttggtgaagctgaaccagataagttgacagcgttactgttagtggtgatcagcccagccatccgtaaatcctttcttgcattttgcccaatacaagtcagcaagtcaagatgttcttatcgtttcagactaagtggacactggaatctgttcttttcacatccacactgggacacatacagaaaagctaaatggacataccacctaacagcaatatctcttgtcttccactctttgtcactgcataagagccagcccatctggatgatccacgcaatcaccggggaacttgctcgtcatcttcctcgcaataggcgatcgatttgccggcttgccatggctgcacgcaccaaaggcctcgctctggggtgagtctttctttcaattcctcgcaacatagcatgtgcttgcttggttgttgggtctgatggaaatgtcgtcttgcgatgcagcagacgcgccccatgccgctgctgttcccattgatctaggatcactccggtctttcctttcatgctgagcaagttcgccttctgtacttgagtaaaacccctcaactttgttgccagatatttctttctggttgcccgtttacccaagaagctatagaaaaaggtaacctcattatttcattttttcagattcagtgatccagtatggtcttgtggcaaaacacatgcaaaataacatactagctagatatgtgctcctctcttacaaatatactctactttatgagtcaggctgtgtttagttcagtgcaaagtttggattttggttgaaattggagatgatgtgactgaaaagttgtgtgtgtatgacatgttgatgtgatgaaaaaggactgaagtttggatccaaactttggatctaaacacagcctcagtcagacagtaagacaaataattcagttcggtctctagctatgatggtccgtgcatgtcatcgaatgcatttatgcacactcataaagtttgagttgtcagtgttcatactccagtaactgaaaaacatcacagggcaagctataagtcattgcctacaagtacctactagtagtactggtagtaactgaaagctgtgcagctagccttcactggcaagctccaagcagcaacaatcccatatcgaattaagtggaaactcttatacaaagaatagatggataatatatttactgaacttcatcttgcattcatattttgtcagccttatctaacttttaaactatgttaacacaagtttggttacatgtcaggctgcattttttacattgatcaattatatatggtggattaccccttttgagtttgtcggatggcaacaa

SEQ ID NO: 50457 - DNA, 1501 bp, Oryza sativa
tatatgcatatgtgatattactactggcatatagtgaatatagcaatgccatcatagcattgtttggtgatataacccatacaattttcttttggagtagcagtaatctctatctatgtctgcagagctaggaacactactgcacatgattatgttgtagtacatataggacaatacatttatctagaatacaccgtatgtgcaggatgcatgttaataagatcatgagaggataaaagatatggacaactaacaaatttgtcgatgtatatccaccattttatgaaaatcttgaccacggtgaaatggttacgtgcagcagtaatgaaataaatactaaatcatataagtgattaaacaatcagtcaatgcacacaacatgaacaactaaggagactatcaaatgctagaatagatgcatacagctgaagagcagaggagcagcatgaatgtacaacccaaagattagtatattccagtgaaaaatcccaagcaattagtgtacataccttgcaccatctaaattaattgggtcttagagctactcgttgaccaccagctcatgctcatctccatggagcttgcagtgtagctcctgaagcccagggacccactgctgagagatctcgtgcataccttcatccagccatagctgctccaaaccgcccaactcctcaacatgcctcaaattcgggcaacaatttaaaaacaactctctcacttggggaaggttggagatcctctctaggtcttcacatctttcaactaaaagtaaaccagagaggaacgggaggtcctccaccgtcttcaatcaacttgtgtatcttataaggagctccttcaagttggtctgtccaagctgtggtgggagagccctcagcttggggcagtcccaaagatccaacctcctcaaacaaggcatcagccacgatgaccttggagacagggctactttccccttttgcttcgaagcaacagttccatcctctcccccttccttggctgctgcaactgcttcctcctcctgcacctcttcttcttcttgttcaacaaaggaccactcctcccagttgggcatatccttgatgatcaacatttcgagcttggggaaagcaactgcctctgtggatatgagattaccttccctgcagccaacgaattcgggtccaatcttggtgattgcacttgctccaataattttcaagtagttcaagtttggtagctgtccgattggtggaaggtgcacacaggatttgcaatttgcgaggatcatggatttcactgaaggcaaatgggtagtaccaagccaggtggggaatctacaaccaaagaaatacccaataacaagatctcgtaagttgtgtggaggtgttagcatctcgaagatgttctcaacgttgctagcattttcctctgaatatgcttcatctgtctgttcagtgcaccatagattcagaactttgagatactttttctctgttagcagaaatgggtctacacc

SEQ ID NO: 50458 - DNA, 1501 bp, Oryza sativa
caagtggtgtgcatatagtgttagttgcataccgatagggggagtgtttgcccaagtccataaggaccgaacttgtgtcacccatttaaagttattcgtacatccacatgtgctagtatgggatggcctaagctgattaatctatttaggactagccttgcattctggtaggccggtgtgtatgagttagtcgataattatgaggaattagtcgatgattcagaggaacttcctatttgccccgacgtggtagtttaggtgactaagtctgtccaatacaacggtattgtgccacgtgggtgggttcccgttgtgtccgccaccacggcgttaagtttaaggcgtgggcccgccacttaacggttctagacatatttccaagtatgcctaggatggaggaacacgtatcgtgctggtgtaaggctagattctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattagccgtgctcacggtcatgagcgctttggtgatgtgtcatgagtataggctttatgatttaaaatgtgaacatgtgacttgatttgaaattgataaaacgtgttgagttgtgtgagtgtgatgatatattatgacttgttgttcaaggatgacaacaagagattgattatgatggaattatgataaacttaatgttaaaacttaaaacttgttttgttaattgaagcatcaacttctttacaaaagaattgcgaaacaaaacttgctttatgctgaaattgagctacatattgtcttcctttgaatatatgctttacatgtagtatggtaggattgacttgtgcttgccagtacattaacttgtttaatgtactgactcttgctgtttgatataaccttttgtttgcaggtttagtcttagtctttgagtgatgcgggttccgattgcttcttctaggatgagaacttaatggggtatacccttagtcggtgtgcttgtgtttgggtagtcaagcttccgctgttctctaataagtctatttgggcggtcggcctatgtaattattaagttgttgtaagtcttaagtttctttcatcttagttgtgtttgctatgtgtaaccatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaagg

SEQ ID NO: 50459 - DNA, 541 bp, Oryza sativa
ctaagtatttttttccgcaaatattgcatgaataggatttacacaagtaattcggccgcggcttgcgagatatcttgccggcccccaatcctaattgctgcaattaccctccttgaattattgaacacttaaacctcctttgtcaactgttgtgcttcgatgcacgggcctttgggtacgcgcatcggaaccccccctcaaaatttaaaatatccaacgatgggtaaaacttaggttttacaaaagacttggaaaacccgacacctgggtcggtgcttgcgaactaaaatgaatttctaaaatcgcagaccgggagacgtactgggagtacattttcccgttcttgcacttaaggaccgtttccttggaatttcatccgaacataaggcaagtgcgaccacatgggtggaatgggacacacctggctgagtaattagctagtcgggggaacgatgatgccaagagacatgtggattcaacggggtggtgtcggggagaacccccgggcttcctggcacagtatggtctgggacctaacctg

SEQ ID NO: 50460 - DNA, 1501 bp, Oryza sativa
atggtgaacttgtcggccgctgcagagcgcactgtagcgcgccgtcctgaccaaaggcctctgcatccacaagctgaggatgaaggtgatttgggatggcaccgagaggtgcgagatgaagatggtaattaccagaggatgacgtgtgggaccaaggatattttataaataattgttttcttcatttgtagatcggactgatctggtgaaatagctgccgcacatattttgtaaataccggttactttacacctgaacttcttccacggtatggaaaactcctggtgtaaaaagtttagggtgtaaagtaaccgatattagagtttagtggtgaaaatcgaattaccgacatcaaacgtggtctttgaaagttgaaatgtggttactaaaagtcattagcactactttctaagaggactcgcgcgctaatttaaatggtagccaaatttaaagaggtggagcgcaccaattttaattgtctagattattcagaattttgggatagaagaagacatgcaaggagtagtaaattagctgaaaagaacttaatcccactattaccacactcacatgtacacacggctacttatatggaccggtgtgcacggctcacgtttttgacccaagaaatcgacgtgacaacgatcgagctctccgatccgatcccctctagctaggattgtaggcatggaggcattggaaattactcggtggcctctgatccttccctcgcagcttggcgatctcctcctcgaccaaacccggcgcttgcgtctaacgcggcatgtgcgagttgccacaaccacaccattgcgtgcgtgcggcttcttccctgcacgccacgcgcgatcgacgacgtacgtgttgcagcactttgttctggccctggtggcggtaccggtgatcttggtgtttgctgagcccagttctgatggtggatgagtaggtcagtccctctgttgcatctattccttgcaacagagtgcagctgctgtgaatattttttttttcttgaccatacggatgagctagctcatgcttagccttacgcttgaataaactggaacgtaataaatagaactcggctcattaccatcaagagaccttttgcaactaaggatacatattttcagcttttttttaaaaaaaatgattaaaagcctgacctctacatccaacttggatgtacccaacacatacagtgatgtcattgataaataaaataaattttgacaagttggaaaactcatatattagtaactttcactacttgactaaatttggtgctactcccccgtcccatgatataaaggattttaggcggatgtgacatatcctattacaacgaatctggacaggtctgttggagccttaagtttttgttggagcctaagcaagatgggttgagttgtgatccaaattcatttacatatgtataaaggtcaacttcggacggagcgaagtggaggcccgtcgccggtggcttgggccgtcacatagc

SEQ ID NO: 50461 - DNA, 1501 bp, Oryza sativa
attttgggataaattctaagtgctaaaagttattattttttgggacggagggagtagttgttttcccatggtgttgtgccaaggccgagattaatcacttacactgctaagctagtttaagcttcaacgaaatttggataagacgcaaaaaaaaaaatcagctcgttacgtcgtagactattgcaatatactccatccttccctaaatatttgacaccgttgacttttttaaatatgtttgaccgttccttttattcaaaaacttttgtgatatgtgtaaaactatatgtatatataaaagtatatttaacaataaatcaaataatagaaaaaaaattaataattacttaaattttttgaataagacgaacggtcaaacatttttaaaaaagtcaacggcgtcaaacattttaggatggaggtagtagtacatataggtagtcgtgaaaatttggtctttgatagttcccggtgataatgcacgcaaataaaatggagaaggaaaacaaagaaacaatataacaaataaatttgacaaaccattaattccaccacaaaaggctcaattaatttagtctaacccgaagtacgctcccaatatttgtgctctctatttataaagagcaagccgaactgagtcatgacaaaaggacaacgggagtagcttaaagttaacagcttaaaatagatcgcataagcatgtagaatggaattgcttgcggagcagatataaggtctaagaggcatcggaaactctgttgtgccatggttgttttggttactgcttaatgcttatgtttatcataagagccccactacggtgttctctattgatagtagagaataatgtgagccattattcttatttaatcgaatagttcagatctatttatattatcgtctagtttaaggtaatagaaatatggagatgtattattgtaaataaaaaagatgaggaggggtacaatcattatttatctgcgactaaacttttttccttcttatttgttttttcgatggaatatgagtaatgccattgcaatggatgacctacatgacgatctagctgggaaaaaacataaatgataaagttacctctgatcactgtattatgaattactgtcttatccttaacaataaacgggatagtgtcttatccttaacaatgaacgggatagtataatactatcgtagagagcaccataacattgcttttttttaataaatggaagcttatgtttggtaatacgggacggaaggagtacatggccagactacttatagataactccagctgcctccaaccctcctatgctgtccacgtgaggcttaaccggattttggaaagggtttttggacacgaataaaaaaactaatttcataactcgcctggaaaccgcgagacgaatcttttgagcattattaatccgtcattagcacttatggctaatcatagactagtcaggcacaaaagagtcgtctcacgatttcctccctaact

SEQ ID NO: 50462 - DNA, 1501 bp, Oryza sativa
tacaatgaaagacacaacacagtaggtgtgtgtagtgtgaaaaatatttccatggaagagaaaccctaatataatatgttctatttgttgtacagacatcaatacttaagtctaagggctcctttaatttggccaaaaatcatagaaattttgaagaactttaataagagctctatccttttggaaacttttttttaagtctatctatctcatcaaattcttatgtttttttctatgttccaatcaaacagtcatttctatttttttctatatttatatttttctatttctttgtttttttcattcctataattcaaagagcacttaaatgaaactctttccttgtcccatcccaattactaaaaatttccctagatgtagccacaaatccacaatgctcttcccatattgacacagctatgataggctcaaaataaatctaaggtttcatggatctggcggcaccgtgctgtccgctagctcacccaccgcagctcaagaagacctgcattcctcctcccccaaatcacccccatcaaaaatatcctaccagtattctgtattcccccatgcctcccttctcttctgacttgatttgtttattactgacgataatcttgacttctctgcctccaaatccgattctccacacatgcaaaaagaattaagaattgcatattgcatattgcagccttgcacttgcagttgcaaggcagctgctgctactacaccctgtcactcactcacacactctcatccctgcacacacacacacacacacacacacacacacagtggcagtacacactacagtacatgctgcagccagcagctacctatacactcactatcacttttgcaagagtgtactactccatctaataattgcatccttctcctctacatttctgattgatttcttttctccccctttgatttgttgtttgttgcttcttgtgctcctccctccaaagatcaccaccaccaccaccaccaccaaccacccacaccaccttcctttctctcctccctctaatcttctccccctctccccaccaagaaaaatccaggctttgtattagggaccagattaagcagagaaccaccaccttttgcctttttgcagtttgctgttttcacctcctcaaagagaagaagaagacactccaaattcttcaccccccacacaacacacattgtttcttcccaaaaatccaatcttttggttttgggcccaatttgtcctcctcttaaatcccacttttccatcactccattctgtcataaatcctctcctcttcccctctcaaagttccagcttttcccactaagaaaatccaatcttggccactccatttattcgctgagcaaatttccagccttttttgcgcccaattccattgggagatggagaagtagattttagcgcaaaaaaaatcaggtttttttggcacccgattttggttgggagagctcgccggagatccgccatttgaggtaa

SEQ ID NO: 50463 - DNA, 1483 bp, Oryza sativa
ttttctccctcatcaacttacaacaaaattttggagacaaaaaagcgtgcaaaacatagctacaaatgtaatatgacaaaaaaaacattggaggatgaagttgcaaaccttttaggcacctccgatttatatgtaatcaccaaaataaattcactagaaattttggcatgacctcccctcttttttgaagaaattttgaagtttgctcgggcagctggaggaggaagaagacatatatataggggtgggactttagtcccggttgatgttaccaaccggggctaaagatccccgggatctttagtctaccaaccggtactaaagttacgatctttagtcccggttggttgatcccggggggacctgacaggccccgacagcattctttagtcccggttggtgttaccaaccgggactaaagatcaaatatgcccgttaccctttttaaccgagactaaagattatttttagccccggtttttattgcatccgggactattgtggaattcggccgaccgacgaaagatggatttctccaccagtggtagatattcaagtggttttgctcccaaaaatagatacaactaatataaaccagaaaagaaaaggcccccctaatttgggctatttttaacacgaaattagacagaacataaaacactcacccttttgaaatagagaaattttacaatccttgagatatcatgagataccaaaatttagtgtaaaaattgatacctcatagtacctaggtaccaaatttgtaatagaaaaaatggtgtctcatgataactccacaagtactgtaaaattgattttaataaactgctattatgttctcgtgtatgagtatgtctcagtattgatcttacaaattaaagagctaacctatctacatacgacataaagccattgtaattaatacgctaattaaacagccgaccagaactaccgacttaacaccacatggacatcgaagatctacggggcgatgtcccctgttcacagctcttagcttgtaacaaaattaagatctgatgattggctatggccaataccctttgattacttactgctgaaatatacacacatgtggatcttgccttaccgtaactcagcagcagtgtctccagtgggggagagatttgataatttaacactcttttaaattatttttattatttgacatagtcatacacgaatgacatccacacaaatgtcaattaaagcaattgggcaacgaaaaaagtgtcaaattatcaaaattttcccagtgggaaactcaataccacacaattcacactctgctcgtcactctgccaactctgtttttgccgacttgcaacattattttttttgtgcaacgataccgtgagtgtggacaaaaatggacaccagaaagatcaaggaagggcttatctcaacgtttattactcacatgtgtttacaatctgtctcaacatccttgttggtctctgacaga

SEQ ID NO: 50464 - DNA, 1501 bp, Oryza sativa; identical to SEQ ID NO: 23462

SEQ ID NO: 50465 - DNA, 1501 bp, Oryza sativa; identical to SEQ ID NO: 23473

SEQ ID NO: 50466 - DNA, 1393 bp, Oryza sativa
ggtgccgcggccggctgcggcgaggggtacctgttccggcggtggccgcagcactgcatgccgccgccgcagcagcagctgccggcgatcgggcaggcgagcccggtgatgtggtggtgaaattgggaaatcttttcaccccgtgtactctgttgctgtactgtagaaatcagttttcaactgaaatagagatgaatttggatcagattcaagagaattgtttgaattcagtactaggaaaacgtacgatcccaacattctgcgatcccgaagaatccctccgcgtccgccgtggcagctcgccggagctccgccgtggtacggacggcccatttaagttgggccggaacgggattgcccgcagtgttggcctgttgggtttcgattggtcaggtattgggccgtgcagttggtgggccttttgccttcccctctgtagccaccttcgagactccgacccctatgttccacaatgtcaattccgtgttttatattgttatattatataattaactagctggctggcccgcgtaattgcgcggctagcacccaaacaaaatcataatattttttagtatgattttacttaaaatttataaaatagctatctggctatctcattgtcatgagactttgaaattccaaatcttatcatcctcgtgtttataattatgtagtttttaaaagtcacaccagttgctaccccttatgtcatctccttctttatttgcttgctcgatctaccactatttctattcattcttcttgcaacctttaaaaattggattttatagcttttagagtcgttggatttcatttttataatttctagatgtcctgtcaaacgttgccattatactcctctacggcccgtccactatctcttctctttgttgtcattgagattttaaaaatcgaacataattatcgtttgggttcatttttttactttctagaagtctcgccaaaccgtcagcagctttaccatcgtactcctctgcggctcgcccgctgcctcccttttttattgtcattgagattttaaaattgaacatgattatcattgtttttttttactttttagaagttttaaacctttaaaaattggacttgtagttttattttttataatttttagatgtcccatcaaacgatgccactatgcccctctatagcccgtccgccgccaactatttattgtcattgtgattctaaagattgaatataactatcgttggaattcattttttattttctagaagtcccgtcaaccgtcggtggctctgtaactatactcttatacatcccgcccgctgcttctcctttttattgtcattgagattttaaaaaatgaatatgattatcaatgggtttttttttactttctagaagt

SEQ ID NO: 50467 - DNA, 1501 bp, Oryza sativa
tgcatgtgttgatcatcatctttactctggaatatgcatatccagctaacaataatgcatatgcattgcgtacatttgatgcatggctaacacaacgatcgatcgacgccgctcctactcgatcgtttcaccaatgaataattcatgatcagtttggctctttcttccaagccttttaatactatagcatgtagtatgagtaagagctactttctgcaaacccaagctcatggaccatgcgtgtactttatgttgcagtgttgcagctaattactatgtctgtttctctattgattttttaaataaagtttaaacatttgtcttatctaaaatttttgtgtaaatatacaaacatttaagtcatacttaaatacttaaagaacatttaacgataaacacaataaatgataattacataatttttttaataagatgaattgttaaatgtatctaagaagtcaacagcgtcatacattaaaaaagatagagtagttgatatagactagtacttcaaaattgaagtatagcaactacaaaaatccaagctgcattgcattccgcgcattcatccgccgaccgatcgatcgatcagcagtgatgggatgcaacatgggacctcttgcttgatgaacaataatatgatcatcatacgccggtgccactacttcttatcgtatacacactcgtccataaattaataattttcatcagactagtatataccgagttgtatgtatgtgtatgctgcctgattaaaaaggctgtcgtttcggacacaggtcaaactttcaaagttaagcaacaaattaataatatatatttataaatatttggaatattgcacacattcttaaagtcccaagcctccgaggtaggttcatatgctatggacttgatcacttgattagaggaacttcatcccaaatattacatactcaccgttgaattcttctttacaaaattcttatctagattccaagactaggtaagtacatagttaaaataaaatatagtacttcccccgtttcacaatgtaagtcattctaacattttatatatttatattgatgttaatgaatttagacatatataactatttagattcacttttgcttccacccttatgttatgatgcgattaaccaccgcatctacttgagagaggatcaaatacacaagcgtttcattccaaccaaatattccagataacagataacggggggatgagggagtcgaatcattttttgaggtgatctcggtgagagcactcccattagatttgaagtgccggccattgactagacgaagaggaaggaccaatttgatcttgaccaacaactcgtgccatgccaatgcttgtaaaaactgctaccgatcgagcttgatctcatgcctggattgattgaaaccagctaattaaacacgtgcaatataattcagactctttaaccgatccaaatcttggcattgtacatgtaatagtacaaaatatgcatggcaga

SEQ ID NO: 50468 - DNA, 1501 bp, Oryza sativa
tgtacagtgtacagcgtagaattcagagttcagagtctcgtatcctctcactgggtgttaactgaagaatgttctcttgcagtgatagtattagttgttggcatgaacagctaggagtaattaatagagatatgacgagactgcatttctgtttcatccatgcaccgtgtacagcttagaattcagaatttagagttcagagtctcttttcccacaaattttgacaatttgaccctttgcaaaaaactatttttacaaataaaccgccgccaaaacttatttcaaatctgacccttttactcaacgccaaatcgtgtggcgctgaatttagacacctcagcgccaaatagcatggcgctgaatgtacgttggcacgctgacttagtctcccatccgcatggcacggcattcagcgccagctgacgtggcgctgaggtgtctaagttcaacgccacatgatttggcgttgagcaaaagggtcagatttgaaataagttttggcagcggttcatttgtaaaaatagtttttgcagagggtcaaattgtcaaaatttgtgcctcccacaggatgttaaccgaagaatgttctcttgcatatacagtgatattaactgttggaatgaagaattaggagtataattaattaatagagatatgactgagatgttatccactctgacgacaaatcatcaggaatctgtcaaataaagcggccggctatcctgatgaaccctagaagattttcgtcgctggaattgaatctccgggcactttgatcagcaaaacctgatgtgatgccaaaacgagcaccttgtcggctccgcggtttatgcgattggacatcactcacgcttgatagatgagataatgcgtatgctttcattagttgttgtactgcagtacaatttctactcagtcatgatatcattatgaatgaagctttgcattgtccaagttttttttttttgcagataaatgcatttgttaagaccagtgcgaccgatctgaggacaagaattattgcccattgacattgcgaatggtagtgggcaaacataattaaatgtttgttttttacaaaaatatcatacaataattttaattagttcatccttacagctcatgttgcctttttttttgtttttactgtttggcaaaagaattgcacgttactatattagggttttgttgtttatactaaatatgttcatgagtattttagggcctgttcactttgatgccatttttaaccttactaaattttagtaatgttgccaaaaagtagtttgctgcaaatttttggtaactacataacaaatcctgctaaaattttggcaagacaatgtcaaaatttggtaaggttgaaaatggcaacaaagcgaacatgcctttaaacttttcaatagtttacgcttttcgtctttttgttttaaaatatagtaacatagaacacgcaattagacatcagctaccattacaaaagatatattagaacaaagga

SEQ ID NO: 50469 - DNA, 1501 bp, Oryza sativa
gtgatgtttggtccaagtcttggcttccgcttcccttttgaaatgcagttgtgagctcgggatctgtccgcagcccaacatgactgtactcctactctataataaagagacctctgttgctgtgatattctgtcttcctgtgataccagcactgcttcctgggactggtatcgattaacaggttaatttggagcgtcacgggctagttccgctcggggctagttcggggcgtgacacttattatctatttctttgttgcaattcttttgactcttcttgtctaaaaatttaatacattcctcgcaaaaaaagaaacatgatttcaaatgaaaaagatgtatatctctaagatgtatatctcttagcgttctatcacttctatatagccaccatccgagttggtttgaacaattctaaaatttgtatttcaaaatagattgcaccacttataacgcttttctggcatgttaaactcaaacgaaaaagcttcaactatataactacaaatctcatcaacctgccagtttgatataattttttctaatccgatttcctttgagacttgtcaattctgacgcaacaaatgctaattattgacgcatattttttaaaaaagataaggacatacccctccgtcccaaaaaaagttaaattctggctacgaaccctggacacagacagactagtacatgtcctgaactgcttgtgagtctgaacaattgtttttgtttttaggagtacttcttaacttcttgtgtcaggtattctgtccatgcttgcttgaccaatgatatactactgtggtaacaaacgtgaaaaatcccagaccggttttacagtttgaaactgtactggtaccttatttgccactaaaatacccagttcgccctatttttcatcaataaataagcaaaggcacgctgtacgttcaacaggctttctaatgttgaagcaatacatggagtaaaattcagcatagataattaagttcataagactacccatatatgatattgtcttatgcaatatgatcaacattcaacaaatatgcctcgtcgcgtcttggcaacagagcaactttgatcgaccggatcactcgtggggtgtggtaataacgggggagtggattctaaaccctcgaggggatatcccctcgttattttcatgtcatataaatggttataaatttttttaaaaaaaatcaacaagataaattaatatataataaatcactccacaaacatacaagagtattcgcaattaaatttgttttttcgttgcaacttatagaagttaaatttaaccttgtatgtttatggtgtaatttatcacatattaatcattcttgttaaattttttcaatttttttcttaactattttgatgacatgcaaacaacgatgggatgtcccatgcattgagagtttaaaatagttccccgtggtaacagtatgtttaatttgtaccctgaacttgcaccgaaacttcgaatggatggttaa

SEQ ID NO: 50470 - DNA, 1501 bp, Oryza sativa
ctgtttatgcttgtttttgtactgtttatttggtttttattagtctttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatccttagagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacattattgggataacttatgactcattattacttaatgatggtttaaagatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaccttttgtatagcatgattcattgcggagcaccagactgagaagtggcggagataagcccacgggggtcgctggggagtccatgccttgttttataagggggtgattatgatccaggaatggtgcactgtggtgagttgtgttgtacagagggtattgtcacagcctctattcgggtactttctagtatcgcgacgcatggtagacatgatgttaaggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagctgaagccatcgctagaccgttattccgctgctgttttcttttcttttgtaagtgtctaacgttattattatgatggatttgtatattaaactgtcagtttgtgtacctcggctgattcctggacgaggattttatgcacaaataagttcgga

SEQ ID NO: 50471 - DNA, 1501 bp, Oryza sativa
attactttctactccgagtagaaagtaccggagtaggactcctgtaagtatatattgcaagtatagtgtaacgtaaaagtcctaaggtcttatagaaagacaagtcaccacttccatcatctctcacaaaggtttgattatgttgagcaagacgagagattataaccatgtgggctgtgcttataataaaaatggaaacagaagatttaatcagtggtcgtgtatgcgcgttggaatcaagtatcgaaaactttgttgagaagaaggttgaccttgttagtgaaccgaaagtgggtctttcattcgactctctacaggaagcgtacgatctctacaatttgcattcctaggaggttggttttggcatcaagtatctaaagtagtgatccaacaaaatagatataagtatgtaaagtctaattttgatagtacattgcactactatagattttttagaccattaaagacaagttattcttcaaagatcagaactgttcgcaataagaaatgcatcttcaatggttgccatggattttgttaatgagtaatccctccgtcccaaaatatacgtattttggacttcgacccagtcttcgagatgctaatttaacaaataatatctataaaattaagatgttttaaataaaaaagttgcatattatgatagtttgtttaatgataaatctagtaacatcaattttacatgattgatctttttctttttgctattcatttttttgctatcatagttaaaattaaaaatgtttgacataactatgctaaattttataatttttttgggacataaggagtaataactattggtgagaaaaagtatgctggtgtgcatcgttgcaggtatggaagaagtgtaaagtatggtgggacagataaatcagtccaggatctgccatgtgcttgtgcggtcagtaaaatatacttaaaattgattgatgctttgaaattactatgttttcgacaagtgatatgcaccagtcgatgacaggtatgcaccaatcttatgtagggtaacatcgaaaacagattgcaaggctcttattaggctgtaccagtgtaccgtcggcaggacaatggatggtacattagcgaaaacagatcatagcataaccatccgttgtcagaaacatgtggtgagagcaagcactggagctcccataagcacatagacatacacaccaaagagctcgtgagacatctcagaagcattaataatgtgaacctgtcaaaggtgtactgcataactgcaagtttttttgtttcaatgcgtgacgttccattcactaagagatctctgaagactctttgcgatcaaatatatatcaaaggaacaatcaaatgatatgatgtgcaagaaaacattagagttgttccagaagttgaagaaagaggaccctgacttgaagtacactcttgaagcggatagtgatagcaggattcaattgattggcgattagctttaactgccaatgcccgcaggacc

SEQ ID NO: 50472 - DNA, 473 bp, Oryza sativa
gatccaacggtagtttctaagtttccactatatatatggtttgcactacatattttccccggttttccgatcaagttcaaaaatgatcaaattgaattttaaatttttgacaagatttgtttggatctccttggattttgttggcttatcgacggtttccatgaaatctgaagatatagttcatgagcggtttttcatccgatattggatcaattgtgaaccgtagtcaatctggtcatttgaaatcaaatccggagacccaaattgatgtcaatctaggccatttgaaacatttcgacctaaaggcctcgagtggctggcccaccttcaaatttagatgtagtaaccaataatgcacataaacgcctataaaaatgtgaacacgtacatacgatgagtccgtctggttttccacttcccaatggcatcaatcttaacgacaatgcctccttccatcccctctttttcttaga

SEQ ID NO: 50473 - DNA, 1501 bp, Oryza sativa
ctcatttgcaaaagcagcatttagcaaaacatttaagagaagtaaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccttaacatcatgtctaccatgcgtcgcgatactagaaagtacccgaatagaggctgtgacaataccctctgtacaacacaactcaccacagtgcaccattcctggatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatctttaaaccatcattaagtaataatgagtcataagttatcccaataatgtgctaatgtttctaagcatggctaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctctaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtacaaaaacaagcataaacagtacatgtggatatttttaacatgtagatctcgattttagatgaatttagcaacttgaaccactcaaaacagagttacgatgatttagttatgaatttttaaagattaaaccggattaaagcatttatatggattttaattgaattatgacgcaataatgaattacttttgaaaaggaaaaggaggattattgcgtcatcaaaggcagtccgggtgcatgggacggtctaaggaaacgaacggccgagatcgattctatccaaaacgggcggccgggatcaacttgatctaccgcggttcacgggacaaggcgacgatgacgtcagcgg

SEQ ID NO: 50474 - DNA, 1501 bp, Oryza sativa
tgattaaatcttctgtttccatttttattataagcacagcccacatggttataatctctcgtcttgctcaacataatcaaacctttgtgagagatgatggaagtggtgacttgtctttctataagaccttaggacttttacgttacactatacttgcaatatatacttacaggagtcctactccggtactttctactcggagtagaaagtaatctaggcccttgatcatatttaattgtagggttaagatctagttctactcctaccagaattagtggaagtagaaatgtggaggggtgtttttgtccaggaaaaataattcgcgaaggggtattattgttttccgatccatagatcgatcaccatgtcatcctcgtcggagttggtcgtgcaagatcttaatcgatccatgtaatccatgaaacaacacagtgatcagaaacggcaagaagacgaatgagccgagacgacgccgccaagcaaatgacattgcgtgcgtgcgtgacgctgccgccgaagcccaggccagaatttttaccaccgccagaactcctgctcaagattgtcgctcgctcggacgccaccacactcgtccgctcccagacggacgatgcgactgaggaagcagacaaggcggcgacggcggggaatacggatggcgacggagggggtggacaaggcggcgaggccgggggaggaatagcgaggtgactgcgtgcaacggagttcggacctgatacgatgcgaacagaagaaaacatcccatgccaaaattacctctaaacgatattaggagattacttacctgccctttaaaataaacggtcaagattaattctacttggagtagaatactgcaagtagattgcaccggagcattactctacttacagtataaacaatctaacagtgtgaatttatctgatcttctttttaccgtataaattgtgaagggtatatttgtttttccatatttttgcggaggatatttttgtattttcgcgttttattctttagtcagatccggatagtgagaaagggactcgtcccatactcccatgcgctaccaccgctgccgacagccaccgcgtcgcgccgccacactcgaacgctgtcatgtatggggagagaggaaggggaagcagcacagagcgcactggagcagcaacatcagctccgcagttgttgtgtctctctgatatagttgaacgagtgtgggtgattcttcagagttcaggctagtgtgcaagatggaggcagatgtgtgtcgttactggcttactgcatctgaacttatgtactgaatactgtaaagaaaaatgtaaaaaatgtaaaaatgtactgaatactgtttcgattggaaggaatcgctctgcctccacgctcgctcgtccgtcaacaatcgatccgccgccacgcgcaatgtattccgaagaatcactgctgctctagcccaatgtgctacgagatccagaacaaataccaactaaacaaccctttc

SEQ ID NO: 50475 - DNA, 1501 bp, Oryza sativa
ttccaattgttacaagaaaaaactgacattggatagttcttatctctttttagattacacggcagacgcgcgcgcacacacacccacaaatgggtcacctaacatatgctctaagagacgaaaacctatagcacatccttgatcttactaaatttatgttgaatgcacacctatatgtgcgtaatattcgtggacaacatgatttaaaccctagtgggtggagttttctatgaattaatctaaccaaccaaatttgatgtgtttaaaagcaaaatctgcattacagcatgtacatacatatatgcatatccctacaaaagcaaattaaacttgcggatagaacatggatgcatataacctgatgatcatgttgcagactgacaaggcctccattgttggggaggccattggctacatcaagacgttggaggacgtcgtccagaagctggagaccatcaagacggagcgcgtgcgcgcgcaccagtgggcggcggcggcggcagccgccgtggcagccaacggcggcggcgaggggtcctctcactctcactctcagccgccgcgccacgccaccgccgtcacagtcgccgtcgccgagcctgcgccggtggcggcggcggtgaacgcgcaggcgccgcagaagaaggcggcggcggcggcggcgccgacgctgcagacgtggtcggcgccgaacatcacgctgacgatggccggcgtggacgcgttcatcaacatgtgcctcccgcggcagagggcgtccttcaccacggtggcgttcgtcctggagaagcaccagatcgacgtcgtcacctccaccatctccgccgaccatgacaagagcttgttcagcgtccatgtccgcgtaagtgccattagctcaccgacgataatctcttccaaaatatactccccccgtttcacaatgtaagtcattctagcatttcgcacattcatattgatgttaatgaatttagacatatatatttatctagattcattaacatcgagataaatgtggaaaatattagaatgacttacattgtgaaacggaggaagtagttaacttctggctactttttagacaagcatttgtccagatgcatagtcagaacagaagttgttatagtttaggatggatgcagcatttgttcggatacatagatataataatataagttatatgtaatgtgagtaatttgttcattttgcttgtgtggttaagcagctcaacgaagcatcccttcagagcacagagggtctgacgcctgaagccaaatacaagctcgcagtgtcagagttgatggtcaggctcgccgaatgagacgaatttgatcgtcctgaatttgctgtcccccttgctactctcatcgaggattcgtactctcagcatttggaataactaaaaccagtctttgctttcagtttagtcgttgaacttgttactttttggataattcggttaaagtttccgaacataagtacaccaccaggaggtaaaagt

SEQ ID NO: 50476 - DNA, 1501 bp, Oryza sativa
cgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagggtcttgtaacaaacgagccaacaaactagtggtaaaagctacatgttgcatgcatatataaatcataccacacaactcttctctgatgatccatcttgtttctgatcaccttgttcagggagcagcagcaagaagccaagaacatggcttgcaaggtgagaggggacatgggcaagctcatcccggtgatctccttcttcctcggcgcggcgctgacggcggcgttcgtcattgctactatggatatcaactggaggctctccgccctggcctcctggaacaacaatgattctccaccggccgtcaccgacgaggtcagtgatctaccgatgctgctttctgcgttttctgcttaacaatctgaagttctgaacatgagatgagaacatcttcagtgcagtttccttgagtaatgccgaattatacttttacataataaaaaaagggtttttataccttttttttcatttcaattttcttgttcttattgtcttgcaagatgcttcaaaattctaatagataatggccgtgcaattaattgggactgtttcatttcgttgcaaatagttggaagttgcaactatgcataatagacgggtattagtggtcaggtagtctactggtctccctttctatcgtcctagattattcctctatctacatcttcattcagtgagctgataagtctctaagacgcaacgacaagcaaatccatatccaatataatgctgcagatatcttccacagcattagccaagtctagaatttcctttttttttaaaagccaatcatcaacaagccaaagtgccaattctacttttccaacattagcctgagataagcttcctgtagctttgtcacatccacagagcccaaaagcttaaagctgaaactgactactgatgaggtaacgaatatgctaacctgttgtccaagcagccttgtggggataggatatattacatcatttacaactcagccaaatgattcgagtgaactttctatgaaattttacagctcgacttgctactaactttcagttcagattcttaaacaaaacaacgagatagatcttcacatttgcaacatccaatggaaagacttgctactaactttcagttcagattcttagacaaaacaacaagatcttcacatttgcaacatccaatggaaagatttgctactaactttcagttcagattcttaaaacaacaagatcgatcttcaaatttgaaacatctaatggaaaaaggctgaaaaaagataataataatgattgcagatgaaagcattgtcaga

SEQ ID NO: 50477 - DNA, 1501 bp, Oryza sativa
agcagcgaccccggcgccgcgtacgcccggttgatcgacgtcatgatcaccgtcctgtcgtccatcgacgcgttcctcagcacctcggtcaattctgacaatgctttcatctgcaatcattattattatcttttttcagcctttttccattagatgtttcaaatttgaagatcgatcttgttgttttaagaatctgaactgaaagttagtagcaaatctttccattggatgttgcaaatgtgaagatcttgttgttttgtctaagaatctgaactgaaagttagtagcaagtctttccattggatgttgcaaatgtgaagatctatctcgttgttttgtttaagaatctgaactgaaagttagtagcaagtcgagctgtaaaatttcatagaaagttcactcgaatcatttggctgagttgtaaatgatgtaatatatcctatccccacaaggctgcttggacaacaggttagcatattcgttacctcatcagtagtcagtttcagctttaagcttttgggctctgtggatgtgacaaagctacaggaagcttatctcaggctaatgttggaaaagtagaattggcactttggcttgttgatgattggcttttaaaaaaaaaggaaattctagacttggctaatgctgtggaagatatctgcagcattatattggatatggatttgcttgtcgttgcgtcttagagacttatcagctcactgaatgaagatgtagatagaggaataatctaggacgatagaaagggagaccagtagactacctgaccactaatacccgtctattatgcatagttgcaacttccaactatttgcaacgaaatgaaacagtcccaattaattgcacggccattatctattagaattttgaagcatcttgcaagacaataagaacaagaaaattgaaatgaaaaaaaaggtataaaaaccctttttttattatgtaaaagtataattcggcattactcaaggaaactgcactgaagatgttctcatctcatgttcagaacttcagattgttaagcagaaaacgcagaaagcagcatcggtagatcactgacctcgtcggtgacggccggtggagaatcattgttgttccaggaggccagggcggagagcctccagttgatatccatagtagcaatgacgaacgccgccgtcagcgccgcgccgaggaagaaggagatcaccgggatgagcttgcccatgtcccctctcaccttgcaagccatgttcttggcttcttgctgctgctccctgaacaaggtgatcagaaacaagatggatcatcagagaagagttgtgtggtatgatttatatatgcatgcaacatgtagcttttaccactagtttgttggctcgtttgttacaagaccctgatgaatcccctaatgattttggtaaaaatcattaagttaaggtggatacacatcttgtcatatgatcaaatggtttcgcgaaaaatcaataatcagacaacaaga

SEQ ID NO: 50478 - DNA, 507 bp, Oryza sativa
cggctcgcgcgcccgatcgattcggcgccctcctcgcgtcttcccggtgagatttcccctccatttctccccccaaatccccctgttcgtcgccgacgcggggttgatcgctctgttttttgttgttgttggttgtggttagggtggtggtggtggtggtggtggtagtgagggtaagggttcgggttggggttttgcttggtgctggaatccgccgcgttcgtggttcctcgccggaatttccgtggtttccccgcttgtggagctctcgtggtttgccctagcctgagtacgggttcgtgcgtggcgtggtttgttgttggagttggattttggtcgtccctcgcctaacggcggccaacctgtttgatgatttgcttgttccgtttagccttgttgtttcatgcttggtttgtgctgtttttttcgtatggctttgtttgattcgatggggattttatggattaactcgattctttcttgttgttcttgcgtccccaggcgtga

SEQ ID NO: 50479 - DNA, 370 bp, Oryza sativa
gattattctgcactatctgagtcctcatttatccttgcaatttttgtgcctcagtccctttgggatccccattcaatgtagtgaaagaaaattatcgcaacttcaattgtgttgttgggaattccttttcgctcaaccagcacaggccacaactctaagcattgaatttttcttgttgtttagtacatggattacttcacacatcccatggatttggtacatttgcacataagttgtatttgttggatgttgttgcatggatcatctgcacctatcattggctcattcctgaaagtgtgtcttttagtatttcaatatcttaattttactggcatatttcttcccggagaattgatattaaatgcactgc

SEQ ID NO: 50480 - DNA, 960 bp, Oryza sativa
atgcgggcgtcaaaaaggcggtaacaaaccaaccaaccaagtaactaacccgtcaagattctttcaccggtgacggtggggcccacgtgacaggcagccaaaagagagagagagagagagagagagagagagagagagagagagagagagaagggaggatcctttgctccggccgatttggtgaggtagcctgtgtgactgtgtcctgctttgtgttttgtctcgtgattttgcattcttcgtatctaaaaacaaaatagggcaaccaaataattagaagaatttatgagcctgtttggggagtttaaaattctgagaagtaattggttgataaccagcttctgagaatctgaaaaacctgggttttctggcttatgacttttagtttattttatggattctacgattataatttcttagaatttagactaaaaattgggctgtttaagggagcttctgattctagaagaaattgctccagctagaagcttccctatagtcacacgtttgccacctcactttcactatcaagtgcgtctcacattgtttgtatttggaaatcatacgcatacaaaaatttgaaaaaactgatgtggtatattataactgaatcttgattttcaaccaaccattaattgaattcaatggttaaattattttttaccaagattttaataaagattcttttaaaagtgcattatgacattactctttcgcaaccattaatgaccaaaaagggttaacttcggataaaatttgtcaaccttttagtttaaatttgaccggttcgagtggtttctaaatttgcaagtgcaataattgagcggttatcgtcgcatttgtgaaccctgctcgccatccgggccgttggatatcaaacagccaacgatcgagggccgtcggatcggggccctacaaagcgtgcatcagatcactctccatgtgattggggaggaaaca

SEQ ID NO: 50481 - DNA, 1027 bp, Oryza sativa
atacacataatttgttgacttgaccaccctaaactctctctgcaaggaaactgcccaatgcttcaccgcctccttcatctcatccttataagcataccttgcaccgtcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatggaactaaaactaaaacgcaacatatatac

SEQ ID NO: 50482 - DNA, 1501 bp, Oryza sativa
gagggactccgccttgaacaccggtgagcgagtggcgagcacagcccggtgcacgtggaacgtctcgacggaaagcttctggtttttctttcaaggagtaagggcaaaagctctgccgaaggatttcattaagaagggaaaggcctaaggttcacatcatacagattacaaggatcaaaagatcccagacaaaaggcttctggctattttttggtagtcaagtttgtactcgatgaaaccggaggccagcatgttgccggcttgccgccggcgaaggatgaactttctcgagagagaatttttttacccacagcaatgtgaagaagatcgatggtgaggaagcgacggtagttgctgccgataccgctggcggtttaggcggcccatgaagtgcgcagacctagtcaaggcccaagttactccagtctaaagaagtctaaccgcaattcccaagccaaccaaactattcgcaaaataacttttttctttttaaatctagggcctgaacgtttgcttttggagtggttctccagtgctgggaagttatatggttcgttaatcaactaaaatctaatggtccacggagaaaggtatcttccaaaaggtagtaaaaagtgggccaaggtacttaattgatagattgggtggaaggataaataagtaattatcttaattttacagcgataagactactgagagagagtaattcaatcatgagtggcgtgatcgggaattttttttatttttaattttttttattaaaagttttacaaaaataattttccattttgaaaattgacggaagtagtcgcctaccgccctctgggagggtgatttttaaaaatcgtcatcccagagggcagcgaaaatgacgtggcagacggccgttcgctctcgggcgacggccgtcaacgaaatttgcaggcggcccccttgccgccctccgctagggcgattttgtactgtgcggggggccgcctgcaaatgggcggcgagggggcatggaattttgcaggcggcccccttgccgccctgggggaaggcgatttttgcctcccccctataaagcccagtcccccctctctgaaatttcattatattcactaaaaatccaaaaaaaacgaaaaagagagaggggagggcacagaagggaacggcgaagccctgctggttcgctcacttcatcacaggtttgctcccatacatcttttgcatttgtactaatatgttatgtttgagtatatatgttgcgttttagttttagttccatatattttagcatatctgtagcacacagcacatatgtgtagatccagagcatagaatataatagtatgaattgagacatagacagtagtgttaattgtaagatgtagtttagtttgatctggagaatgtaacctacttttagaattttggagaacaatattgtagagaatgtaacttagggcgtagtacagaaatgcgaggttaacgcagttattgttttcatcaggcacaa

SEQ ID NO: 50483 - DNA, 1501 bp, Oryza sativa
taagtgtttaatgcaggcttcaaggaaaggttgttgtttttgcaattgattttatttgaactcttttctaaaaacaactaagtgagtgcttctcaaacgacacggatgagacagtgcgtctcgtccggtcggagtatgtgcaatgtatcaatctttaaaatagatcaagattggcacccggccaacagctttcaaacggccacccgggccaacaactttcaaacggccacccgggcctagctgatcccatcagctgcagattttccaaacatcgatctcctttccaccacagcaatttcacaaacagtaggcaaacaaaactacgctaggaatcacctcacatccgcccatgaccgtgggcacggctgttcgaacagttagttaacctctgcagaaggggtacactttacccacacgacattactaacccggatcacccagcccgtggggatcggccacgttgggagacctccaagctttcatgacaaggcatttcgaaagccgacacaggtttaccatatgccgacgagaggggtcccagaccaacaacaagttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagagggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcaactagatggttacaaggggacatgatataacaattaacaaaggaaggatcaaatgcaacgaattaggtaggtctgccaatctgccttgcagacgggacaacagattaagtgcgatcctatcaatgcataatatttttcaagcaacataattaaattcaaatataggctcaagatgttcaaaggtggcttgccttgctcgagatctggagcttgatccttgaaatcctcgcactgctggtcttcgggctccgaaactatacgcaaaacgggacaactcaacaaacggcgaaaataaagccctattaatgacctctaagcatgccattagatagatctcgagatttgaggaattttggaagttgaacggagtcaaacggatttacggttgggaagatattgaatttctaagattattggatttttggtctaaaggaaaaggatttaattaaatcctttttgaaaaagaaaagaaaagaaaagaaaagagggagggaaattagacttccctcgggtggctagggcgcggcccgagagaaaaggggcggctcggccgagcttaa

SEQ ID NO: 50484 - DNA, 1501 bp, Oryza sativa
tataatgttgcagtgaattgaaacattcttttacaacaaatcacccacatattttggaaaccctctattaagataattcgtttttttttgttccaccaaaaatgtttcacctagtgtactcacaatgttttactatatatagatctaaggttgtagtgaacagaaacattctttttgctatttgctgaaacattgtttttatataagatgaaacaacgcccgatttaaacgattgaaacattttcgatctacttagtgaaacaattccaatatacttggtggaatatcgtgcaacatttaaaaataattcaataattaataagctaaaaaaatttcgtcggaatatatccatgtgtggtcttgttttaaagatttaattgcaacaaatttaatggtgcaatcggatcatgatttggataaataatttaagagaaaaaatagtttaaagtgatttgcacgaatgcgtcttgctgacgtcagcgcctgatttttcccccctccccatcgggcgcccgattctaagtcgtgtcctattgtatttgatggccgcaattttaatttcccttaactgctccctctatttcatgtaataactggtaatttttgttttggaattgtttggtttgactaccgctataaacatatgttagaatgaaccttttcactagcttgtttacaagactacaagaggtagccaaggacttgcaacatgtcaaattgtccatgttagcttaggaacaagtggactgcatgctaggtgactcttatacatgtggaaatttctctcgcaaactaattaagaatgttagccgaagaaataaaaaagaacctatatgatatatagcatgcatttccattgcgagaatttgtgataatatccaggcgtgggaggtgttgggaacttcgcggcctcatccaatcccaattctcgcaacccgggaaacggggaaagcattctgctactttccctctctgaccaggcaaacccgacagtgttggtggcacatatgactaaacgctcatatgtctatgtaattgcagtgttggtcatgttaactctgtttgccttcaatcgtatgtgttctacaacccgagtgacatccagattaggagggatccaaatgatgatgtgctttttagttttagtttaagcgtttgatctcgtttcattgctttttttaatttgtcagttgcatgcgttgtagcagtgttacgactgcttctacatgcaatggttaatttggttgtaacatgtgttttgcagtggcacatataaacctttgagaaaagtttctttcttttgcaggcataattttacctgaaaaaaaattactacttgatgaaacacaatccaaagtgaacagaaccacggcatttgaatattactcgcaataaatggcgaaaaccatgaattcaaccatattaaaggcggtacaagagtgctatatcgtggaagttgtaaactactccctccagtttcatatttcctatgatgtgacca

SEQ ID NO: 50485 - DNA, 1501 bp, Oryza sativa
gccgcaattcaccgccgtcaagcttcctccggcgaatccgagccgttggctcgtctcccctcgtctcgtgcaaccacccggtgtgctcgctttcgcctgttccggccggcatcgtcgtctacctcccgccggcccgcgtggcagccacgtaggcgccacgtcggcgccagctcggccaagaccgggtcgagccgaccccggtcagccactccctccggccccgctcgcgggcgcgatccaccgcgagccgtgaggctgcgcgtgggcccgccgcatccgcgtcctccgcgaaccgcgcgcgtgcaccgcgtctcttccccaaaccctagcgcacgccgcatactccctccgcatggtgagccgagccgctgacaagcgggtcccacccgggaccacgcgaggtgagcccggtccaccggctccctctctcctcccctcccacgcgcgctctgggccgccttttgggccggccggcccattaagctcggccgagccgccccttttctctcgggccgcgccctagccacccgagggaagtctaatttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcatgcttagaggtcattaatagggctttattttcgccgtttgttgagttgtcccgttttgcgtatagtttcggagcccgaagaccagcagtgcgaggatttcaaggatcaagctccagatctcgagcaaggcaagccacctttgaacatcttgagcctatatttgaatttaattatgttgcttgaaaaatattatgcattgataggatcgcacttaatctgttgtcccgtctgcaaggcagattggcagacctacctaattcgttgcatttgatccttcctttgttaattgttatatcatgtccccttgtaaccatctagttgcgtctcgatattcgtgcaccctgtgcgagtatcgacggacgccttcaaacttaaaatctgaaaaacaacttgggtaaaacttgggttttacaaaagacttggaaaacccgacacctgggtcggtgcttgcgaactaaatgaatttccaaaaccgcggaccggggaacgtaccgggtgtacggtttccctctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacttgttgttggtctgggacccctctcgtcggcatatggtaaacctgtgtcggctttcgaaatgccttgtcatgaa

SEQ ID NO: 50486 - DNA, 1501 bp, Oryza sativa
atggggaaccaaaccaaaccgacgaagtgatcttcggaacaggtttacacacgagattgctcatcagctttaacataagattccaaagtttaatttggtacagattggtttaatacttatacaagagtagcaatccaagagtgttctgacgatgattggtttaatacttcatgacgtgttgttccctgctcaagaaatggtcatcactattttgatgctcttctcaaaccattttgacattttgctgtcttgataaatgttcattaattatgtcacgttgccgtagtaggtatatactctgattaagaaacccaattaatatgcttttgttcaatcgactgagccagtatagcaagagaaggggaaataagaacaatctctagcatcttttgtggaacttttactacaaaacagcatgcttgtaactcactagctagtacataaccggcaatcactaccaggcaccagctcatcagtagtgatttggattgaactggcaatcaatgagtatttgtaccagttcataccgtataggaagttttcccatccaaacttgtgtgaaccagagtatcactgtccgttcattgcccactggctgttcgaaaactggcagtacgtaatgctggttatgagccagcactactacagatccgggcttcagtgacgggtcatctgtgacgggccaacgcaactcgtcaaagatgagtcatctctgacgggccgaaaaaatatcctcttcaatatatggctaccagggaggacccgtcacagatgtgaagtcatatgtgacggcttgcacttgtaacccgtcacagatcgtctgtgacggatcacaaccatggctcgtcacaaatgacatgtcatctgtgacgggtgtagtattatgaaccatcacaaaagagaccactcatctctaacgggtctttaactaacacacgtcacagataacgttatctctgacgggtggtagttatgacccgtcagtgatgagtgaaaattcaaatttttaaattttgcaaaaaaacctcggattgaaacatgtcttatataaaagttgtagctctcaatgatatccacaactttataactaacaacatttctattagagatcgtttacatccccgaacatgcattacaagtgatcagatctacttttaaaaacaaaattttgagttttttttcaaatgacatggatggatacatgccccgtatcaaagtcatagaactcaatcagatctacaacattataattgaaaatattttcatttcacaaaatttacatgtttataaagtgagatatattttgaaaaatgaaattttgaattcttcaaacaacatcggatgaagatattttctatgtaaaagttataaaacacgatgagatctataactatttagttgataatattttcatttgaagtcatttagggtgttaaatatatgttaaatgattcagacaagcatagacaaaataataacattgggttagtagtcaatatgt

SEQ ID NO: 50487 - DNA, 371 bp, Oryza sativa
ccccccccccccgccaccaaattgagcagctgaaacaggatgctcacatcatggttcttggaccgtgtccatgcacatctcacattacagcaaaaggcttctttcaccttgatttcctctggattctgtcatctcgctttcggttgcccatgagtccgggataaataaacgaactgaatcttgacaaaatggttgatcaagatgttgtctccactaatcttgatcgccatactaagtcttccctggttggaaatcaagcagcaggcgccgaccaacattaaagcgcaattaaggttgcctccaagagcaaggcaaaataatttcttcactcgaaaagcatcactcgcttcctttgcaagcagagtctcaca

SEQ ID NO: 50488 - DNA, 1501 bp, Oryza sativa
tagtgcgtactaggcgtcagctttcctttttcttcttcttcagtcgccatcgccgtgatcaaaattttcagatcactcgatgtctcatcgctcttgacagtgtcagtgaagaacattgtttagaagtttttttttgtcacatcggatgtttgaccggatgtagtaaggggttttcggacatgaatgaaaaaactaatttcatatctcgcctgggaaccgcgagacgaatcttttgagcctaattaatatatcattagtatatgtgggttactttagcacttatgactaatcatagactaattaggcttaaaagattcgtcaagctattcctcctccaactctgcaattagttttttttaaaaaaatctatatttaaagttttatgtatgtatccaaagattcgatgtgatgtttttggaaaaaaaaatttaggaactaaaccaggccatagtagatgtgttcagcttctggcctttgagctggctacctgtgaagactgagtatgacgttgcggtgatatgagggtgatgctgcaagcacgattgatcgatgatggcccctgccaattattgagcgatgattaattcgtacagtgcactaagtgtcagtcagtctgaataattttcgtctgttctagtgaggctccaaaacgtgttattttggtcgattcagacgcgtcggacaggcagagtgggtgagcatgataattcactacttctagtgcttgacaagacactgaatgctgattcgtttcggtttggataagcaaccatttttgcattctttccgtgccaaaagaacaccgaaaaaagaggatagaacagttggagcagaagcaagttcagcagcaacaaacagtcttacagcaagccgggatcgagccaacgcatttgataacgagattaattgagtttgcttatcaacgaatgaacggcccgaccgaactctgaagaactcaatccagtttaggacagccaaacactctactgaaccagctgtctgagctagctaggtaggccaaaagcaaagatgaacatcactatggcctttgtttagtttggaaaatgaaaatttttaggtattacatcggatgtttgattagatgttggaaggggttttcggacacgaatgaaaaaactattttcataactcatctggaaatcgcgagacgaattttttgagcaaaattaatccgttattagtacatgtgggttactgcagtacttatggctaatcatggactaattaggctcaaaagattcgtctcacgatttttatacaaactgtgtaattagttttttattttatatatatttaatgctctatgcatgtgtctaaagattcgatgtgatgttctgtgaaaaaaattttagaaactaaagaatgcctatattagcaaagagaaaagagattttacaactactaacctaccctattgacgcagatcatagggccgggttacagcaattctagcattctggaaccagcccaactgtaatcc

SEQ ID NO: 50489 - DNA, 1501 bp, Oryza sativa
caacccaatatttactgctcgtattgtggcggcagctgaggcggtgaggcctaggcatatagccgccacctagctcatatgcttgattgaattgaatttttttagaactgattaaatttattttatccttgctttctgcatctccactcaagcgaagctctgaagtttgaatgagtagcatgatattgaacctatcaatttgatatgggcttttcttattgaataatctagagtgttgtaggcctgtgatcttgtgtgggcttctagtgttctagccatggaaatcacgtaagcaggtagttttcgtacgaatttcgtacagatttcttcgtgtgtatagcagggtgtcggtgacatgggaccgggagtatcatgactagaggcttgaggcagacacaatcgcccacgtggcctggcaccctcggggggcgtcgggcccgagggtgatgtgttcgcccttctctttgtctccccgaggggtcggaccgctcccgtctcggccccgagggccgaggcgccccgaccccttgtgggttttgtgccgtgtatatggggtaggtgagcatagcggggctcacctaaccacatttattgtggtttggacgagcgcgtcacgccgcatgtatcgcagtgcagcacgctcgtttatccggtcagtgaccagtcatagaccgatcagatcgtgggttaggtggcgacaggcggtctgacgcacgcctcgccccatcccgtcaggatgagagcctccaagcactcgtccctagccggagccggcgtgttagctcttggagatggcacgttggtcccggtcagatatataccaggcttcatcctaaccattacaagcaagacattgtatgaagaggggcgaacatgcagattgataaactgacgcatggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaatagataggataagtccccacaaaaaagagagagatggtgcatgtggtatccccttgaggtataaaaggaggaccttgcccacttagaaggaaaattttttcggatcccagaacgatcgggggctggctcgcactttgtagcttcttcatacacagatccaccaaaacacaggagtagggtattacgcttctcagcggcccgaacctgtatacatcgcccgtgtcttgtgtttccactctcgcgaactttccacagaccaggagcttagaatctcacccagggcccccggccgaaccggcaaaggggggcctgcacggtctcccggtgaggagccccacactctgtcatctggcgcgccaggtagggggttctgcgtgtgttcttctaagctctcgcactctttcgtgtgcgccaagcttttcctgttcagcccaa

SEQ ID NO: 50490 - DNA, 1501 bp, Oryza sativa
tgctcgccatggctgacaggtacgcgctcgacaggcttaagctcatgtgtggccagaggctgttgcacagcatgacgtcggattcagtcgccggaatcttggcttgcgccgagacatacgattgcccggagctgaagaacaagtgcatcgacttctttgccgtcgaggagaatttcaggagagccgtgttcaccgatggttttgcgatgctggtgcagaaattcccgctcatagctgctgagctgaagaagaggattgtgaaaccgtagctgcatatatatcttttagtcctctatcgcgttcactgcacttgtgttatgttttttttttctaagttatgtctggctttgaacttgtttttttttatcatgtttaattatattgggggtgttatatgtactagctgaatgctcttgcttttcatcagaatttgtccaactacttcatcagctgatcttggggtttgttggaagcttcatgcatttctttggttccaaatataccaccaggcgcctggaatcgaccatattatcaattgggtatttttatcattcttaagatacttagagatgctatatattctagggagacgactccgtgtcggacgtccgatattccaccaaatatcggacgcccgactgtttacgcgtcatcacaccacctacgtatgcaatatgcaaaaaaaaaaaaagaatcagtcagtcaaatgttccaattaactaacgagtgaaatatcaagttatatagggttaaaaaaaatcagcaactgaaacatttaaaaagtttatgaaacatggtgaagatacacgttaaaacatatcgctatcacatatgaaacaaccaatgttaatggattgaaatatatgtttttctttcatcaaaatataattatgcgatatcctgttgtaaagatttaattacaaagaatacaacggtgtgatcggatcgtagattggataattaatttaagagaaaaatcgttttgaaactagctaaaatgcatgcatgtggagagagaggagagacgctgaagacacatattgaaacatgtatctatcacgtatgaaacaaaaagtgttaatggattgaaacatatgattattttttatcggaatataatcatgcgacattttgttgtaaagatttaattacaacgaatacaacggtgtgatcagattatagattagatgagtaatttaagagaaaaatcgttttaaatatcgttaaaggtgcatgttatatggttggaggtagagatataggcttggatatgtgtatgtgtgtcagaggctgcctgtccgatttttgtcattgcttcgaacgttcgatgagaagcattttctattttctagtgtaaaatttgatacctctagatactataataagtttcttaaggtaccaaaaattatagtgcaaaatttaggtatctcaagtattttctaaaggactgcaaaattcatcttatcatgttcatgtgccgggcatgtatccgaatccaata

SEQ ID NO: 50491 - DNA, 1501 bp, Oryza sativa
tcccttatatatggatgtgtttagatccaaagtttggatccaaacttcagtccttttccatcacatcaacctgtcatacacacccaacttttcagtcacatcatctccaatttcaaccaaaattcaaactttggatccaactaaacacaacctatatctttttgtccaccagagtttggtctgcaagtcctgtctatgattctgctgcagttgtatcataaattattatgtattctagttaatgcagacgccggggaccagggagttatactttcattatatatctatctatatatatagatgaacatacaatgggatcatgatggtaaggtcatatcaacaattgttgatgttgtctctgcctagggaatggcataccaatacaatggaatactctacatcatattggtaatcttggaactagagacatcggaaattttcagcggtgtggactactctctccaagccagaaaaaaaagaagatcgaggcaaatgtcaccaccgtgcagaatcatactggactcctctggcttaaactagaacagatccaacttgttagacttttgcatgtatttggggtgtaggaaatagttaaaggaaaggtccagattcccccccccccaaaaaaaaaaaactttaaattaaagtttatctagcaccctaaactttgaaaccgaatattcaatcccctcaatttgacaataccatttatagaaccacctaaggtggttttgcatagttatttttatctaattgttatataagttggatgagtctgaccacttgacatagacattagacatatatattaaatcactacttaaattgttattttttacctattattaactttcacttactaatagcgcggtacaaacataataatagtatggtatcgatgtataaggataaattgatgacttacaactgatgatatacatgcgagatacggcatttaatcggttgtagctgtaagatcaacgtgtgttttgattctaattctgtgatgaacaattggtacctgtgattatcggttttgatatttggagattatcgtcgaagtggttttggagataatcaatttccaggagatgaacagggtttactggtttgtcgggaccggtcagatcgggcggtggttgccggtcagaccggcgctatgtgagcggtcagaccggcttgcccgcggtctgactggccgacgctgtgtcggtttcggtttcgtgttgtttatttggatatccatgattgtttcatggttatggcttctagatggatactatacgtatgtaatactgttctttgctaacaatgagtcgagttggagatagcttggtctcgaaatatggtttctttgtttgtttcatgtgtaggtgactcgatgcctcgggagagtatttgcggtgatggaccgggagtcggcttggtggtaagacgatgtccgtggtggtcagatatcatgcgggatactaaggctagagttgatgtacgtggttgatgg

SEQ ID NO: 50492 - DNA, 1501 bp, Oryza sativa
taaaaccggatgacgcatctccaaacttacaaaaccagtgcaaattagatctctcggcggttctaggcggttttgactcggttttatcctatgtggcagctgactcagcgtgggacccacgtgggcccccacgcgtcagcctcttcttccttcctctctccacctctcttcctctctcctcttttctccaatttccgggcggcgcgcgggggagcagctgcacgtgacgggcggcggccggcgggcgcaggcggcgtgggtagaggccgcgcgcaggcggcgagcggccgaggaggagctgggcggaggtgcacgagctcctcgccggactaacgctagaccggctccgccatgtccgccgcgaggaggtggcgcgcctcgtcggctcgctcagctggagtgccaccgacgccgagcacgtcgacgtcgacgccgcgctgatgggtgtcaccagcaacatcgtccctcgcatggtgatgggccggcggtggaccggcgacgacaacgacatggaggagatgcggagcgtggtcgccgagacggcggagctcaccggcgatctcgtgtaccaggacatcttcgcggcggggacgacaggcggagctcgacgcggtggtcggtgacctgcaggccgtggcgaaggagacgttgcggctgcacccgacgccggccgcgccccgctgctcccccgttggctgccgcccgccgcccacgtccgcccgcgcgccgctccatcgcccgccgcacgcgcgcggctcctccccacgccgccttcgcccgcctggagttaagtcaaccattaactttgtaccagttcaaatcagtggcaatcaccaaaccaaacagtgcgagcatgtgagctcgatcttaacaacaagcaagcagaactgtagcaggaaccaccagctgctgaggatccaaagcaaatggggatcatcagatcgattgctcatcggcgtactactggagatgatgggctccagggcaaccttgtcggcggttgccttgcaggatggatggattaaacgaaaaagtacaccgaaggtcgcccgccgcctgtgcccgcctgcgcgccgctccgccgcccgcgcgcggttcctccccacgccgcctgcgcccgccggccgccgcacgtcacgtgcagttgctcccccgcgcgccgcccggagattggagaaaagagaagagaggaagagaggtggagggagaggagggaagaagaggctgacggatggggcccacgtgggtctcacgctgagtcagctgccacataagataaaatcggagtcaaaatcaccgagggacctagtttgcactgttttgtaagttggggaatacgttatatctggttttgtagttgaaggacgattttgtaacatccatgacaagttgagggaccttcggtgtactttttccatggcaaaaggataatggaataagtctatttttggtccctcatctcttgctcgtgattaagttgcctccctcaaccgtaaaactg

SEQ ID NO: 50493 - DNA, 1501 bp, Oryza sativa
caaggagcccccgaatggggggcagagcaaaaataaaaaaaattgctagcgtatgtgtcatgcgctgttttttgctcaattgttgagcgaagagccgaggacaagcaacacagcaatgtccacaagtcggccttcataatccatgggttttgtttgatatgcttacgtgtgacatacgcacactaccatcagcatacacgtccgtgtgtgcgaggtgtgccttcgatcgagcacgtcaacagcgtagcaggatagatatgtaagaagaggtgaaatcctttcgatctccggtgtgggactaaaaaaaattgacggcgctaaagtaaacaacgtgcacctctgtgtctagtgttagaataattgggctagacttaatttatcctattaaatctcagacccataataagtgttaaggataataataccacctcaggatttaagcaagaaatatcttaacctaaatagggagttattggaggctcccagttgactggttgaggtgggggtcggaaagccacgcgcgcgcgccgggtcgggcgagggcgtgacgggcgtgcgtcacgtcgctattcttttgcgtccacgatcccacgttcccacgactgcctctgcaatggcgcgtccacgatcccacgttcccaggaggccgctagataaggaggccgcaagtccgatcagattcctcctccgcaacggcgcgtccacgatcccacgttcctaggaggccgctagataaggaggccgcgagtccgatcagattcctcctcctccgggcctatgctgctctcgcgttctgatccgcttgcttctttcccgggtgttagttcctcctcccaaccacaccttcgcctgagatctgcaccgggtaggcgggtgatcaggtttttggagatgcttcccgcacgactgctcgtcctcgcccaccatgtctgcgcctggagccggtgccgctactgctgctggaggagatggcggaggtggtgcgccaccaggagctggagctggagctggaggtggtgcgccaggagctagagccggtgccgcgaacaacaacaccaacggaggcaattctgcctcacaatccagcggagggccattctcaaggtatatccttctcctgttcctgttcccgttgttagcgctttactgctatattcctgttcctgatattcatgatgcctctagcatgctactgcgttactgctatgttcttgttcctgatattcataatgcgcatgatgcctttagtatgctactgcctttagtatgctactggttatgttacatgttgtcattagatcaccctacactgtttatgccatgattattgtcttaacattttggattaaaatatgccgatttatgaccatattttcaactatccaaaaacctgataggtcattttcggtagttggctttgctgctacattgaaaccacatgcttttgatggttctaactataagagatggaaagcacgtgcactattgtggttgacagcga

SEQ ID NO: 50494 - DNA, 1501 bp, Oryza sativa
cgtgttcatccgagagggaggtactggaggtacctctcaagcacagtaaaagcgttttgtgcactctcttcggtgaagacctgatagtaaaattgagtaccaaaaaagagaagagcgtgccactgattcgcagttttgcaggctaataacaacttatcaacatttagaacatctaattgacgctatcaaccgaataaaagggcgaaatgtagaatactcttgccactaaatatctttcaggtctcatctctcaagtctcaagccgttcttttattggtaaattggaaccatgccattataattttgcaaagtttaagatatgtcatcggtatctcaatgatatatagaacccacatgagtcaatgacacgtgggtcaggatggcatatcttaatttttacaaaattataatggcatagctctaatttttccttcttttatctcttcgataactaagggaaaattctgtataagaagaaagtagccgtcggtgaccactaccttcttgaagttgctctccgccatgaagaagtcgaggcacttgctcttcagctccgggcagccgtgcatctcggcgcagcccagcgtcgtcgccaccgtctccactgacacgctctcccacagcttctgggcgcacatcagcttcagcccgtccagcgcgtacctgtccgccgccgcgagcaaacgctgatgatgaagcagatgatcgctcgtgctcgccgtcgtcgacgacgatgagccctcgatgatctgcagaacgtccgtgtacacgaagtgcagcagagctctgaacgtcgtcggctcgatgtcatgcagcgtgacgcacggcatggtggcctccgccgtggagccgaggagctccaccctgaacaccggcgagcgcgcggcgagcacggcccggtgcgcgtggaacgtctcaccgccgacggagaaggacacgtccgagccgtcggcgctgcccaccatggcgccgagctggccgcccaggttagagggcggcacggctatggcaccaccgtcgccgagaattacgagcccacatatgaatgtagccatgccgtcgatcacataaatcgactcgagatcgctccgtgtgatgaagcgatgccatccaatggagcgatgccatccgatgaaacgatgccatccaaggaagcggaagccggaggatgttcccctaattacatctatagagctattctttgcacagagtgaagatggtttaccatctttgttcatcaagaagacctcaaagataacattgatcttggggtcgatctcagtaagcagcaggaagacagcgatgtactcaccattacggccctcacatccacgcgggaataacaaaatcgtcgcattgtgctccccggccgagattcttattccgggcaagcactcgccgatggcaagcttctgggtttcgaggtaatcaagtttgtactcgatgaaactagaggccagcatgcttgctgccgtgtactccatatttgttgtatgggggc

SEQ ID NO: 50495 - DNA, 248 bp, Oryza sativa
tatgagtgtatgagaggtatgaccgagtattaatgatgtagtatatttttatataggtaactattgtatgaatggactattagattgactatagatgatttagagccagcaattggctatactattgaacttgctctaatggaatttcaacggcggccgctagctgatgaaatccggagtagattgccggtttggcgcggcccatgaaagagtgcatagtcaaggcacaaccaattctactctacaga

SEQ ID NO: 50496 - DNA, 1501 bp, Oryza sativa
aatcttaaagctaatccaacggtctagggactctatcgtttcggcatattttgtaaatgggaaataattactacctccgtttcatatcataaggcgttttgactgcttcaactttgtagaaacaaaacattttcaacccaaaataattttatcataaaaatatatttatttattgatttaataaaattaatttgatattataaatattatatatttatctataaacttagtcaaacttgaacgaccatgaccaaagttaaaacgtcttataacctaataaataaaacttttatatgcgtgttcttagtgatctaaaagcaaagactggaaaataaactacaatgaaaaaaccctaaaattaactctaaatttaaggttgagattttaatttttgatttataagcatgagtcaaaagacgaggctgtagaatttgaatttatgaggtatttttctgtcaaacgccatctagacatttatttattttttatgatgatggtgagaggaagagaagcacgtgggcgtagaaacgtcacatctgacgtggttgggctttgggccttccattgtggacctcgaatccgacgacaatgccacaatgctgccgtaggagagcgagaggaattaaatttaaaaaatatatttatcttttttttagaaatatgcggatgtaattttttttttcacaaatacaacgtcgtcactgtatggaaatgtaaaatcaacacaatattgctgaactattgtgcgaaaataacgatggtgtaacaatgcggacggtctcgtagactgaggaagcgagactgcgcgtggacagtgcgagaccgagcaacagccatttgggcatgcccaaaaagcaacagcattttgggaaatgattaattagtgagttgattatcctgattaatcactaataatgctaattaaaataattaattaattgctaatgatgctaattaatctattaatcatgctaatacggatacaaagtcacggtctcgcgcctcgccctgcgagaccgtgacgcggcaccgtcgtgcgacgacggtatacttctgcaaatttcttctaagcgtgtatatttatgtaaaaaacatacatattcatttttttccaagcgagagggtgtttattttgttcggtggctaatgtgccattttaaatcacacgaatgaaaaaaaaagaagaaatagaaaaatatatgattctaatataaatagaagtataaaacagagaattgcaaagacataagaaagattatttgattgggccttacgaaaaatataggattttgataagagatatagacttaaaggaaatgtttcaagaggtcagagctcttgctaagttttctacaaaatctctgtatgattgtctattccataggaatttcaaatgataggataattcaatcctctctttcaacagtctttataggaaatttttttttaggattgaatcctctaaaatttctatgttttttcaataaaccaagagagtaca

SEQ ID NO: 50497 - DNA, 1501 bp, Oryza sativa
ctaagcattctgcatccattttgtgagtttcttgattgaaactttgtttttaaaaaaacaacatttagaagcgtaccgattcacgaagttgcattttcttgattgaaaatctgaaatgctgtcatcaagtttcagtttcttgattgaaatgttgtcaagaagttagtacatcaatggtgtttctcaccctcttcaacagggggggaagaagatgaagaagggaaaaataaatgaaattagaaattacaccttggatcttgctatagcagggttgccttctcaagtgtgtgtgtctcactagttgagcacagattatctaaagaaagaatgaaacatagaagaagaagaagaagaagaagaagaagaagaagaagaagaagaagaagaagaaaaaatgttcagtgatgtctagggttatggccccttggaccatagtaatctacatggatctcaggcagctcatgtcctactctgctcttctcttcagaaatggctttctccatttcaccagatggctcaccatcagtctttgctactactactgctactacgttatcgccagatgtctgcaaaccaagaatgagcatcagttagcaacttggaatcaacatatacattcattgatcaatctttatcagaaaacttaaatgacagtgataaaacacttacgttattgacagtctgtttgctgaatgctgaatgactctctgcatccaaccgaatgctctgaactgttgcagccatcaggaacagagccaggacagcagcaaccaatggcaaggaggtcttcatttcgatcttctgtgtaagtaagaatcctgagaaaagttcagagactggaatactagcacttcagctcagatggaacagtgaggagctatgaagttaggttgctgcaaccctttgacccagagatgatatatatacatcatttgcttcagaagcaaagccatggtcccatctagtgattgctgcactcatgtctgcaatggaggtgtaatctgaagtacagatgcaaaatttgggcataatttatgttatctctgctacactttagagaagtatgtctgcccaaagtatgggccatgtttaggccattggtccctggattaggtgccaatgccacacttggaagtaccaaatgtaattaagaattttgtcaagtactgtatttggtctcaagtgtgatatacatctgctcctagaaagttgcatccatgtctctgaaggaatgtacagagttgcgtatatttgcttgtgcattcctccaggaaaagtgtacaaacttgattagttaattgggttgaatactggcgtacgagaaagctttgattttttaatggaagattaggactaatcagacgaaaatgatcagtgcccgtgcaatttggcatgcatcattcctgcactttgaaggcattattttggtcttttgtgtttgtctccgtgttttttgtatcaagaaaccaaacaactgaaaaaacatgagacaaaaccatgg

SEQ ID NO: 50498 - DNA, 1501 bp, Oryza sativa
agtttatgagtttaatccatttccatatgagaaatgaaaaggacaaattcagacatgaatagtagcaatactattcatttgctgatcttttttaagtagtttacgtatatgctatgaatgttgtcaatttttttagaatttttaacaactatttggatgaacagtgttatctttaaatgatgagggaaatataggttaactttctccattgcagtgttgaccacaggtactatttcactgctaatgttaggtggcatgacagcatcagaagggacttgaataatggcatgatcattgcgaatgaccatccaaccctaatttcttggaccaaaaaaacagctaatttagcgcccacatgtagataaacaaaagcttaaccgggccacaaactactcactgccaacgctcatgctgcacgcttaatgtattatagccatgcgaagaagtttcagtcgatcagaaacactcaagtgggcatattcagattcttcagcaatccatctgtaaattcattcaaaaaaccaaatcaatgtcctttccagtctggtcttgtgtttgaattaatgtcatgctctgatcatatcatgcaaccccatatatggatggatcgatcgggagctcgtagtaatcatgcgtgatctgatgaatattttatggatgcaatgcataatttgccgttttgttcagcaacagtgtcacactgtcactgtccttggctagatccagactccagcgttgcttgctgcaagctgctcctcttgaatgtgagagtgagagttcgtcagaagatgacagaattcggggttaatttcagttggtttttactgacgacgtgctacggccgagtttagttccaaaatttttcttcaaacttccaacttttccatcacatcaaaactttcctacacacacaaacttctaacttttccattgtgtcgttccaatttcaactaaacttctaattttggcatgaactaaacacaccaattgatctaccaatgctgattcttagtacagttcagtgttaatcatgtgcaaagtaaaggaatttggccaattttgttccgtgtttgaaacatttttctgatcaatctgcatctctctggggctggtgagcatgcgaaaaacgaagagacatgcatggcccagagtgacagaacaagtttcaactttgcgaaccaaactaattttccttttctttttgagcaattctaaaccttttctttttaatttccacgttcttatcgccatcgactctaccttattagttcaattatgcatggaaaatcatggctgcacttaaaatggaacggagggagtactttattagttcaatttttaattgaatttacacaccatttaatctattcatgaatcatgataggtttcactatatattactgccaaagtggatcagactgacaagcaacaagcagctgcagcttaactcgcacgtgtggaattagggagctagctagagctcgagctgatcggcaatggc

SEQ ID NO: 50499 - DNA, 1501 bp, Oryza sativa
gattgggaaggaaggaaggaaggaaggaagcaaagcatgcccttctgggtgcttgctttgtgcacacgcctcttccgtttcttgaaacacatggagtattattagaagtgattgtgattcttttttcttgtttaattattactgctagctagtactgattgtgcctagactgatcgtgtgtgtggaggagttaagttttctgcatttgttagctgcgaagtttggtggcctggtaggtgttcttcttgccaatgtgtgatgatactactactaatactacgttattggtcacctgttcattgcattgttcattggtactttgattttgtactgaatatatataattatagtcgcagcttccaatctctggcttgttcattgtggagtactaagggggtgtttagatggggctaaaactttttagtccgtgtcacatcgaatgtttgacgctaatttggagtattaaacatagactaataaaaaaactaatttcataaatgaaagctaatctgcgggacgaattttttaagcctaattaatccataattatgaaaagtttactgtagcatcacattgtcaaatcatggtgtaattagactcaaaagattcgtctcgcgaattagtccaaggttatagaataggttttataattagtgtatgtttaatactctaaattagtgtataaacatccgatgtgacagggacttaaaataagtccctgtttcccaaacaggccctaatttcagactgttgtacctaccaaacagggcaaaaacaatcatcacgtgctttagaacaggaaagaggtagtacctgcaaagtgtacatggtactttatttccctctcttgactgaaatgaggaaaaaagagtggttcttgtgcttctctctcacccaagggcacatttttcctgaagtgatccatgtggtttgctaactttgaagtgttcttttttcttcatatcagttgtagaaactgcttggctttaattatctatggctagtgagattgttggatcataagtgttgcggcattaattttttgctatggagagtgctgaagcgtgtagtttttgatgatatatttgttgcatctagcaaacaccaggcagtagcagctatgggatcttttcttatgtgatgttaccccaagtgcttaatcttctgttttgttatctggagttacatttatcggccgttgacactcaatgaataattcattcattactcgttagctagtaaatcatctaataaataaataaaatgttcaattggggtttgaaataacttgtctagccacgtttctaaagaagcattttaaagaatgtaactttgtagcaaagtattgcctcctcttttcattagagttgttgtttcctattaattgctccagctctgaatttccagtacaaattaattgatctagcattaatccttttgtttggacagatggaaagagtttgtgagaacactacagctgctgatttcaagcaaaataagt

SEQ ID NO: 50500 - DNA, 1501 bp, Oryza sativa
aaaacctctaccagttcatcggttttaataaaaaccgcctggttcactgttttttacaggtttgattgcaggggcggtctttttgttgaaccgagccaccaaggtcgccggttccgattttcccggttcaactgccggcccagcccggtttttttactatgactgccacacatttccacatgagttgaggaccctaacaaacgaaaccatgcgcagttcgcttcatagcatatttgtatgtgcatagctagctgattttttagtaaaaacaacgtatttgtatgtacatagttgtgtaacatacttgtgtaggagtagtttgtatatttaaagtgtataaactttatggtatatttatttggcaatgctccggtgtgctactggtacagtagaaataatttgaatcgttcattattaatggtaatttggtactttattaatacaatgattatgaataactttatcatttatatttttgcacgactagatcgatccgtggtcattcattgcactaacattgctcatattccatcagaaaagctaaaaaaggaggaaaaagagcttcatctgctaaatgacgattatactgactgcaccttctttttataataatgatcttccacgtttctactatcgataactgcagggtctttgtaggaagggtgctaggccccacacctttccattcgttagagttttgattaatagatctaaaccattcacacaattttttgctgatagtgagacgccaaagctaaggatcacataatttgtgtatgatgcgtaaaaagtgcaaagcattagtataggatctcgtccagattcaatgaatgcattgaggaaggaaagttttcctttgtggtaactggtaagtgataacaatgtccagattgggatggaataaatccatattacaactgatgaaccgaagctctcatgttcaaaagtctaccgaaacttgaaataccttagtatatatgtagattgtaaaatcaaatgtgtttttgattattattctatgatgaacaattaggcattggagattattggttttgttatttggaatttattcacgaagtggttttagagatgattggatttacaggtgatcgcaggattctatcattttatgtgaccggtcagaccgggctctggtagccggtcagactggcggtgatcgagcggtcggaccggccagcccgcggtctggccggccgacactgtgtcggtttcggtttcgggttgtttatttggatatccgagtttatttcatgattatgacttctagatggatactatacgtatgtaatactatagtttgctgctaatgagtcaaattggagatagcttggtctcggaatatggtttctttgtttattccatgtgtaggtgactcgatgtctcgggagagtatttgcggtgatggaccgggagtcggcttggggataagacgacgtccgtggtggtcaaagatcatgcgggatacttaggcaagagttga

SEQ ID NO: 50501 - DNA, 1501 bp, Oryza sativa
tattcttacatttgacgtttaatcatttatcacttacgtatatatcaataacatgtagatcctcatacatctatgacatgtagattcagatgataaatgattaattgtcacatctaaaaagtagtaaatagttaagtattcccaaaattgtgggtttatcaagaatgacaatgtagtgtatatcaagagtattctaagcaaccctataatttatactagaaactttagaaacttggaagattttaatcacacaagataatttcctacgaaggtatttgaaataaaggattaaattttatctttttattttaaaattcctatggaatggatggtcttatagagatttaggagaaaagttaacaagagttctaactccttagtaatttccactttaaacctatctcttatctgatacctacgacttttcctacaatctaattaaatgatcattcttgtatttattttataattctttatttcattcatattcctatcaaaatcatatgacttttttttcctattccttcgttttaaaatccacatttcaaagaagcgcgtgttggcattttcatcgaatccacgcgtaaagagtggcatctcatagcgaagtgagcacaactcaattggttaggttacttgtggtgaaaccaatccacccgggtttaaatcttattctttcaatggtagttgacatacctgtcgatagcgaggtacctatcatgacttcgtcagtctcatatttcaagatatgctgacctagtttgttcggagatacaataggttatacgtgtgtgttcataacaatgagcgtacggatgttatgaacgtctgcgcgtttagggcccctttgaatcacaaggttaaaaaaatggaggaataggaaaaacacatgattctgataggaattgaagtgtaaaacagaggattgtaaaacacaggaaaaacacacaaaaggccgtttgattggagcgcaggaaaaacgcatgaatatagactcaaagaaaattttccaagaggttggagctcttgttatatttcctccaaaattcacatgcaatgtgacattccataggaattttataggatttgaaaagcttcaatcctttgaatcaaaggactaaatagaaaaaatttctataggatttgaatcctatgaaattcctacataaatcctttaattcaaagaggcccatgtgttttttaaaaaagagtgacatctctcatcaattttctccccacacaaggcatggtgaggcaatattacatataaccccttataatacctcccaaatcaaatccagctcccctttctctctcctcgcatcgccacctcacctcacctcacctcactcgcgccgctatataataacgcgactcccgagctcacaggagagtgtgcagagcgagagacgcgtcacctcctccccgccgccgccgccgccgcctcgcctccgttgcaaccgtagtagggttagggttttcgtggtgggcgccgccgcca

SEQ ID NO: 50502 - DNA, 1501 bp, Oryza sativa
aatttggggaaatcataaaaaaccctgagtttattttctcttatatgaccgtttgttacaaatgttctctcctaattcgggctcctttattcaaatgaaattcatatgaattttagaggatttcatttctatatgaaattttcctacataccctatccatcccaaaaaaaatttaatcctaactacgaactcgtaggtagagtttggtgatgtttgaatctcctgaagatgaagattaagtgtttcacgtaaaatgatatggtaataacatgtgattaattgagttttaattattacaaacttgaaaaatagattaatcttatattttagaataactttcatatagaaagttttcgcacgaaatataccgtttagcagtttgaaaaatatgccattttaattcaaaaacgaagagggcctttgcctttttgtttgatagactagtagtcctttgaatcaaagagagacgaaccctataaaaattcggaatgtatctttccatacaaattttagaggaaatttaacatgaggtataatctcatgaaaagatttttttttaattctttatctctcctcaaatttcaatgttttttctgcgacccaatcaaatggtcattccaacggttgtcctgtgcttttgtaattctttgttgtacatttttatatgctatgttttttctatttcttctttttcacccaattacctatatgcttagctcatcatcatagctgcaaatcccacatacgctcacgagtaaggagatgtggtcgccattcatatcagacagggctgatgatattgccgttgcagatgcatgcctactcataaaagtcataatgttcagcacgtcaatgaacgacggtgatcatgagtctccactcttacacatcgaagcgacgaagagatgagttgttgcgtttgtttcgcagggttcgacatttgttaggttttttttgttagattcaatataagtattggtattgctaagaaataaatatgtttaaggccatttctattaaggaatatgctaggtaatacaacatactagtatgcatgaagagggaaaaaacaccaaacaatagcaggaatcccaaatcaatgtgaattctaaagagtatatgcaacaaggagataaccttaaactcaactcgggatgacatttggggtgttttttttttgcaatttttttctttaaaattgtagatttgaaacgttcatctcgaacagtaattcctaaaatacaattaggtttccattggaatttttttcatgctgacaattcctataagctttctacaaaattcttccatagttcattccttcctaaaatacgtggacttcaccgtagagcccacgagaaaaatacgtgggctgagtgaagccttgtgcggcccaaggcccaacgcacgcgccgcccgtggattcgatcacgagaacggcataaaccgcggcggattcccccactcggcgacaacccaacccaaccccgaccctctccga

SEQ ID NO: 50503 - DNA, 1501 bp, Oryza sativa
acttcaactttttaattgcttaactatttggataattttgttgatggtgtactcttgaatcttgatctgtgtacttctgataaagacataaaggctcagctacacgttgcaatttttattagttaatgtactgttaaaaatctgcttttgtcggaaagtttctttcatgcttattggagtattttcttgatctaggcgcattccaaatggtttctgttggctcgttttggtgaagtactgaagtgtacaggttataggaagctgtgacctcgtttttgcccccctgtttagcttgctttagctacttgtttatccagttaagtgatgaactagtgttacttattatggcactatttatttaggattagttcaacgcgttcgtcctatttcccattgccatgtgccagtagacgacacgtgctgactgctgactagtattctttgtattgatcgtaggcagatatttcttcagaaatagacgtcgagccaaatacttgacaaccacatatagaaatacgagtaaactgtccgaaaacattattcacggtgaacaacccttttacagttttacagtattttatatatttcatatatatggaaattgtgggacaataaacttctggctgtcagcgatcatcagctctgttttagtgtgagtagggcaagtcttttttttgtgtgttatctgattaactcaattagttttcatcgggttgagaatagtcttctagaatttggtaggatgagatgtttctttcaacgaagacaccaattttgtcatctggtacctgagatttttcttggtcttctcaaatctaccatgtgtagaaaagagtggtcttttagttgttatcccttatttttctccttccaatttccaacaccgaatttggactggatcatgtgaaataacaattcaaatttgccctactactagtgatgttgcctctgtggaggaactttcgtgctgacaattaggcaaacccagcacactgtagtttaggaactcacaattttgatcaaattttcaaaccggaaatgtgtcctggaaagttaatgctgtagtttggattagatacagatgacaggcaagaagtagtgaccgaacacaaaataattacttgaatacctcgggtaccttccagatccatttaggtgtttatagcatagaaatccacaaacaagtgcagtcagtaattggacatatagcttccgctttctttcctattcaaaagggaaaatattgaatttatagctttgcagtgggtgatgaaaagttcgttgcaatcatctccatagcagctctaccacatcaaaacgcttgtaggtgtttttttggatgcattcagggttaacacttccagaaatagttctttcactgatttatattctacccaaagttgttcgtaagttttaaatcatggtgttgttattaattgttaacattggaaccattactatatcttatgcagaatttcctgaggaatagagaagttggaga

SEQ ID NO: 50504 - DNA, 669 bp, Oryza sativa
acgccttcctctgtgttaaccactaatagccatgcattatataattgaacacttaatgggtaactagagcacataatttttaagtaaacttcatggcaaaaaaatttgaatttcaataaaatgcattttttttctgtttaccaaacagagctttcattcagtatcaacacaaacagaggttgagcttaaacaacaactaaacaggtcgaacgtctaatatatgtaagcttataaacaagaagttgcatgtacctccatttagtacaataataacaagagtatgcttacgattactacatagtttcatgcaagattttctgaagaattattggaatgcattcatctgacagttaaaaatataagtctgtatgttgtagtgttactctgagtgatctctgttcatttccacaatacatcatggtgcaatatctctgaaccgagtgaaaggtaacattggagaacaggacaagcttttcggtgagagcaaagcacttgaattttagctgctgcagagggcaaatggctatctatctttggagacttcacctcctgctgtcttaattctgagaaacaacagcatgcatccgacaagaatcacattgtaattttgttgtaatgtacggcaatttgcagaaaaagaatggcagatagcatttctgaatcacacat

SEQ ID NO: 50505 - DNA, 1501 bp, Oryza sativa
gtcaggcattgaggcattgaattcatacctcggtccatagtgtttcttaattaataaatcccttgattttttttaaacatatgctggagaatcgcatttcttgtgtagttacaaagttggatttcgttgttaaaataattaagcatgcagggcaagttcatacctccgttttctactgtaatcgtgaaacacagccaaaacacaaagtcctcacaagccaaatctgcaagggcatagatgtccttttacctgtcagttaacaccattaagccctgctaacggaacaggagcatacctgagcttcagttcaaaatagtgagggtaaaatcacaaagttaaaaatacaagggtaaaatcacaattgcagttgtaaatagggacaagaacacaattacccctttttgtttttatttgttaagttcgctaccatgtcaacattatgtagcaaaaaccactaccatttcagcaccaaaacatgtgctggttaaaggtagcaaaagttcatcttaagagcttgctaaaggtaatcataaaacaaattatactggcgcaaattcttttcgcgatcttggggtgtccaatctcaactgcccaacttgcaaaccctgaaatagccggggcagcccacaactgacatattattctcatgatttatgctatttcaccttaatgctatttgacgatatgatgataagacattgttatacatcttatattaattagtcccataatgcgatgtgacagaccaacacgagaatgaaagccacgccattagacttagcgaatgcacaagacgccgaattgctcctaagctgaaattcccgtaaacaacttaagctgatatcctgtggctataaataataactggcacatgcagacgagaattaccttcttatttcttaacctgcagttaattgcctaccagtaagcaattgatctgttaccttaagcggtcacgaagtagggtttcgttctcagtacaatccacacgtccaataaagtagcacccatttgtctgcaggcttcagttgcaagctctagcacagatggacgtctccagaattcaatttgctgaagatgaagagcagccatcacaatgacttagaaccctcatctttttgtttaacatttccattacattatactatatgacaatgcgtgaaaagaccatacctgctcaacttcttgaaactataggggctaataatgaaaagataaagaagcaacaaagcaaagcaactgtcaagactcttcttcacaaagcttcaggctttgtgtttcagctcggtgacaccaaccacgtatgtgctacttgtcttgcaagcaaatccagcatctaaagccactcgcagcaccaacgtgtttcccagctttttctgccacacactcactacttacacacatctctgcgctccaatgcatcccctaaccaagtagtgcatccaactaaattgctcccagcaatcttcgccttgggatttccagaagatgggatcactca

SEQ ID NO: 50506 - DNA, 1501 bp, Oryza sativa
gggtgcacgttgttttttgcattttaaatgcaaacccctaccgttcaaatagtatttattatcctagtagggcacaaaaaaaagtttatttttttcttaagaaaaaaagttattgtcagcatgtacagctaacggcagattgtatgttgtatactgtagtacagatcacggctaaccgtatctctcatcatttaatttgttgttggtttataggccacaaccaaaatttaaatcttaaaacttaaagttgagttgaagaagttttcattaattttttattccgtaaaatagagttttttttttctcaatcgtagtttatttttcagtattgatttttaaaccagtaaaaatataaagatatggaaattttactataaattttttttggtacttctgtttattttctctgtgatttatcttagcacttagcaaaaaataaattaaggcatcttagcatgaagcatcaaggtcagcgtgtgcaagtaggagacacttaatttgatcattttaatttgatgctgtcacgcaagaactaaccagaggtggcgcaccttgactttgtttctttaattaacgagcatttagcatggaacttttttttacctactgtaacctgttgcttagtgagaaaagagtatagagcatgaattcttcgagttgggcccttcggagtttttgtctgctgtacagactgtcaccggcgacggagtcaaaaaattatagaagactaaaaatatagaactcgactaatgaagtattaatttttcaaaaaaaaatactatatggtgaattaacaaaatttaagcaagtttttggaggcagttcaagggcttaagccttagctaccctaggcctgcctccgcccctagccaccggtgataatattctactccgtaacagctagcttacttgaaaaaaagaagacgatgaacaataaataagtttaaataagaagtggtaattaaacatgtgaaattttgataaaagtataggagtttcaaatttgcatcaacatcaatcaatttggcatactgaatgcactacatgttcttcagggagaagacacagagtgggtcacggtgaaatacggctgggcaaacccttccgctgacgactggattgctgtcttctctccggccgatttcatgtactactaattacaacaaaatcctttcaaatttccacattttgatcgtgaaagtagttccttttactcatcagtggacacatttgatcgtgaaattagtttccttcactcatcagtggacacattttgatcgtgaaattagtttaaactgttaaatctgtgtcacttgtgcagctcgggttcttgccctaatccttccagatacccggatgagccgctgctctgcactgcaccaataaaggtggattaactgcaatttctctgaacctgaatcttaacaagtggttgctgcacatatgaactgatgatgaacatgtttatggatgattaacgaatcaattgatttgcgcatgc

SEQ ID NO: 50507 - DNA, 1501 bp, Oryza sativa
ccatcatattgttaacctcaattcacaccatttccatttattcatgggcataaccattatacttgtaacaaaaataatgtgtgcctcaagctaataggttttacaggtgtcataaagggcacactgaaaagacagaaaatgagcattagcaagcactgttgtcttattacaaatggggatttaatttacagttcatatcgaccatagggcctcagacagagcagagcttttcaagaatcatgttctcgtcgccgtcgacaatcttcagagcactcctcacgatgtcttcagggaagcccatttaaagttttaaaccaacttatgcacatgtggtcacagtcacagataagttgtactccgtatatccaatggaataacaaatactccgtataactcggtaacaatacattttcttccataccgacggaggtactctgcaaaggcctctatccagtagcagaaaatatggaatagtcacgcaggtactgcaaaaatggattaaaacaaacattaagagcagaacacaacctcaacactgattccttaaaacttgttaattagttttgaccatgtctcgaggttaggaatttctgattctgaatttatgactggaatttctgaattttttattctgaatttcttatactctgcatcgctttagtcacggtacagaactcaacgatttactcaccggggcccattaattatacagccaagataaggtgtagttcagattccgaactctggacctagattgaataaccaagtgactttaccaatataaaggtacactaaaacctaagttggctctctctgacccaataccttcaagaagaaatgaaaaaagaaaaggaaaaaaaaggcaatggaaatataaaacatgtagagtatagcatgcgcaaacacatctctaaattctagtatcatcaatggtccttacccagctccaagtgccatcattggtccacactgtagctctagccatcatgttttcatctctaccttttcccagcaatttgagaagctatgaaacaaacagctagagctgcaaaatttctccattacaaagcttaccagagccctgaccaattttatatcttcaatctcacctgcaagagcaccaaccagttttcagtcttcagtctccattcactgagcatgaaggaaagcatggagataatgactacatgaatacaccatgatggatcctctatcatgcaacaaatgaccagatccagtgtggtcatcagaagaatggaacaacgtcgataagacttcttgaaccagatacactgctagccattgcagccacaaaccgtaagaggcagggtaaagaaaaaagtgcattcttctgagaccaaactgcctcttactcccttcttttccccttcctcttacaagtcaaattaaatgttcacatgatagaaaagaaaaaaaaaaggagtactttgccagcacaaagtgcattcttttaggccttagccaaaagtcaagtgagcag

SEQ ID NO: 50508 - DNA, 1501 bp, Oryza sativa
gatctgtacttttcctctcaagttaaattcatgacggaaatctccgttccaacatggtttacgtgggttttaaaatcttacttgcatgatgtacttaacgcttctcgataaacccataaccaaaaccaagttatcctttagaatccctaaattttatgctcagaatttcttttaccaacttaccggtctagagtgagtttaaggtttcaaccatgactcgtcccactgtggaaaaatctaattgttgtattctaattgttttctaatctattacactctcataaggtatacatagaagtaaataggggacaaagacttggagtacaatacaagtataagagtagatttatctctagcatactatctctaggattctatctctagaatatatcttatctctatatttatatttgtatttgacttttatctctaactaacatatttgtacttctaacacccactactcgtattgtaatttacacacccacttattacaaataagaatgcatccaaaaccaaaaccgtcctcttgtcgattttctcctagagatcagaaatctccaatcagaccgaaccactgcagccggcaagtatgaatgatcgatcaatcatccaagaatgcaaatgtaccaggctagacagcacgttggattcctagaaaacctttttggtgtttttagtaccattgcatgctcccctttgtcttccactgctcagtactgcactgcactgttaatcactccctccgtcccacaaagaatctatttttcaatttttgatacgactattcgtcttatttaaaaactttttatgattaatatttttattattgttagatgataaagcatgaatagtaatttatgcatgactattttgtaaaacaatttttgtaatttttttaaataagacgaacggtcaaacgtttgagacagaaaccgaaaaatagagtctatgtgggacgaagggagtacagtgttactgcttgccgaaatttaacctctccccggtcaaaacctgaccaaaattaaccgctctaactgctagcgaacagaaaacgaactgttcttttttctatctttcttttgcccgggcttaccgcgtcatcgtgcatggaaggtgatggagctcgagatcaagaatggcggtgaaaagggaaaagaaaaatggaggagaaattaaagaagctgaagcattctactccccaccaccaccgcccttatcttcttcctcctcctgctgctgctgctctgactcgatgcgtcgcccttggcgttttcccatttagtatttaggcagccatggtgtaggtggaggtggaggtggccggcagaaagcgccattgcccacctgcccacctcaggtctagccgggtagggtagggtagggtaggctcgtcgtcggcgaggcattccgccattgttgctgcttgcttgctttgccgggatggagatgaggcggtttcttggtgggctatgcttcttggctctgctgcggctgggcg

SEQ ID NO: 50509 - DNA, 1501 bp, Oryza sativa
aggtcatgtgctaagctgacacgttggtgacatatggcttggtatccttacgtttccagactagatctaccgggcaccagaagattggagcccaggtttacattaatgtaaaacttaagtcagcctaatactgactagatcaacttgttaagttgggacagacagatccctcacgcgccttccactgcagaatttgtactactactgaaagctacatctttcctacaaaaccgacacagggtaagagcaccgcttcaagcattaaaagaactcattactgaaccctcgatttagcccaactaatgtgcagatctaccgtcttggggcaaagaaaaatatttgccagcccccactcagtggcatagacaaaagtgaattctaacgaaaacaaaaaaagaaaacatatcaacacaggaggagcccccactagaaaaaatacagatttggggcaaaccaggagagactaaaatatcaggaaagcacatatttggacaaagtagcactatttggcagcccccacaaagaaaccaaaagccccaacgagaagatttggcttccatcgcctaaaacctccaatctttaacatcacttcagcggttcatctcggatttttcatgattcttcttcattcacaaagccatcttttttgaggagcttttggaagttttcccatcagatcgtcgttattgaaactaactaatcaagggagaatagaaccaaaaaacgaaccattttgcccctgcaatgtcgcgctcatcgacaaaatcatacgcccagatacgaaatgacttaagaatgatttaataatataagtaatccccacgaagaacgcgcgaaagccgcatcgtctcggccgaaacggccacgggaacgatcagatctagccgaaccaggcgacgcggccagatctgagagggagagagagattcaccttcggagatggcggtctggatctcgtggcacttgacgacgacgttgtggtcgttgagcccctcctcctcctcgatgaggtagtccccgtacccgccgttcttgctcccccccgacgccgcggccgccgccgcgtgcgccgggttgaccttcacccgcgcgacgagcagccactgcgcgacggcgaacgcgacgccgacggcggccgcgacggggatgaacacctcggtcccgagcgccgagaggatcgccatggcggcggcgcccaccacgaaaaccctaaccctactacggttgcaacggaggcgaggcggcggcggcggcggcggggaggaggtgacgcgtctctcgctctgcacactctcctgtgagctcgggagtcgcgttattatatagcggcgcgagtgaggtgaggtgaggtgaggtggcgatgcgaggagagagaaaggggagctggatttgatttgggaggtattataaggggttatatgtaatattgcctcaccatgccttgtgtggggagaaaattgatgagagatgtcactcttttttaaaaaacacatgggcctct

SEQ ID NO: 50510 - DNA, 1501 bp, Oryza sativa
gagccggtgaagaacgggagagatcgaactgaaaagtgaaaaaggcctagttttgatcatgggccacacgttccaaggccgccactgatggtccggcccggcccatctaagcccaccacttattgggctctcgcgggctcgccgcggcggcagttgggccgcgcgatggcaatgaggagcttcgtcggagatggaggtcgggtcggggggcttcggcggcggcggcaggtggtggccgtgtgggactatggaggcggcggcggcggcggcggcgagcaaccgattccatttcgcggcaatggcggcggtgaccggaggaggaggcgcgacgaggctacttcctgcgggttgcctcgatcccatcttcttacgcagatagggaatcggggcggataggtttgtgccaaagcagcttcggttaaattttttgttctttgaaaagtttgggggaaatttatttgggattagtactgtgcgaatgtgcaatgttttcaggattgattttgtgcaatccaaaaaacaggaagaaaaatcccgtaggaacaagaatcgttcgtttttttttaaaaaaaaaacagcacacggtattagggttccttgcatagaatttgatatgaagcatgccactttcaaagtagtagaagatgaacaagattgccatgaactataccactttcaaataaaaaagaaacaatattgtcatgaagtacaccactttcaaattaaaaagaaacaagatgtcatagaatttgatgtgaaatacgccacttccaaataaaaaagaagcgatattgccaggttcagttaatatgctccttcaagatgttaagttattctggaaaggacgttatcacaagcttaaatttaagggcctgtgctgtgcatcatcggttgctcaacctctcaagttgaagttggcatgttgtatgttgtgtaacacatggagtggttttctgattcacatggtatattgaatctttattcttctaggtgcttatatttttcattgtccggcaaaagtatgccgcccaaattaagaccaaggagaggttacaagtaataaataaacaaacaaggttgctgtgccaccagaaattagcccaactacctaaggatagaacaaacagcctgccaactccaggctagtacacagctgcgctctaggtgcttatattgaagttagggaatcagatgttgagcttgaatttaaatcttaattgtcagccactattgggcagttcctaactctgctccataaatgtcaaattgccttttttttttggttaattcagcaatttggttgcaacttacagcatttttttataccaggtataaattgttttcattacatgaccacttgtgcaacaatggcagtatttttactcttttttcgtacatggtctcagactcatatatagtaacttctccgtatcaactcaacagcattgaacaacctaagtcctgagacagtacctgagctacatccgtatggaagggagca

SEQ ID NO: 50511 - DNA, 1501 bp, Oryza sativa
taaatacaagtgtaggggaactagttgacaaaaactataaaagcgctgagcttatttttggtggagcttcctgtttgacatatttgtcgaaagtcgaaaccaaattcagggtgatagatgaacttctgttcgaagtttaggggatatactggccttctcttctccaactttttttctcattaacatcttcaaatccagccctgagttgaggcctccatttcaccatttgtcacttcaacccataagtttaatgcatgtcatcttagattcttgggcagtggcaaacaaatggagggcaggctgcgtctgctgcagccaaagtagatgctttactgtccctgaaatacaatcccagcatgtgcaacctttccattgaaatgatttaagacgatcactatcgatacagatcatggcagatcgcccagcaaattttttagactagaaaatgacggaaacaatttgcagggtaaacaagtcgcctgaaatgggataataaaactttttagaatatccttccggttaaaaatatgacagttgaagacctccgggtctttctcaatgcaacatcgttccatcgtcaaaaactatccattgaagtggagtctcacagtaagcttgtccaacagatccattcctaacctacatgtgtttaacaagttgatcatcagtcctacttaattaccaggccacactcaacctttttaacaagctaatctcatcgtaccatattaaagaaagaaatcaacgtgagcggtgcaggccataaacaaattgacaaatccgcgagatccaatgaagcacatttacatatggattccaaatctaataaatccaaatggattccaccttgttgaaactataaaaatggagcttatttgtcggtgaagctcatggttaatttgatgtatttgttaaaactaaagttcggggttgtagatgaactcccgaagttcaagtatatccccgaatccatcctgatttgaagcccaaagtagactgacgattcagtcactacaatgcgatcctgggcacatgtttcctttgctccattgaaattattcaagacgatcacgatcagaatagatcatggcacggatcacctagcaattattctacactagaaaatagctgaaacaatctgcatgatcaccaagttgacgggtgatgaactgatgataagcttttttcctaacaaaatatcatatggttccacactcgattttataaaagatacagtgtggtgttgtccaatgtctacaccgcatgttaacgattgcgtcaaataaaaaaaatctatactccctccagaatataagcatttctagcaatgaatatggatatataactatctagattcatagctagaagtttatattttgtaacggaggtagtttatattttgtgacggaggtagtataacggagttaaatccagactatttaaatacttaatgagtagaggctactgacagtgaagcaaacacacacacagtcacagacca

SEQ ID NO: 50512 - DNA, 781 bp, Oryza sativa
atactcgagatgatttacctaaaagatttgggatgtgtgggccaaaaggctagatttctgtcacactctggctcaaccttgagatgcagccgatcagaccaatccaggatctgatctttggtttgcacaggatcatttccatacccttctatctgaaaacgcttgccatcaatcaggttgctcagtttcttcttctcttcaactggctgccgaaaaaattccctcgcagcctcgatcacagcatcgatcagtgaggtctcaacgccatggttagaaacctaatcacacagactgttaattactttttttcgccgggtcggcaaacagccgacagagtatattaagatggaagagactgttaattactcgtcacaaaaagaataagagcttattccgtttataggattttgaataagatgtcacatgcactccattccttaggaattttttctcgagatctcacctcatgctaaaaattccatggaattaacttgtaagactacaatccttaggaatatggtagaatccattcctataaaacgaaagatgaatatagggaaaaaaatttctaaggattcgattcctacaataatcttatgaaaatattctaaaccgaatgagccctaaggtgcaagtgcaagttttttttaacccatcactagttcaaaatcatcatatactccgacaaaaaaataggtttaggctgtgtttagttcagcgtaaagtttgaattttggttaaaattagagatgatatgactgaaaagttatgtatgtatgac

SEQ ID NO: 50513 - DNA, 1501 bp, Oryza sativa
aaatttgtagaaaaaaatagtaatatattcaacacaagataactatattataaaaatatattcaattatagatttaatgaaaataatttgatgttataatattaccaaaattgtctataaatttaatcaaatttggaacagtttgactttaactaaagtcaaaataacttataatatgaaacgaatgcagtggtacttttatttaccaggaagaggccccagtcctctaaggcggagcgtagcttggcaagctcgccggcgctgtcttcaccattggaggcagacagccggctgaggtcgacgacggggatgggctcaggcatgtcggagccggcgatggcagggcggtctttctcgccgaccatgtactggctcggcggctcatggacgccggcggcgagctcctgcacaatcggcggtatcttgacaatgttccagtggtggccgtcagccatggttgtctgaacgcgcagtgcttctgttcagtcaggtgattcctagccagccggtttttatcttatttcggcattgttttgtggccatggatgatgacagagtgaaattggtcagggtttagtcaagatgaaagattttatgtaaacaagttggtaggtcagggatgtgggaagacatggtagtgccactcattagtcagagaggatcaaacacacggtccttgtcatgatagacacaggaacggacccatcgaataagcgaaacggtatatttgcaaacgaatagtaatttgtgaataaaacttttatatatgtatttttaacaatctaaaataaaagcaaaggttgaaaaataaacttcaataaaaaacctcaaaatcaactccaatttaagattgaaaaatttaaaatttggctaataagcataagcataagcataagaaaaagacactccggcagtaatatggtatgggtcgttgagctttacatcactgtcaaatgtttgtctgccgagcccattggccttgttcggcagccagttttgctgcagctgctgtggctgcagcagttgaaaatcgctgtagcgtgctgcgtgcagccgtagctgctgccaaaaaatctctttcgaacacacccattataaaaatctctttcgaacacacccattatcagcggggagattttgcagagacatgcaacaattactcccccctcccaattttattttacttactacctccgtcctaaattagtagtcgctttaacttttttttttgcaacgtttgactattcgtcttatttgaaaaattagtgcaaatgtaaaacatgataagtcattaaagtacttttgataataaagcaagtcacaaacaaaataaataataattccataatttttttgaataagacgaatgatcaaacattacaacaaaaactcaaagctaaactaggaatcacggcaaaatacattgctaccctcattatttacattctaattatctttcttaaagcaagcattaaaattttcttgtgagagtactggtact

SEQ ID NO: 50514 - DNA, 1501 bp, Oryza sativa
gagtacctctccatcaagctcgacctcgtcacccggtccaccaatgtcagggccatcttcgccgcgttcctcgtccacctcgacggccacccgtccccggtccacgccaagagcttcgtcgccgtctaccctctcggcgccggcggccgcggcggcggcaaggccgccgccgggtggatgtacttcgcgtcgcggagcgagctcgagaagaagttcgtgtccggcgacggctgggtcaccgtcgtctgcggcgtcctgatcccgagcgacagcccacaggcgctgtccccgccgccgccgccgcctccgtcgtccggtggaggaggcgggcacatcggccgcctgctctacggcgccgccgacgacaccgcggacgtcgcgctcgtcgtcggcggcgagacgttccgcgcgcaccgcgccgtgctcgccgcgcgctcgccggtcttcaaggccgccctcttcggctccatggcggaggccaccgcgccgtcggtcgcgctccgggacatggacccggcggcgttccgcgcggtgctccacttcatctacacggacgcgctgcccgacgacatcgacgagctcgccggattctccccggtggacatgttccagcacctgctcgccgcggcggagcggtacgagctcggcgggctgaagctgctgtccaccaagaagctgctcgacaacgtcacgccggagaacgtcgccgggatcatcgtctgcgccgagacgtacggctgcccggagctgaagaagaagtgcctcgactacctcgcgcgcgaggacgaacacttcaggaaggcggcgacgacgcaggggtaccttcgattgttgcaggatttcccttccctcatggatgaaatacgagctgtgattgagagatgagacagttagtgcggatcgatgtggtggctggatttaaattagaaatagaaattccagggattaatgtgaggtaaatccgtttggtttgcttttgttttaaggctgtgttcggtaggtcaaacacgtaaaacaaggtgatttattagcacgtgattaattaagtattagtattttttttctgaaaaatatattaatataaacttttaaagcaactttcgtagaattttttttcatcaaacataccatttagtagtctgagaaatatatgcgtgcgaaaaatgaagagatgtagttgagaacacaagctgccgattcatagttttcgaagttgagaatattgattaatttatgacctcatggtacatatactgggagaattatggattgttgtcttgtgcttgagtgtagcggtctgtgatctattttggaccataaatgttaaatggtcttctatttttttcgactgaacattttgtcaatatatattcgtagtaccgctaaccatttttatatgacatcactacaaagttcgtgcagtgtaacaatagtttgatagtgtgtctggactttcgagaatttcaaatacttcgttgatttcagcttaaatttttaaacc

SEQ ID NO: 50515 - DNA, 1501 bp, Oryza sativa
tttcgatgtgacggggtgaaaattttgccaggggatctaaacaggcccttagtactgataaaaatgtatgcatatgcatcacatttatgggatgataacatcttttgttgcgttcatccgctagacttaaaagacatatagctacatgaaaaagacatagagtatttgtgagtaaatgtatgtttaagtaatttgacattcttctttaaatcattaatgcaatctattaacctatgtttatgaagttggtcccaaaaataagcaatcatacactgtaatcctaccttagatatcaccatcattagagacaatattagccgggacatctggaatatgctaggctatatggttaagtcgcaatgagatgatttcggataacttttctattaaattttatatgtagatactttacaagagacacacattgtctttggttttgggccatgttgcaaaagtgcgaaaatgacaaacaaatgatatcggacttgtgctgttacctaaatatgatgattatgcaaccttttgctaattatggatggggatttagcaatagcatttgcttttaacaacgtcttatcattcgaactatgttggctttctcttttctttgtaatgtaaacgaatgtgctgtaaatcatgtaataatttggctctaattcccgtgaaaagcaaaagaccaaatttttccgaatcgtttgaaaaccagagccatggttcatctcaagcatcttttaatgggacttaaaaatttatctttccctaagtaaattccaatataatttctttcgtaaaatctcattctctggcccaatttgagctgagatctaccacaggtatgtcacatccgtctaaccaaacatcaaaccctatccaccgtgggtatataaatcttaagataaatatgaaccaaatatgtaatatttggacaaaacaaatattacctactatagcgaattccttttaaaatttttgaaacctatccacaataccacatccatattcttaagtcttaacctgaccacctgaccacaagtgaccatgcagattcaggcttcagagccaggggaaaaaaaccgggcccacctgtcagtgtaaggtccatgccatctcctagactcctacacaggggaaaatccccaacttaccctccccctctctaacctccattggagctcgacgaggaggagaaaaaaaacagaggcgagcgaaaaaaaaaagaaaagaaaaaaagagaggaagaaaacgagaaaaatctcaccttcctcttcctccgttatctagctcgatccccgcaagaaattcgccccggaatctctcgatccgctcgatccattcccccgatctgtcgatcgttccttgcgaaccctcggttcccggggtcccgatccggtcttcgccgcgtcgccgtcgccgccggagtcggagtcggagtcggagggggaggagatgaacggcgccggcgggaaccaccagcagcagcagcagcagcagcagcggctca

SEQ ID NO: 50516 - DNA, 362 bp, Oryza sativa
aatagttcgctttgtgctcaccacgcagctgcgtgccttccaccctcacacccaaccccccttatatagccacctccccctccaccacccgcctcgctcgccgaggtggtactaaactcaaacccccacctcacacggccaaaccgcgcgcgacacccctcctcggcttccgccattcggcccaccaccaattcggcccatcacccatccggcccagaatggtggccttgtgggccgcccaggtgacgcgctgtcgctgtctcgagaagcgaggcgcattctagaggcttccggagatggaaccgaagcttctccggtcttcctcgccttcttcttctccactcgtccactcctctctcgac

SEQ ID NO: 50517 - DNA, 1501 bp, Oryza sativa
tccaaggagtctctacttggccagcttccttagttcgtaagacaagccatcaaaaccgtgcgacttgtgggccaacccctgtttagcttagaccaagtctatggtctcatggggaggtccatgtgtccatcctctgtctagaaatatccttatgaaggttgaacattcgattatggttggttcagttgatgtgggtcgagatcgtgcccctagagctgtttagagacaaacacactttcactatgctagcgcgtaagatatgatagctggctgcatggtggccaggtcatggcgtttttctatgctagagtccatgactctgcattgtccgggactgccaggtatatcttgcccattgaggtcgagtagagtaggcatgtcatcccttctcggagtccaccatgtaatcgtacatgggaaggaggatgaagaccctagactctaggtgttgtatcacgagcaccccttggcgtctcatgacaggccaaatagtgttcatgagtgccgaagatgggtgggtgtgtgtccaaatgggcactacatcgcctttgggaggaatgcataggccacatagtccatccatcatattaactacatattctctcaagttgcctcttagcattaatgatgagggataatgtgtattgaagactcaatatctcttgggagtagctttttaggctcacatgagagaataaggagactacaagttagtccagtgtggattcctaggggagattgactgctacattaaatatagcgaggagttcaaggaattagttcggacttatgattatgtacagtcttttttgtttgtctttcatcaaggagaaaaagagagagcagggtagttgtagggtataaaaacccatcctaaaccctgtagaaaaggttagacgttaggaattggtaagaacaccagtcttcctaagctagttggagagcatccagagcttgtacgagttgctttgatagtgacgaataacatgagtagatttgctatcttcggaagacctgaacatgtgtacgtgcttgtgttctttcttattccccgagcacatctggacacgccgtcagcatctagaaccgtacccctggttgatcccgatttatgatttttcacgtttgtcggtgttaatactggtttaaaattaaccaagactaaaaaatggaccgataaaacaaacaccaaaattaaccttaggattaaaattttaaaattcaaaatttgattgtatgtaaattgcaagctaaggtacaagggaaatccaactgaactactatattgttcaaactgagtttattataaactactctatccatcttaaaatataagtattcatagtattcaacaaaattaattttagggtattgccttcttcaccgactatacctgaactggccctcatttaactttttacccaattaattttaccttaaaccccaatcccactcgaattgaatgacaaagggagtaactaatactacataatcgaaggtc

SEQ ID NO: 50518 - DNA, 1501 bp, Oryza sativa
ttaacttgatgatttcgagtttgaattgattttaccaatgcctgggattaacttgatgatttggggtttgaaactttgaattaattttaccaatgctgatttggggtttgaattgattttacgcctgaattatcagatatctacaatcgctctctgtaaatttggtttctatagaacatactacaatttatactccactactgttttaaacctggatttcctctgaattaaatttaccaatatctgcaagttttcagaatttacagtgataatcagggaagactcatcgtgtcagagctactcctggtcacaccggacgaggcggccgcgtttgctgcacagcgcctgctcgccgccggccgccgccaccaccttcccgtagctgtaccggagcggcatccttcccagcagccggtggaactccgtgatgcaatcccctctcttctcccagtgcgccgcgccccccgtcgagctcaggccgacggccttcatctcctcgccaccggcgccggcgccggcgtcggcatcgtcgttcctcgggtcgccccagtctctgatgctgccggcctccaccagcaccggcccctcgccggactcctcggcggcgacgaagttcatcaggatgtcctcgcagttgcgctcccggtccaccacggcgcgcgccgcggcgagctccggcgagcaggagtactcgcggaggaggcccgcgccgaggacgaggagcttggtgagcaccatggagtagcgcgcctgctgccgcgccgccgcgccgtacgcccacctcccgcgggccaggtcgaggtggtgggacctcgggaagaacccgacgagggtgcccgggcgggcgcgctgctgccaggcggcgaacgcgaaggagagcgcggcggcgtccgggagcacgtcgtcgtcggcgacggccacggcggcggtgcggatggacgggtgcgggaggaagcgggagttgagggaggcggaggcggtgcggtggagggtgacggccggcgggaagcttgacaggaggctgtccggtgtggaggggttggaccagagcacgacgacggcgaggacgagcgggtgggcggcgtacgctccggcgatggcgcggagcagcgggagccgccgctccgagtagccgctcaggagcaccgtgagccggtccggcctcagcgtggccgcgtccggcatggactccactccgcagaacgcctcttcttcttccacaccggctacggcagcggcggcggcggcgagcgtcgccgcgagcaaaaggaggcggaggcggcgatgcgacgccatggacgcggtggcgagatctggttcaagtgttcaacgctggagccgttgacttgtgagttaaaaatgtctcgagttggattctgtgtgggccccagtgtcagcctcggtggtgagtggtcgtgtacgatccgacgtggactcgcgtgggcccggggcgtcaggcgcgggagccgttcgttttccccgcggctttatccacacgagg

SEQ ID NO: 50519 - DNA, 1501 bp, Oryza sativa
gtttggacctttccactttgatctattttattcacctagatgtcattattcattaagccaattaggtctagatcaagagatcgcttctcaggtactcgattgatctctccattctagacgctgttcataatgctcatagttgcactggcaatttggcacctaaatattcatatatgcacataaatacttatatttcaacttgtttaatgagtaaatgatactgttataactacatgatgtttgccttccatgatgttcatggagtttggtctgccaatagtcattttgcttttttttttatctctttgtttgtaactatcccgtagacgaggtcatcaatgaagacctgtggaggtttgtctatcgggtcgtcgatgatcaaatcggtggtgctaactttgggttcaggtttccaacttgttcaatgacctcggtttgttattctgtcgaaagaataaagacggtggtcagcgtttatttatttggtttttcttcaaaaaacttttttcaggtgctagatcaagtaggttaatgtctcttataggttgtgtttagttcataccaaaattggaagtttgattaaaattggaatgatatgatggaaaagttgtaagtttgaagaaaaactttgaaactaaacacggcgatagtatctcttgtagcattctgagatatggaggccgagtttagttctaatttttttcttcaaactttcaacttttccatcgtatcaaaatttttctacacacaagtttccaacttttccatcgtgtcgttccaatttcaacaaaacttccaattttgttgtgaactaagggtgtgtttagttcacgtcaaaattagaagtttgattgaaattggaacgatgtgacagaaaagttggaagtttgtgtgtgtaggaaagtttcgatgtgatgaaaaagttggaagtttgaagaaaaagttgggaactaaaccaggcctaaacacacccggagtctctttgtcctattttgataaatattttctttctattcctcaaaatggtacaactgttatcgacctcacttataatccatcctaaggctgagtttgagaggagcgaaaagttgatacgtaaattgatatgagccattagcatattattaattaagagttaattgtttcaaatttaaaaataaattaaaacaatttttaagtaactttactatagattattttttaaaaaaccgcagcctttcaagagtttggaaacatgcgcagagaaaacaagaaattttctcaccatttcttgctcactccaactctacccaacacgggaaaaaaaaagatataactacattttcatcaactcagaaatgaaaccgcgttggactacaaaactacaaggctcatgtccaacctgcttttttccccctctttttgagagggtgtatatgtacagtactcctacgtaccgtgtgggcaagtgctttgagttgattggccggccactacctggcaaagcaacccagataaatcc

SEQ ID NO: 50520 - DNA, 1501 bp, Oryza sativa
ccacgctcaatttggctacattttagaatcttcttcactctcatactaaattttggctttatattggtattaagggcttgtttggtttagtaccctaccaatatattggtagtgccaaactctaggcaagctttggcactaccaatattttggtagggtagaattgtaaatgagtgtctttggattgatgccaattgagagccaaatttcaaattatggtgaagaacattctagaattgtgccaaattgagtataggcattaccaaatatttggctttaaaccaaatcatcacatttactatttaaactaccaaaacattggtatggcaacattttggtatcaaaccaaaacggccctaaaccaaacatagattagctaactttgccctacaaaaaattggtagtgccaaaatttgcctagattttggtactaccaattaattggtagggtagagaaccaaataggccctatattccctattttcttgtttaaagggaactcatacactgcctagttactctaccatgtactagcagcatttagtttgggcaagaacagggccatttctgcaagtgatttgaaaggcacaaaatcatatgcaccttctttagcagatcattatgctcactcctaggcttcgcctcatacccaggcggcgggaatgggaaacacctggacattgtgcccctcctggaagatcaatcacaaaactgaatccccagcaaagcagctcaacagattctcccaacaaatgcttgaattctttctcatgcaacatatcccctctctagcatatcatccccagcgccggcaactgcgcgaggccggtgcgccgtaaccccgatttccaaacactcagatgcacaaatcaatcctcaaaacacaaaatactacatctagacctaaacaaaaaaatctcccgattctgtgactgcttggagcgatccagctctcagaaacaccagattgctcttgattactctctaatttgaggagaatccaagtggtggcatgaacagtacgtgcaatcctcttccatctgctcactccccaccaccgatccccaaccacagccacagcagatgaaactgaaaccccggcacggcaccgccgcgatctgagtcgctgcaatctccaccggcgccgccgaccgcagcagtggcgccggagacgcagcgcatcaacaccaccgccgccgccgccgaagcttccggaaaaaaaaaagtatcgggcaccggaaaccctcacaaactgcttcctctcgatcttgaaccaaaacctactaggaagaggccccccgatctagcgaatctttggcactccacgcctccaatccgtcgtcgtggtcagtggcggattcttcgaagaactcccagaaaaatttcccaagaacgcgaactcgatcagcgggatttcgcctatctctctcggtcctgagactttcctcttcgcttcttctctcgctctctttggggattggttggttgcttcgccgcagcg

SEQ ID NO: 50521 - DNA, 1501 bp, Oryza sativa
attggttgcactaaatagcagatttaggcatgccttcaaaactgggaagtagagtgggctaaagtaggcactaggcagtactggaatgtggatactggatgtctggatgttgaagaaggtgcaatcagaacccaatatgtaaatgatgcagtgaagagtgatgctgacgatcttgttttgttccctttttctttttctcttttcttttttactttcagttattctttatgcttggtaatcaggtcttaaaggtaccctactatttcttactaccaaatgttagagaaactgattttgcatgtatactaatcagctcaactttggagttaccactatacctcttacactgtggttcatcatattctaatcttagctgcaatctaattgccttaatgcttatcataaggcaacattacattgactcctttggaactgttccttacaaaaattcttgcaaaaaatacttcacatttactcctttcgaaattgttccttatcgaaactcttgcaaagtttagtatgaccttaactgaggcacctacaaaccgggcacccgatttttttaaaaaaaatagggcgctatttcaccaagtagatcgaatatgtttcactaaatagatcaaaaatgtttcagtctccctagtcaaaaaaaatatatttcaatctttcaaaaagttgaaacgcaaccaaatcacttcatgaaacatcttgctacaacgtatgaaatgttgtttcaccttatataaaaacaatgttttagcaaatagcgaaagaatgtttcaattcttaaaaaaagtgaaaacatacgatttgaagccattccaacacttaaattccgtgtacatcaacaaccaacgtgtccatcaagatgaaattattaaacaatatcaaaatccattacatgattcatacacagtgaaatatcataagtacactagctgaaacactattggtgaaaaaaaaatataaaacaaatccttttaatagggcattttcgttatattcggacggttgttacaatggggcgcgcgtggtgggggcagcgcgcgggagccgcggcgtgggggcaccccattttttttttttttgcgtgcatcaggcgcccgacgttgaggattttccgaccctaaccaacacatttcagctcatattttcagcggctgctcagttaatcaaaaatatttgatgcgatatttaaagaagtgattaatcggaaacaatttattaattgatgctttgcttgattacttgagtcagatccagaagcatccatccatccatcatccatccgggccgttcgctttccgtttttattttcctcctcggaacactctagaagcccaccacctgattctctcacatccatttaaaccctccccctcctcctcctcatcatcgcctcgtgctcctctcgaaccttccaaagtccaaaccctagtggtgacctcgcctcggcctcgaaaccctagccgcagatctcgcctctccttgccccgcgcca

SEQ ID NO: 50522 - DNA, 1501 bp, Oryza sativa
atacttatataatggtccgaataaaataaatggttaaatgctatgtctaaaagtcaacaacgttacatatttaaaatggagggagtagaagtttttggaaaaaaatataaaaaaatttcacacatgtagggggatatatgcaagaatttatttcaaattatttgagaacttctatatcgtggttttcatattatccacctagctatggttcccatcgtatatttacccccacgttttgtgtcaagtgtgtagacctagttcctttacggtaaaattgcttatttaccgtatccagataattaatgacaactagactcatggacaacatgtcatattatcacacacacttatgtggaaaacaagaaaaatgccatccacttaattatgaggggcaaatcaaaagccaagataaaaagaaagtcaccgtaaattgcccatcctcatctttttatttctcacgtaatagagatgccaaaactcatagacattaagcaagaaaaacttatagtaccatatcaaactgaatataaaaagacattttcaaaggaacacatcatctcctagctcgctatcaagatttaagccctgacagacataacgatacactcgtacctttgtcagtacagtaacaaagaagctgcctctagtgtgcaaaaatttcaactctcttttcgcactcatctcatctactactttactccctccgttctaagaaaaaaaactctacttctggagtttgaattttctcctacaaaaaatcaacttcaacaatcatatctaacctcggtacataaaacgataagttttctcccttaaataccctttacctatctattaacactactacttttctaataatgaggggtattttggttatttttattcttcactagtctcttcttgggatgctaggaatggtttttttttggaacggatggagtagcattataaaaacattctactccttcagtttaaataatataaggatttttaggttatttagtaaatgttaatgttacatcaaaagattttttttaaaaaaattgattgtcaaattttgaattttggatggtgtagatttcatttcgattcgaaatttgattggctttaaaattattgaaatgatagaaatcgtggaaaatcaagaaaaaaatacttttatattatagtctaaaacttaaatacaagaaatccttatatttgaaaatggaattaaggagcagtatcaaaagcagtacttaacacaacccattgccttttgcctagagtccaagacattagacatacatgtcagagatcccccattattttctcgaggagtactgaattcgtgcaaagatttatcacaagtcaatgagccagctgctttctgccggaaacatgcaaccaagaaaggcaaccaaagaaaccaaaccctggtctatgtttagttcagcgcaaaatttagattttggttgaaattagagatgatgtgactaaaaagttgtgtttgtatgacagg

SEQ ID NO: 50523 - DNA, 409 bp, Oryza sativa
gtaccctccatgtctccaacccaactaggagtaccatttcttatttctgaataggagtgcactcaactataaaagaatcttaattttgaaacaataatccagatctataggtgctatacagtagtaaataaagtcattaaacttcatttacctttggaagtacccccttagtctcataatatcgcagcttttagcttttaaaatttgttccagaatataataatttcttcaccaacactctatgcttaaccaataacaatattcgctcatttaattttcccacctactttattttttcagtcaatcacaatattttcatatttaatttcacatacttttctcaacaattgtgtctaatcctaaatattttagggacggtggtagtatatcgctaaccttattgcctgtt

SEQ ID NO: 50524 - DNA, 1501 bp, Oryza sativa
tatcaggggaacatgggttacaaagttgccagcaaccattggtaggttacaaaacttgaaatacctccatgctggcatgccaccagatgatgaggatgacaccagaagctgggttccgactccgccatcggcaattttagaggcatttcgtgagtactggacaaaccaagaagaggttgggatgggaatcaagttatttgtatcagtactcatgtttttgatcagtggttggttgagaaatatggatctgtttggtgttaaagtgccaagacgaattggacgattgaggtccattcacacactgagcgtcgtcaacatttcacggggaaaggccatgctgaagaacctcaaaaagcttacccaattgcgaaagctaggcgtaactggcattaacaagaataactgcgaagaactctgttctgtcatcgtcaaacatggatgcttacaatccttattacttcgggcggagggtaaggatgggttagaaggttgtttggatggcttgtccccccctccaaaagaccttgagagcctccagttgtatggaaatctggtgaaattacccgaatgggttaaggagcttgaaaatctacaaaaattgagccttcggagcacgaatctggaggcggatgctaccatgcaagtgctcggaggcctaccaatgctcgacattctacgtctccaggacaaggcgtgcaaggagaatgaactacgtttccatcccgattgtttcacaaatctgagggcactggagcttatttcgtggggtagcctcaaatcagtgatatttgaagaaggagcgacccctaaacttgaggtgctactggtggaccattgttcgtccatagacgaagctgggtttgctgggatagaaaatcttgcaacactgaaggaagtttcgctccagggttactactacactgaattcaagaaaaaactacagcagcaacttaacatgatcgagcccagaccaaatctaaggattgtgttatacaaaactgtactcccccttacaatctattcacactatgtaatgaaccttgtccgttccctttgaccctttcaatgcaatgacaaaattcaggtggggaatccccccccccccccgggtgatttgggctgtgtttagttggatccaaagtttggattttggttgaaattggagatgatgtgactgaaaagttgtgtgtgtatgacaggttgatgtgatggaaaaggactgaagtttggatccaaactttggatctaaacacagccttggtaaaaaaaaaaaactgtactggttatgcatagaagtcgctccctccatactcaaatatgtggcattgtatcattcaagtagcgtttcataattatctataattctgaaaatttcagcattaagttttactcccttttgtctcctcatgtaccactcgctttaagtgtataagttttagtttcctcgtgaaactttgtaataccattgccatttcactgccagttgcaaagacaaaaacaa

SEQ ID NO: 50525 - DNA, 1501 bp, Oryza sativa
tttgtggcgatggaacgctccaaacgctttttggcatgaaagattgcacagcacaatacgagtacagctttggggttgggggtgggtcaagaggggagagcagattcccggcgaaatgtctctgttcaaatgatgaaagctatataggcctcaccgtccgtccgtctctccgtcagttcactgtctatctgaaactctgaaagttcatcctttcttctcccccaacaggcagagttcatgaatgtgtatgcatctatggccttttcattgtagtatcatgctaatggtgctagtagcatctgtcactgtcgggtgtgctaatggtttcacatcaagaaaaaggtcgaacggtttggtttggttttttgccacaggaatttactcgtgtgactctcttactgagaggtaagtcagacatgctggtggatgtttcgcagaggttttttgactaattggttgcttgctttaactttgtaactgtgttttcgttgagggttggggctatctatgtgcatcactcagataattttaaggttccatttgaattctggggagacttcaaccgtatcaacaacaagacacctatgataacttcatcaattttaaaatataccgattcaagtttttggaggcatttataaaggtaggatgcatgttaatagagataaaggcgcacgcgttgtgagcacctacatttgtaccatgtttagtaaaaaaaatgtattttccaaaccatggccttgttcactttatatcattttcaaccttaccaaatttatcaaaattttggcaggatttcttatatagttacaaaaatttgacagcaaactaaatatagcccttttttttagtaactttactaaaatttggtaaggttgaaaatgtcatcaaagtgaacaggccccatatatccctatagtcacctctggccacatcaccaccctgatctgtcatcttattactacaaattaaatttgcttgaaatcctcttttatttcaaatcttttttgtttatctaaagctgaaggtttaaagtttacatgtggcaatcgcatatccagagggtgtgtttagttcacgctaaaattagaagtttagttgaaattggaacgatgtgatggaaaagttgaaagtttatgtgtgtaggaaagttttgatctgatgggaaagtttggaagtttgaagtcaagtggcgtaaaccgtttttgtcgcctgcaacgcatccaaaaccaacctccaaagtccaaacagctcaacacaaaagcggcgtcaagtcaggaaggaaagaaggatccgacggcccagatggcccccgcacgattcacgagacgtcaacctccatcaccaaccctccgatcctccccaataatttccccccgcgccaacctaatctcctactccctccctatcatccacgactccctcactcctcaacgccatatccaaatctcccgcgaatccctccaaaacccaaccatacattgcacgcgctcgcgccacg

SEQ ID NO: 50526 - DNA, 1501 bp, Oryza sativa
tgcttagcattatgctttgcgtcaatcatcacttcccacagttcagcgatcctaagtggcaaatctcacccaacaccaagtacaaaatccgcactaagtttggtgtgaataattggtagtcccactactaaaaggctctagtatgtcataagatgctaatcactatcatgtatcagaacttcggtgacagattagtatcatcttactactaattccaggcagtgctagctggacatggacgcgagtctacctgatgctatagccataatattagatatttgactaaaagtaaaaaaaaaaaaaaaaagaagagaagtatccactactcatcatcccagatgccaccaaaaaaaggatgtttatcgagaactacatccaccgtgaaccaggatccacaaagtaaaaaagtttatcttggcatcactattcccccggctgctactacaggaagcccaccaattcattcttctcccattctttttcactagcaaaaagggagcatttctcaagcacatctagaaacaaagaaaggcatcgcattcgttgctcctcatctactctctcacactcctaataataaacttccctaacggcaaggaataactacagattgaagtcgaaggccgtaaataataaaaaaagattaccaatcaagcgagcacacatacacagacagaacaaaaaaaaaaaaaagagagaggagagattgggatgggtaccccgtggaagaggaggtcgaggagaggggagtcgtagacggcctggatctcgggccggctccagtcgttcctgggcccgtcccgtaccgcgcgctccgcctccgccgccgccggcgacggggccgacgagaacgccgccgtcgacgccgccgcagcagacagcggcgggcagcggaggcgggagcggaggacggcgcgggcgagcagcatcatggcggggagcgagcagtagaagatggggtggtgtagttaggcgatacggccgaggagttttctactcctacttgagacttgtgagagctcaggctttggctttgctgctgagaagagaccacatggggtaatcggcggatttcatttcaaaacgtgattaaggattcggcttaaggttattataacctaaattattaggactaatctgaaacaaatctttatattgttatgatgaattattataatctagaagacatgttagtatactctggtaagcttttccaaagggaaggaaatggaaaagatttagaagtacgtaaaaaaatgtaaaccattagcctatgactttttaatactcaattgagtattgattatttagaatttaaagaatagatcaatataatatttaaaacaatctttctatacatttttttaaaaaaatatcatttaacagctcgacaaatgtgcacgtgaaatacaagagatttttttccctctttgccccctctatcaaacacagtctaaatcatcaatgaacaagtgaaaatgagtcaaaatcattttatttc

SEQ ID NO: 50527 - DNA, 1501 bp, Oryza sativa
agcgttccatcgccacaaagatccaccacgccgtgtctctctctcgtggtttctccttcttcgggtgtgtttagttcctgaaaaaagttaaaagtttgaagaaagttgagaattaaaaaaaaaaaaagttaaaagtttatgtgtgtagaaaagtttttgatgtgatatgatgtgatggaaagttaggaataggaggaaaactaaacatggccttcttctttttttcatgttgctctgtgaactgaaaactgataagataacagtgctccaatatctctacttttacactgaaaaacactgcttcttgtgtctgttggttttcggttttctgaatctgaagaaactcgctgtctgccttcctgtttctaccaaccgcgcttacccaccgcttaccctctatctgatgggccttgctccagctccacctgcgttgttggtgacgtgtcacggtccagcccgttagtgagatgggccgcttggttgttggttcgaacagatcgcaccacgggcctaacacacgtacgttttcagggcatatgggcctagcttcagagtctctcagactcacagtaagcctactgcttccgtcttcgtcagaaattcatctcaactgctccttccgtttccatttcaaaatatagtaatataagattggaatggataaattctaatacgaagtactatgatgtattcctatcaattctaagttactatattttaggtgaagtaacactgtaaaagtaacaacccaaataattttgaccatcaatcgtggtagatcgacctagcaactgcgaagccggcaccatggtagctcaactacacacttcagacactcagatgtccctttccccttcatcaactcacgtctccgtctcctcgtagtatctgacttttaaggtttaatcgcagtcggttttaacccacagaaataaaatgattttgactcattttcacttgttcattgatgatttagactgtgtttgatagagggggcaaagagggaaaaaaatctcttgtatttcacgtgcacatttgtcgagctgttaaatgatatttttttaaaaaaatgtatagaaagattgttttaaatattatattgatctattctttaaattctaaataatcaatactcaattgagtattaaaaagtcataggctaatggtttacatttttttacgtacttctaaatcttttccatttccttccctttggaaaagcttaccagagtatactaacatgtcttctagattataataattcatcataacaatataaagatttgtttcagattagtcctaataatttaggttataataaccttaagccgaatccttaatcacgttttgaaatgaaatccgccgattaccccatgtggtctcttctcagcagcaaagccaaagcctgagctctcacaagtctcaagtaggagtagaaaactcctcggccgtatcgcctaactacaccaccccatcttctactgctcgctccccgccatga

SEQ ID NO: 50528 - DNA, 1359 bp, Oryza sativa
atagtgtctttttcctatttatcccattttagtttatttcccatataaatttgattctataatttctaaatcttgcataaatgaagtttactcaatatttgtgttatctcaactaatgaattcaccctagattaatattactcatattttattggtataatttatttgaatttttaattagggttaattcttgttccattgcatttaaatctaattaatacaaatatggccgtgatgatattttatttattcctatccttacataatctttattttaaattataatttatttatttctttaaccaaatctaatttcagggttaattcctaattaattttcccctatttgtgatcgatgaattccgaaatcaaaatccaataaaatcgtcgaataaaattggcatgatgcaatttatttaaaaagtttttgaaggcccatatttttagagtttagattttttatcggtcgaattttcaggtgttacaactgtccacccttatcttacagctacactgaggctacttacatagttgtccctaccacctttgatacccgggccctcctcccaattcccctccacacccgcactcccaaactcaaaactttatctggatgtgccgccacttaggttccaagatttcatcggatatgaaggcgaatttggtgatttgagatagggtcaacgaggtatcggatcccttacctaggttgactctaggggtctacatatttgcaacatactctttccatgtgttttctcattttctatcttttcattctatctatgtacaattttagattacaaagctcatgtcggctcgattgtcagtctatgctctcacgtcagctttttttttttctacaagaaccccttttcaattttagttttagattcactgctagagaataagacatcttgatatatgatttttggagtcgatcagaatgccataacttagactaaattgataaaaaaaaagccatagatatatgtatatcagcactgaaatagaaggtgactttggatgttgaacaaaagctcgtgacttagatttaaatcatgccaaaatctatatattatagatatatatgtatatcaataccaaaatagaataaatacaactttttagaagggagaaaccttttaattgtgattattaacatcccaaatcacccctctttgttgtatactacatagaaaatccacaagtatactgctagtataaatttctcaattctaaaaggtcactttaaattactcagttacaaacaaactgcttatattgagtaacatgtaaggtgagttatcaggtttaggtagcaagaaagttgtttctaagtttgatgacctcattctt

SEQ ID NO: 50529 - DNA, 1501 bp, Oryza sativa
aagagtccatgattcatatctgtacgtttatattgcaggaagcttagcatctctcgatctcttcttgttgattttgcctacgtgtgtgtgtattgctagaaaaaaaaagggcaggttggaatagcaaaatggccgctgagccaggaacgaataaactgaagatgttgctgtactttcttctcctgatcgttgccactcttgtgattactgcaggtatatataattcgtgagtatttgaagttaatttgcaggcttatatatgtatcgttgacaaatgaatcaatgtttctcgatcgcgttcttgatccctcgattcctcgaatgcttttgtacagaagttggtgtcgttttagctgctgctgctcgggtactctcgccgtcgacgacagaagaagtaccggtggtaacaagtgtacgtctgcccgtacgtaacttctgctagctcgatctctctgatgcatctaatctaaagcaagctagctgtagctccatgatcgagtatacatggctatatatgtcatggagagcttctaaccactgcatcttcttcaaaagtctctaggtcttcaaacagtttatattctcacttagattctgataaaatatatggaaatatatggttagagaaaaaaaagaactaaaaactagaagctaagaaaccaagattgtttagattcttagaaactgactaccgactggtagtttctaagaattttaagcttcttcaaaataggatctatatatataagataataagaagtaaaagatgcataccaatgtgacgaagatgatgttaaaggtcgaatagccttaggtgagttgcttcagtttaattgactttgtgttcttgccatgtttcttgttaggcccaaactgagatatcatcatcatcagaaggagaagcacggggaggcgggagcagccgggcgtcggcggcggcggcggcgaggaggatggcgatcgggtcgagggctccgacgtgcacctacaacgagtgccgcggctgccgccgccggtgcagcgtgcaggaagtccccgtcgacgccggcgatcccatgaacagcgcctaccactacagatgcatctgccacctctaagttctgattaactagctagcatatgcatgcgtaattgttgttgtgatcgaccgatcgatggaggccgccccgggtgtggttttaataaaagtttgtgcatgctaatgccatggcacttaatttagtttggacgtcgtgcatgtcgtgtggttcggttcttgaataattgtggtcgataagacaattaatcacgctttgaacatccagattcctgcaatatataatatgttcatctagttacatatcttctccatgtaataaaatttagaatttcccaacttatctctcactgacatacatgtgagcgagcaataaacccagaaatcagaatattttttaaaaacttcggacctatttggcacatctacaactccggctctagctctagccaaacagtttcagct

SEQ ID NO: 50530 - DNA, 1501 bp, Oryza sativa
gcatctccaatggcttccccgtgcagtagaacgcgaagtagagcatggactggatccacatcatctcgatgcagtcgctcgccgtcaccccgagctccgggaaggtgtcggccatggcggcgacgaggccaaggcgtgtgccgactaccgaggtacagggactcgaactgcacgttctggttctgcaatacgacgcggagaagttcccgccgctgccgcctcggatggcccagaagaggccctcccccatggcggccctgttgaggagcctccccctcggcgttcaccatgttggcatcgacgacgaggtcggaggcgaggccgtgcttccacagcatcaggctgaagccgccgccgctgaggaacccgtcgacaccgaccgtcctactcgggccgtcgcgctgctcgcgcgccgttcctccgctccgctgcgtgtgtgaggaagaagaaggataggagagcaatgtgggccccacttatgattagcaaatagtaatcaccctattaattaggtacaaattagtccatgatgcgtgaggccaggtggttaaaaacctattaaaaattagattaaacctacactgtctatgacatgtgggacccactggtgtttaaagaaggaaagaaaaggggcaatctgggcatttagaaaaatatctcacctcttttgaaccagaaataataaaataatgcgaccggtgtcctatagccaattacacatttttgtagtgtctatcagccgtgtcacattttaacggtgtctctcagccaattacatgttttttgcgtgtcctgtggcaaatttttcctattaaataagatgctatgttagcattttttataacatgacaagaacatttcgtctagataaaatgagttttacaatttatcccttaaaagtactacttacgaaacaatacaaacaaaacaatacattatattgtatgagttgtttcaacccatcaattaaatattttatttattatgtaatattttaaaaaacacaaatatattatgtaatattaatacaacgaagtggcctttgacgcggccggcggcgagggagacgagctgtcttcgccgcggcccgcggtcgccgcgttggtctggtcggcacgataacgacgacgaggcgccaactcaacaaagcagccagaaagaagcttggcgtgcgcgcactacctcctcccaacccggtgaccccacccgtcatcctcctcacccccccacccctccgcgtcaccgacacctcggccccaccgccaacctcacaacgcagtgggccccacctgtcagcctcacccgcctcgccgtcttccacccgtgcgtgcgtcccactcgcctcccactcacctcctctgcttctcccaccacctcactacctctcgccgcgagagcagcagcgctcgtgttcggtcaaaagcctcgccgcggcgagctcgagctcattcgcattccggaggggagggagggatgggggacgagtcggagggggagacgg

SEQ ID NO: 50531 - DNA, 230 bp, Oryza sativa
gtccatttcccaatccaacggtagtttccaagtttccactatatatgtggtttgcattacatattttcccactcatttgtccaacatcttaaatggtagaccgacacattatgccttaggtgacaattttttttttgcacaaaacatctcaaaagcaatatatctctctctttttttttctgcatgggatatatttgtcatttacttgcttgttgcaatctatgtacaga

SEQ ID NO: 50532 - DNA, 1501 bp, Oryza sativa
ggaaaattgaactcggtgtaaagttaagggacccaaatgaacttattcctttatatgaggttgtgcgtgttgtccatgggcctggacgtgcaaagctgggcttctcctagacaggcccgtagacggaccaaggcctggtagatgccccctggaccacgtctggtttgcacgccgggcgaacaagcgcgcgagctgaaccgaagagacgagcatcgggtcaaggtgatcgaagagttcagcacaaacctagacatcacacagatgcagtactagtaaaacaatgatcttgttgtatagcagcgctgctagtcattttgatgaataagaatgagaattactgctactcgaaactcgaggagttccatatctcagtgctgatcaattttctttttcgaggtggagtaaatcactgctgatcacttgatcagtataagtataagggcaagttttataatagatgtggtggtcacctccaattttatccacatcatccattcaaaaaattaaaattaacttatataaatgcattgcatttaatacactagtcccaatacacttgccaccaatcagccctcttattttctcttgttctttgaaatttgtgtggaggttgccccttgcatgagggatggctcctcccctctcttctcttctctcctccacatcattatttaagcatacatggcactttggagtttgtgcttagaaccttagggcaagtactataggcatttaagcacaatcacctagatgccacctaattttaaatgatgatgtggaggagagagtagatgagagagaggatgagccacccctcatgcaaggggtaacctcttcataaacttcaaggaggaaggagaaaagagtgaggttgattggataagagtgaataaaataaatatttatgttgcattgagactagtatgtgagctgcccttaataaattagttgatgatgtggacaatattagatgtgatagtcacctctaacataaaacttgcccttatagtacttgccctaaagccatcaggattattgttcgatgcttcaatagatacatctccattaatatttgtgatgaataattggctttacaaaagatttaatcaataaattggtttgaaaatatgtatgaatgttggtgtgaatgcgtgggactaatgtgggtcaggttgtgatatctgtgcttagaaacagttgttttgtctgattatgtgcaggtgacctgaggtcagccttggtcaatggtgaggaccggaactatactcagggaggagcagattaggtctagtgctgttgagataccatgtgagaaggtgactagagtcagtattcttagagatcaacttcggttaacgctggggaccgggactagactcagggaggagttgagatccagacggtcaaagataccggataacgaagttggatacgagatggcacaccatggatggacatcgtgtgggagagatcttcgcaacaggtttcacaaggtgtgcat

SEQ ID NO: 50533 - DNA, 1501 bp, Oryza sativa
aatatatataggagtacttcatatgttccattttatttgacaccggatactatatataaattaaactttcactgctcgtcttttttaaaatatatatagttatgaacatcgagaaagatatcatgctaaatataatcatactactgttgcattcatcacagcatctcgtaataaaaatcgtgattcaaaatttttttattggtgtaaaaggtaaaaaatcaaattggtcaacgtgtcaaataaaaaagaaacgaagagagtacgagtaacttccacgcactgccggccgttattctaccacgctagctaccaccatttctccattatttttgtgcgtgcatccggcggcggcggccactgcctccctcgtgccaatccaacgaggagatgcaatgcaaattatattgggacaggagatagagagggaaaaaaaggttaagatcaggaggagaagacgaagacgatggcaaagaagaatactacgtacactagctagtttctatcgtgcgctgtgacgaagactaacccaacatatggccggccggccgacatacacagaggcgtggctaaatggctaatggcattttcaggtagacagcgagctcgcttttgttgaggggtttatccagctcatacaacccactatatagaattttttctttttacaatgaaaaaaggcgtttacaattcaaccccactaagaattgctagcctgctcggtgaatatattatatactacacgtacccctttatttgatgttggtaagtttaattttgagctaaccacgagtatattgtaacgagagcattccactaatctgatatgaatgcatatgtgttacatataaagaatactactttgtaaggccgagggtcgatatggtaatatgtattgtcctattctatgcatgtcgatcactttttgaaatctttctaattaaatgtaatttaaaaatcgataataaattacatgtatactttatttcatatctaaacttttttaatatctaaataatactccctttatctatttttaatagtcatatttcatcatggcacacagaccaaggataagtgattctaattatcatccatttaaacatgctactagtcattcctcgtaaacaggcgatttattaatatttatatttctcgatgtccatgcagctaatcttgtgtggaagaatggagagtcacgcattaaattcaagaaaaccattaagatgataagttgttggattgaaatatgcctatcaaaaataaatttttcagatttgaaaatatgtctatcaaaaatagatggagagagtattatggtacagtgggacaacactaaatgcgagtgatttttacaatggaaacatatataattcctgatccctagactaactagaaatacacacagcggaatttatggatattgagatttgaacattgatgagtgtaatcatgcatctacgatttcactaccacaccgaactatgttttcccgaataggtaa

SEQ ID NO: 50534 - DNA, 1501 bp, Oryza sativa
  unsure (1)..(1501): unsure at all n locations
ctacatctgatcctgctactgaaaacaaaacaagcacacgacacctagaaggaatggttcacactaagagaagttttaacaaaggagagaggtggttgttggaatcaacatgtaattccaatagaaaaaagaacttgattagttgtagtaatccgtaagtaaacagaatcatatagataatggtacaagcctgacccagttgttgatattttttttaatctccctgtcttgcacgtgcggtatagatgctaatgtgatgtggcagcaccgacgtcacacctgtgacatctggccatatgtctacagctaatgctgtgttttgttcaatttttattaaaggcaaataaatatctatatctacggttgtgcctataccaattgaagttatgtcatatgaggcgttttcgtgctatctactgatgaaatttacctctcgtacatcagaaccgtgcaatatcattacttatgtcagtgtaacgggataaattggtagagtttttgagagtggaagcttcctgttttttcaaaatttggtaagatagcaataacaataatgagtttggtttgttgtcctattaaaatttggtaatgccaaaatttagtagggttaaaaataacaacaaagtaaatattccttagtttaaattgttttagttgaaggttaaacattaccaaaaattggtaggttaaaaatgttaataaaaaaagcaaagcccttagtttaaattgtttcagttgaatgttcaacattgctcacaaaatgttctcttaaatagtactttattattacaaagagcatctgaatctgtattaaaaaagtacaaaaaaaaacattctgaatctagaaagggaaaatatctagaagcgactgcacgcggcccccacgaaaagcccatgcacgtgggccccatcccgaaaaaagagcaacagcctcaccgcctacctgcatgtgcaagtggacggtgcgcggctgcgcgccgcaacgcgacgccccctntntnnnnnantnnnanaaccaacggncccacacgtcagctatacagtgggacccacccctccggccccacatgtcagcaagacagtgatacctcctcccccgcctcctcgcgcggcgcgcaacgcacacgcttccccttcatctcagtcgcgcggactcctcagtcctcacactccccacgaactcgaatccccaactataaataatccaccggaaaattcacaattcgatcgcctctctcgatcggagatttcgcaattttctccgccatggggagcctcccgcactgcctctccgcgcgcccgctggtcgtcgcggcggccccgggccggcctgggccggggccggggccgtggctgctcggcggggcgaggcggcggaatgcggcgttttcggcggggaacgcggggaggcgggtggggttgagaaggtcggtggcctcggcggtggaggtcggggtcggggagaatgagaagaagggtgtgtaggagtagaagaagaagg

SEQ ID NO: 50535 - DNA, 451 bp, Oryza sativa
ttagtctatgactaaatgattaaatataatacacgggtaaaatccctagtaattaaatccgaatttctaccgtgaaccgattacttaaaggattacccaaaaataatctataataatctataagaattcatctatttgtttagtaattaactacatctaaattattaccgcgaattgatttcttatagaaattgccaagaataatccataatttatattaaattttgcaattctacgactataattaatccataattaaattctaattattttcaattttctaaacttccctaatcttcctctaattactattttttttttcttttctttttctctcctcttttctctcttttcttttctttttctctctttttctctcttttctctcctcccggctcctttctttcttttccttctcttcctctctcctcttttcttcttcctccctagc

SEQ ID NO: 50536 - DNA, 1501 bp, Oryza sativa
  unsure (1)..(1501): unsure at all n locations
taaattctgaaaacttgcagatattggtaaatttaattcagaggaaatccaggtttaaaacagtagtggagtataaattgtagtatgttctatagaaaccaaatttacagagagcgattgtagatatctgataattcaggcgtaaaatcaattcaaaccccaaatcagcattggtaaaattaattcaaagtttcaaaccccaaatcatcaagttaatcccaggcattggtaaaatcaattcaaactcgaaatcatcaagttaatcccgtagtctttcgttgagcatttcagagttatacaattacttaaaaacatttggcacatctcacggctgaaagctttgaatttccgccaaaacatttcaagatttagtaaaacaaagctttaaatttaaatttagcgtatgctgctaattgtggcgcgcacacggtattctttagtaaaaggcgaaagaatagttcgctttgtgctcaccacgcagctgcgtgccttccaccctcacacccaaccccccttatatagccacctccccctccaccacccgcctcgctcgccgaggtggtactaaactcaaacccccacctcacacggccaaaccgcgcgcgacacccctcctcggcttccgccattcggcccaccaccaattcggcccatcacccatccggcccagaatggtggccttgtgggccgcccaggtgacgcgctgtcgctgtctcgagaagcgaggcgcattctagaggcttccggagatggaaccgaagcttctccggtcttcctcgccttcttcttctccactcgtccactcctctctcgacgagccccgtataaatctcccgccatttcgcttccccccttcgctgcgatgcgagaattaaccttcgagtgcaccgggattaagtggcgagattagcgacgtggtgattgattagtggagcaggatatggtggtgctcgtggagtcccccggcggcggcgtgacgctgaagaggaagggcggggaggagcctgagctgttcatttgccccggcgacgtcgacggcgggctcccgctcgcttgccgcgcgaccaaaatgaggcggctggtgcgcgatgacaacgcggcggcggcggacgacgtggcgatgggcgaggcgccgtctgcggcggaggtggcggcggtaggtgaaagggctatggtggtgtacgagccggtcgaatctgtgggaggcgtcggcctcctcggccagctgcggcggcggctccggccgtgggccagcctccgcgctggcgccgagtggatccgggacatgctgcggaggcggacagccggacggtgcggcggctgttgtccggcgccaaaaaagaaaagagaatggcgccggcatggcccttgtccgttggggctccgcgccggcagcggcgggggattcatggcgaaggatactgtgggcgtctcgtcgtcgtcgaaggaggagaagaagaagnacgccgagggctcagcgaagccgatggaggtcaagaaa

SEQ ID NO: 50537 - DNA, 1501 bp, Oryza sativa
tgagccgagcccgctgacgcaataatctccttttccttttaaaaaataattcattattgcgtcataattccattaaaatctatataaatgatttaatgcgatttaatctttaaaaattcataactaattcatcttagctcggatttagttggttcaagtctctaaatttttctaaaattgagatctacatgttaaaaatatccacatgtattgttcatgcttgtttatgtgctgttttggtgattttgttcttttctctttagattccaacgttcccggagagtccgaatttgcaggagaatattttgaggaatttcaaggccagcaaggcaagtcacacagatcccaaacaaccctttaagcatgttgatcccgtttaaagctattgtttctattcaactactgcatttattttcgaatgtcattgggtggaattaacctattgccttgttatagcccttttgttcttgattactctattccttgatacctagggttattataacttgactagttgagctttatatatgggttcagctggatattagatataatttcttagccatgcttagtaacattagcacactactgggataacttgtgcttcactattatttaatgatggcttaatgatacctcatgatggttaatcatgattggttaattaattaatttgccaactaaaacctgataatggtgggttgtgacatatggttttgatggttgtgctcatgaaaattaaggaccggttcacgattttcggttgtgaaacatttaccgtgccaaccacaagccagcgtgggcaacggctttactttctgtatagtatggttcttagtagagcaccagactgtgaagtggtggagataagcccacgggagtcactggggagtccataccttgtttacaagggggtgattatgatccgggaacggtgcactgctgtgaattgtattatatagagggtattgttacaatctctattcaggtacttgtcaagtatcgcaacgcatggttgacatgatgttgaggttgtgtcttgtgggtacagtggtacacctctggccagagttcaaactattcgaatagctgtgcccgcggttatgggcgggtctaacaatgtctttcatgtttagtttcacacttctcaccatattaaatgatgctgttaataacttgatagctcctggtttggaatagtatattcctggtttggagatagaactgtgcagccgggattggttgttcagaatggttgggcctatgcaacagggtatgttgtatagcgttggattaatactgtttaattaatattctactgttttattaaattctgaaatatttattaaatgctgtttatgcaaatgagactatactatgccatcctttgttatcctgtgcacttgcatatttgctgcgtggcttgctgagtatgtcatatactcaccttacaatcattcatcagaggaggagtttacagtgatgctgatggtgtggatga

SEQ ID NO: 50538 - DNA, 376 bp, Oryza sativa
atccacctaggaaaccgtcctgtacaagaaacaaactttacaaactccaatcattccaaattcggactccttccaaattcgattccgcatcccatatgcacacaatacctccatcgtatgccatatgtaatcttcaccaaccacgtgcattgaactctagcttaagtatcccgcatgatatctgaccgtcacggacgtcgccttatccccaagtcgactcccgatccatcaccggcaatactctcccgaggcatcaagtcacctacacatgaatcaaacaaagaaaccatattctgagaccaaggtatctccaacttgacttattgttatcaaacaacagtattacatacgcctcaaccctctgtccagcctaagc

SEQ ID NO: 50539 - DNA, 1501 bp, Oryza sativa
ggatggcatagtatagtctcatttgcataaacagcatttaataaatatttcagaatttaataaaacagtagaatattaattaaacagtattaatccaacgctatacaacataccctgttgcataggcccaaccattctgaacaaccaatcccggctgcacagttctatctccaaaccaggaatatactattccaaaccaggagctatcaagttattaacagcatcatttaatatggtgagaagtgtgaaactaaacatgaaagacattgttagacccgcccataaccgcgggcacagctattcgaatagtttgaactctggccagaggtgtaccactgtacccacaagacacaacctcaacatcatgtcaaccatgcgttgcgatacttgacaagtacctgaatagagattgtaacaataccctctatataatacaattcacagcagtgcaccgttcccggatcataatcacccccttgtaaacaaggtatggactccccagtgactcccgtgggcttatctccaccacttcacagtctggtgctctactaagaaccatactatacagaaagtaaagccgttgcccacgctggcttgtggttggcacggtaaatgtttcacaaccgaaaatcgtgaaccggtccttaattttcatgagcacaaccatcaaaaccatatgtcacaacccaccattatcaggttttagttggcaaattaattaattaaccaatcatgattaaccatcatgaggtatcattaagccatcattaaataatagtgaagcacaagttatcccagtagtgtgctaatgttactaagcatggctaagaaattatatctaatatccagctgaacccatatataaagctcaactagtcaagttataataaccctaggtatcaaggaatagagtaatcaagaacaaaagggctataacaaggcaataggttaattccacccaatgacattcgaaaataaatgcagtagttgaatagaaacaatagctttaaacgggatcaacatgcttaaagggttgtttgggatctgtgtgacttgccttgctggccttgaaattcctcaaaatattctcctgcaaattcggactctccgggaacgttggaatctaaagagaaaagaacaaaatcaccaaaacagcacataaacaagcatgaacaatacatgtggatatttttaacatgtagatctcaattttagaaaaatttagagacttgaaccaactaaatccgagctaagatgaattagttatgaatttttaaagattaaatcgcattaaatcatttatatagattttaatggaattatgacgcaataatgaattattttttaaaaggaaaaggagattattgcgtcagcgggctcggctcacggtggaccgggtgcacagcggcggttcacggaaacgaatggccgagatcgatctatccaaaacggacggccaagatctaacggtctacgaccggtctacggcggacggcgtcga

SEQ ID NO: 50540 - DNA, 1501 bp, Oryza sativa
ctgacttagggggtgtttagattcagggtgtaaagttttggcgtgtcacatcggatatacggagacacatttgaagtattaaacatagtctaataacaaaacaaattacataatccgcctgtaaactgcgagacaaatttattaagcctaattaatccgtcattagcaaatgtttactgtagcaacacattgtcaaatcatggcgcaattagccttaaaagattcgtctcgcaatttacacgcaaacagtgtaattggtttttttttctgtccacatttaatactccatgcatgtcttcaaacattcgatgtgaaagggtgaaaaattttggggtgggatttaaacagggccttaacaaaagaagcaaggttatcaaaacatcaaacaccaagcttctctcaggactgatgggtatggctatcacaattcacccataaaattggacagcaacatggtgcaaacaagggctgttggcagtaacttcagcatgacacttaacaaaattccagcggtaagcttgcaaacaagaagaatcaagacccataccaagaaaccatgccaatagcattaagcaaatgattctttcagaaaaccaaagaaggcaattcatcaaaaactatattcatcatcttgaaagataacattagtagtcataagaactgaagtcaaagaagcacctcaaaagtgtactttgggcaagaggaaaaagaacaacattgatcacactacacaaacattacatgagtcctggccatctcccatctagatcaggcttcttgacaaagatcgagttgtactctggtcgtgacatctgcaggtaaattcattcattcaatagttaaagaagacataactccagcccaaaaaagacctaaaagactatgatccaaagtacacttgatgtcaaggtttaacaaaatggacatgatttgctattcgggcatatcaaggcaacaactaaaatatcacgctgatacagtggcgttgccagaaaatttccacgcctagggctgagctaatgggatctcaaatattttcataaattacatagcatttttcaagattataatagggattatggagctaggcatggggcccaagccctagctgccccatgcctgattccgcccctgcgctgatacacatgaaaggttatctttacatttttatagagaaatcatctaccaacgacaaaaacaccattaatctacttgtcatacagcaacataaaacaaaagttatgtgtcgaacagtagtcggcaacatcaaacaagatttaaaattatgtatcgaacagtagtgttttgcatctactaaaatacccaatcttctatattttcagttcaccttcaactaaaatacccaaatcttctaatattttcagttcatcaaggccatgctgtaccaaattgatcaaagccatgcaaatcggtcacgaaccaacctatctctataactaaacataacctgttgttactagaggtgaaatgtgtaagcgag

SEQ ID NO: 50541 - DNA, 1428 bp, Oryza sativa
ctgagagttgaggttggtaattaataagcatccaatttcaaaaatattagtattgagttgcatgcaagtgtggaatagaaatgggcagcaacttttatttaattgcgcgacagccagatttgaactcgagacatctggctctaataccatattgagttgtatgcaccgaccagttcaacccaaaaatttaagctgatgagaaaaggcgggcaattcactttatattccaacaaatatcatggataaatacaagtttgatgtaatatcaatatacaagagattttgtctctaaaatatcatcgttgttagggttccgttagcatccttccattaagtgctatagaataaacaatgcatttaacggcgtaggatggacgaaaccttaacggcaatggcatttctgatactaaatcatttgtacgaatattttgtggaaactcggactcgtcaatagcatgttttagatttgggtgtttgtcaatggtatttcttggattttctcttgagataataggtgggtccatggttcatcgggttcacaatgacaaacacacgtttctttgaaggtagaggtgcctaatcccgaaagaaagagggagtggattttaaactctcgagaaggcatatctctattgtttgcatgctatctaaataattataaaaaattaagaagtatatgtgatatatcactgttaaaatttaacttctacaaattaaaaaaaacaaattaaattataaattgttaatgtatattaacagtaaaaatagtttttttggcaatatgtaaaagttaaattaagaatgttcgtattaatttatcttgttaaaaaaattaaaaaaaatttaaatagtttcctgttagagaggtggtcatgtgcgtggatcgcatggttgctacctaaccctgctttgttttggatgaacgccaatataatggaaggagtacatggaggggtggaattgaggaatagcggcagttcttttgtgttttgttttgtttttttgtttgttttttttttgaaaagttcactcaactgcaaaatcgaatatagagtacaactaaggtataaaactagtgcaaattaagttccccttggtcgctggttttggttaaactacttacgtggtgcattgatctggtctatcgtcctacgtggcgtagaaagaaactagtactatttatgttttaaaataattataattttatattgttttagcatatatcttgaagaagcaattgcttcttgatacaactggagtactagcaagtttttacccaaatgactgctttgcttttgagcatgccagtatggaatggaattactatgaattagagggtgaattatttacatgatgcataatcaattaatcagtctgcaatctggattgtctgtccgtacatgcatcgatccgtcgtactagtatcat

SEQ ID NO: 50542 - DNA, 1501 bp, Oryza sativa
gtgttaacgcgtaccgttatacctatgcggtaccttttataatttgagagacgattctacccttttctctctactagtaaaattatgtttttatccttagtacctaagtacctatatcaatacttaaatatctttaacatggtacctgtgattgaggagcgttggatctttacctcttttggaatgcaaacaccataaaacctctctatatatattcagctagaaatctgtaccagtgtgcaccaccattcattcgagtagaggtggaaaaaaaaactcgaagcttgtgacttggatcaattcaaactcatagtcttaatgagtcgatccgagctccgtttagctcgtgagcttaatgagctagcttgaactactcaagcttgagtttagctcgtttgtaaatgatatcatcatatctttgtatacttagtgcttgttaactagtccttcatttttttaattacatcaaaactatttgtatttagtgagtttaatgtttattatgttaatatattacaaaatcataattttgaaattattaacatgatataaatgagatagagctcgttaaccaggctaacgagcttaacgagccatctcgcaagtcaagccgagctagcctcttagctccgaggaattttgcgattcctcgaggtacttaaattttacactattacttttagtatcttaaggtacttactatctatactatctagaggtatcgaattttacacgtatctctgtaaaaattacctttcagctcatcaaaattaacaaactgagacgaactagctcattaaaataactgagttcaaacgagccaagctggcctaaattccatggtaaaagctattagctagcaatgtctccaccacgtcgatatcgatcgagtgcaccctccatttactaattacttccatattaaagctatcatcaatccatccaatatccatcgtgcactgacgaaaccagctgcattctgctcccagtaagaatcagaactcaattcctccacatatatgctctgcaaactgcaactctgcaactgcatccatcgattgatagatacatgcacatagctgcatctgcatttgtttgttcctgtcacctttgtaccatccaattccaaccccacatttcatcctcgatctttctggtttgccgagccaaacagagcaagcacagctagtagctagccaatattcagataagagagtggagtcaggaactcattagaagagacatctttaatttgctcatggccattgggacccaatcacccaacacatttgataattgatactccattttgattcctcttcttccccagctctagctatatataaaccactccaatggcagcacacaaattcatgaattcccagttcagagtttcaggtactctcaatctgaaacatatagaggagctagtagcaaagagaagtaattagagtgagcttaagtagtaattaattagaggaggttaattaattagggaaga

SEQ ID NO: 50543 - DNA, 1501 bp, Oryza sativa
  unsure (1)..(1501): unsure at all n locations
aaactaattatagaatccgatagtaaaccgtgagacgaatttattaagcctaattaaaccgtcattagcgtatgtttactgtacaattagttatttttttagcctatatttaatacttcatacaggtgctcaaacgttcgatgtgacagggtataaaattttagggtagaatctaaacacccccttactatttaatattattgccaatgtctatttcgagcaaagttggagatagggactcataaggaacacacgcgcctactgccttctctataattgacttgattttgctggacaatgacatgcatggctactcatttgaatagcaaattctaacggggccatctatatcattgtagggcttagttgcatcatattttggtatcatctttgctcggcaattagatctataactatatgggctctagagtctagactagtagggcatggctcgtcagtaccgtataattgtaacggtcaaacaaacactaaactagtaaattctcaacggggccatctatgtcactcatatttttaaatgtgtatataatatggaataaactgcactagtattatctggatgtcctactttcaactcaccttgctgntatatttccttgtatcatatccctggggcggaagaatggaacaaggcagcttcagtgggacttttttttccgcatgtatcagtgggttatgcccctctggcgacgtaatttggagtaaagctaaagaaaatgtccctcctacaatatatacaacttgaattctttaacttctgaggaagtggcacactaatacataattatctttgcagacctaccctgtttatttttacaaacagactataagaaaacctgcatgcaaaaacatttcagggttgtctagtaagacccgcatgtgaaaatcaatttttataaacaggtctctaaacatagccgctagtgtaaatacgtttatttttacaagcgactatattaagatgccgcatgcaggtatacgcctcgattttcacccgcgttagaaaatcacatctcaattttctctcaccctcagcttaaaagtcaatgtccatcatcctctcatctactcccatctcttctcctccacacatccactccctctctgtcccctatctcttttcctaccggtcggtgacgaccagcgttagcaagggagcagcgccagtgacaagagtgcatgcgcattcctcggctcctccttctcctctctctcctctctccctccctctcactcctatccgaccaactcgggcttaggctggacagagggttgaggcgtatgtaatactgttgtttgataacaataagtcaagttggagataccttggtctcagaatatggtttctttgtttgattcatgtgtaggtgacttgatgcctcgggagagtattgccggtgatggatcgggagtcgacttggggataaggcgacgtccgtgacggtcagatatcatgcgggatacttaagctagagttcaa

SEQ ID NO: 50544 - DNA, 1501 bp, Oryza sativa
gataactctcttatctcagtaaaatcttattagcaaaaaggcatatattttcttaaaaaacattggacaaacacatgtattcacaacacacacgtactcatccatacgaacgtatatatgcacactttacctcccaagcacaacaactatactgatatatattaagatttaagattgacgaactcattgcatatatctctgtattgacgggtacatcgtttaccgctaaaaattaattagccataaatacaaacaaccgtgggcaggtttcaccgccataactactcccttcgtcacataatatgagggattttagagggatgtgatacatccagtacatgtttagatttttagtaatatgatgtgttacatctcttcaaaatcttttatattttgggacggaggaagtaataagtatcttctgaatggatttattttaagtgtatttttaaggaaatgatgcgttgaaaaatgccaagcatttcatacagagtaacacccctattgggaaaaaaacgtttttcgccaaacatcccctctctctctctaatgtaatccaagagaaaaattggataaacaaaacgacgataaaataccataatgggattgagagggaacatgcagccctatcatatcgaaggaaaaaagagaaacaatatactatttgcaaatgaaaaaaaaaaatctgtgtataaaacttatatacatgttcttggcgatataaaattaaggcccctttgattcaaaggaaattcataggaattttagaggatttcattcttataggaatttttcctacaaagtcctttgaatcaaaggaatgaaccctatgaaatcctatgaaattcctatgaaatgcctcttcccatataagttttggaggaattttaacaagaggtagaacctcagggaaaaaatcctttgagtctttatctctcctaaaattcctgtgttttttctgtggtacaatcaaacggtcattcctacgtttttcctgtgttttgcaatcctctgttttacaattacattcctgtcaaaaccctatgtttttcctattcctccgttttttcattcttgtgatttaaagatgccctaaaggttaaaaaataaactacgatgagaaaatttcttaaattaacttcaaatttaacattaataatttaaattttaaccgacaagtataagtataaatgaaaaaaaagtgagtccggtaaaatgtggttatcaaatcataattggaagcgcaacgcgaaggagagacccgttgccatcggtgtgtatcccacgaaggaacaagacgaacgccaaggctcacatgcgacgcgacattgcctacactgtgtcacgttcgttgctactcctccttgctagtgcttaccacccctctccctcctcctcctcctcctcctcctctccccttctctcctctcctccctctccgccgcgcgccggtcgccggagtagcagggtgactgggagggattcagcgaggcaaaaccaa

SEQ ID NO: 50545 - DNA, 308 bp, Oryza sativa
tgttcggcccccaactgtttcatttctagatcgagaaatagaatgaaaaaccatcgaatacccactgcaacatttcaaatataactaatcaaacatcatagtacatgcactgaaacatcaaaaaattcaagatgaaaacctagatctacctcttcctccactccagtggttagcaaccacttccgcgtcgatgtcgtgacgagctccaccgcatccacgtatccaccatcatcgatgctgcatgaatgtgacgccccacactttccgaggccgggccctctctacatctggtagctttcctaggaaag

SEQ ID NO: 50546 - DNA, 646 bp, Oryza sativa
aatggaatgtaatatttctttggcaaagcagtcaacaatatccttttgaatctcaggagctatcataagacaattcttcgatgcatttttttctccactaccttgcctaaagcaacatcatgctctgctaagaaatcacgaaactctaagaaattgcctttgttgtatgaatcacttgattcatcatggccccgaaaaggcaaacctagcttaacaacctcctagcaacattaattgatccatttaatcgaacaaaatatgcatttttagtagcttcgctttgcacttgcatatgtatatcgatgtgttgggctctttgcaacaaagcatcacaatttttcatggcttgattatgtaagctaccaacaccactaacatgctcttttagcctactttttctatgccaaccattccaaccatcaaccacaaaggctttatacccatcctctttcttattgcgatctctaaaacaacattctctgtcttttgccttgttatattcaagccaacttccaaattcatcaaaccattcctcaataaactttctgtctttacctgagatctttgtaaccggaaaagtgaatagacatggttggcaaggccctttctgcaagtatttccttctgactatatccctcttactagg

SEQ ID NO: 50547 - DNA, 488 bp, Oryza sativa
tgtgttactggtcaagctttctttggcccatgcccataataattgcctagtagacctgttatagaaaactgctggattttatgcacactgctactcttgaaaactttgtagagttcaattaattttattttagcggaaataatatttcaccaaaaaagttgccttgcaatctgaggcagcttgtaatttctctgctgcagagttgttcaagtccacttctcattatattagaggttgttttatctcactatctgtacttctgagcaaatttagctcaggaaatagtgcagtaattatctggatcatatccaggttatcttattgttatagttttcttcgcttagtgttgcggcctaaataacagattaagctgtgatgtgcttctgattaccttaaaagattgcagtatcacactatcacttatttatgttgcaaattaaggaatcagcttcagctgctcacaccaatcaagcttttgcttttgcagg

SEQ ID NO: 50548 - DNA, 369 bp, Oryza sativa
cactttatttaagtatatatcgatatgaggagtatatatcgtttatatctacagccgatcgagtagattagttcttctttacttattcgtgactgccgatcgatacacagatgacatcggcccatagataaatgatatgtcatcggcatctagccgatcggctatcatttatagatttaactacggtttctttgtttctatttcttgttgattataggatcaaatcaactggcatgctaatacatccgaaggcgagctttggacctgcactggagttaagcagatctcccaggccatgtgttttctgtcaacacgcttttggcacgccctgtgggacctgattagaagtcagacgtcagttcttcctca

SEQ ID NO: 50549 - DNA, 198 bp, Oryza sativa
tgtaatactgttgtttgataacaataagtcaagttggagataccttggtctcagaatatggtttctttgtttgattcatgtgtaggtgacttgatgcctcgggagagtattgccggtgatggatcgggagtcgacttggggataaggcgacgtccgtgacggtcagatatcatgcgggatacttaagctagagttcaa

SEQ ID NO: 50550 - DNA, 1035 bp, Oryza sativa
tatgggcccagggttatgcgaagtgtggggaatctaccttcccatcctgccatgtgtccttacagcctgggtcctgcccccgcagtctgcgaaccgctggagcagccgggggggtcggggcctcggggtgccacgtcatgcccctcgggcccttgcaccgctttgccccgaggcccacgcccagccaccatttggcggggggagcgagcgaggtgagggtctaggttgagcctcctttaatacgcgcaatgcctcaactaccccctgtcgcatttaatgcagtgagacagacgtgcggcgtgctaaactgacgtgccatagtcaagaatgaccggtctgtgaccggcctgacaccgaccgtgctcccacgtcgcatttgcttccggcggagtggaggtaggtatgacccgtcccatcggagggtcattcggacggcggccaccacaagtcttcacccattaatgagggaatgacagggctgtctcccgtgtcaggcgagggacggcactgggccccattcaaggacaagctgtggttcaggttccaggcgaaggcacgggtcgagttccggtcaagatagggtgggaccccacccgaaagaagagtaggtagaggcggtgcatgtggtatccccttgagatataaaaggaggaccttgcccaccgagcaaagggacgattctcaactaacttgggctctaggagaagagtgttctcccgagtttaggaacctttgtaactctcaatctaaatcccaaacacaggagtagggtattacgcttctcagcggcccgaatttgtataatttgattgtgtgcgagctagctaggggccttagggacggatacgtggtttctagaagcgagcttcttcccccggccgaactcacgaaaggggggtctcacgacctcccgctagagaggatcatccctcgacagctggcgcgccaggtagggggagggcacgcgctttaaagagaagtcgtttccttccgtcccaagtttccctgggccctcgacgatcatggtcgaggtcc

SEQ ID NO: 50551 - DNA, 1501 bp, Oryza sativa
aaaacatcttttctactcgttaaaaatcttaagcaagatgttattttaggaacaccgtttttatcactcattcgtcccttccttgtcacaaccgaagatattcaatttgagataatgggcaaacaggtgagcctaagattttcgtctaacacagatgagattcttgaccagcttgtttagaccaaaagagaacaagttgtgaatacaatatatttgcatgacaattctttcccatcatatcttccaaaatctatggacttgccatgtaagacatcatgggaagatagatatttattaaaagctactaaaaattttgaatatatatgcagggaaatggcttcacagaagtctgaatggttcacgaatatgagttcatggagactgccccaactgcctagaggccatggagaacgatttaatcacaatttcagagtaacagagctacaacaagggttattaaaccacttgtggcaggcaaaaaacaaaaaagaaaaagctcatgccttaaatggcctggcatattatttcaaaaatttcgtgccctcagatcaaaagataacagaaaaaagggctaaactacaagatatccctcatcatgaggagagattactagattatcgcgaggagaaatcccgtgatggccaagataaacttcccatggaagttgaacaatctatggcaacagataagaataccaaggtattctcagataagattttgatctcaacagatcctgcttcgagcatggttgctttccacataaatatcaataacctattgcaatcttttccacataataaaccatcatcatccacaaaaaggcatgataccattccccaaacaccatacatactgcataatcatcccaattcattccttccacaatatatactccggacccagccaaaagcaccatgtagatcttgtgcctacaaagattcttgccaaaagaaacttaaaagccaaaatcccatgagtaccacatacgaaaatctccaacctagattaagcttcaagacggagcaaactttatcttgctttgggcaagacatcctcgatcttgtttggcaaaagtttaaagagagacaaatgaaaatattccttggactccaagattatttctttgatctcttagaaggaagagaaagaaacccagccatacgagtaatcatatatatgctccctctcttaaggctagatgatcaggcaatctctgacccatcctatagattcctggttctcaaagctgagataaatctccaaagattccggaacctacccacatacaaccatgaagaaatatctctccaaaccattatagatcatggtcttgtgaattccatctatgcaaccctcgatcagatccttcaatctgattttggaagcgatgtgaaagatgtctgcaggagacttggaaatggaagatacaggattatcttctcctccataccaccaaaattcacaccacctgttcgtccagcaattcattatatatatatca

SEQ ID NO: 50552 - DNA, 1501 bp, Oryza sativa
tgtactagtactgatatgatttgatacatagtataatgaatttggccagaggtatgtctaaattcgtagtactatgatgtgtcacattcaattttagattggttttttatggaactgcgagaggagtacaaaacaacagaggaagtagtacaattatttatgctgaaccagcttcagtaataatcatgcagtaatcccagaagcagttattccaaacaggcaccagcaacaaataaacacatccagtcatgggggtcagaaccaccaccctgatggatcttggctctagctcctggttttctttctttgctccctccctgcctgtcacccagtcttgggatcctccctgttcttctctccctcttgaatcccccaagagcagataaagagaactagtactaataccactacagttaatccttaagcacactgtcatttgcactaataaaaatctcattcttgtcaggctaataatcacagtggagctagatcatctcgttttcaacggttggtagactgtaaacaaagtgcaaggccgagctgagctgagctgagctgcagcgagtgacagctccacagaaaagcaaagcaagcaagctacctctctctctctctctctctctctcggtagcttctctctcttgctggctggctctctgcgcgtggtgtgtactcctgctgtccctgctgcggctacagctactgttgcagctcgagcacccagaaggccagaaacccagaacaagtctcacaccctcctcctcctctcgtccatactagcaccaccgctgctgctgttgctcctgctgctgtgctgccgccgcctgctcgtccaagaatcttccagctttccccaatactgagcagccaactcctgctaccgcttcttgatctgtgggattttcttcttgtttcgaatccaagatcacttccaatccatagttttggcttttggcttccctccagcatcagtgaaaattggttctttggaggggaagaaatggatagcggctggatatgcttcttgagccagattgctgatttgatgcaataaggtaaacttcctcctttttttttctttttctcttctcacctctattggatggttcatctcttgaattagtttctctctgtctctctcttttattgatgaaatgaattagtttcttgtttttgttcctatcttttgtgggttagtatattggttgatgtattccaacctgagtttaatggggatatttgttgtctgaacttgtcaagttctatggatctcaatatgagacacttcatttatgcttaataaatcgattcccccagagatatctgataatctgaaatatactgttccaatagcttgttacagtaagagtaagttcttgtatgcttttcttgcagatttctatcttatttcttgctgcagtatcacaaatcaaactaggagaactgactgagaagtgaaatattctgcttccaagaatcaatcagataaactgattccaag

SEQ ID NO: 50553 - DNA, 1501 bp, Oryza sativa
tcctgcgttggtgttacataggtaatgattatatttcataacaggcaattatgcagcaataggcagggagtgttcattcctcgtatatgcctgagtgtggaccaaagggatctaggagttggctctggaaggcatatgttactggtcaagctttctttggcccgtgcccgtaaaaaatgtctagtagacctgttatagaaaactactggattttctgcacactgctactcttgaaaactttgtagagttcaattaattttattttagtggaaataatatttcaccaaaaaagttgccttgcaatctgaggtagcttgtaatttctcttctgcagagttgtttattaacacaagtccacctctcattatactagaggttgttttatctcattatctgtagttctgagcaaatttagctcaggaaatagtgcagttattatctggatcatttccaggttatgttattgtcatagttttcttcacttagtgttggggcctaaataacagattaagctgtgatttagaattatgtgcttctgtttaccttagaagattgcagtatcacgctattacttatttatgttgcaaattaagttatcagcttcagctgctcacactgatcaagctttgcttttgcaggatgaaggtggaggttcatttactggtgttgatgatcttgctggagcattctcaaaggtttgcttttttgaaaagcatagctttgtagccacatagtattaatacacaaatgtccaattattgggatttgatccaacagaaacatggtgtatttttttggtagaaattgcagaatgtagattatagttaaataaagttgcaaactcttgtatacctatttgtatgcttgcattgtggtattcttttttaactgtgaaaactgatttgttgatttctccactcagttgaccagaagcatcaatgaaccaacacaatcgggcataattagtcatgggggttcaatttctagacaaagtgagtaatgccctgttttgctcgattgcaattggaatcctttgctacttctttatgtgtttcttcaattcacgtgcatgggtatttgatttatttcatttttcaaggatatatgtaagattcgattcgttacatctggccaatgggatggacatatccattaatttttcattgttagaatgtgaatttcaatacatttttgcacagtctttgttctcttgttgggtactgcaggattatatatggtttctgttttattaacattgtattctaatgattcaatttgtctaggttctactccggattgggcacaagattcatattggcctacgcagcctatatttggagctgaacaagggctggataatgaaagccggtggtctcaaccaccccatttagcccgctttgctgattctagactgcacagaacatcctcatcgccgcagcaagatgctcaatacaatcctaatgaacatattcttggagcaatgccatatctgttgcataga

SEQ ID NO: 50554 - DNA, 1501 bp, Oryza sativa
ataatagaagcctgattcaataatagaagccagattcaatatcataagaaaatagagattgtagcgtagagtcaggctatcccatgtttgcaataacagctttgggatctttcctgttaatgatgaatagcttgcctcaacagagaatcagaatactttttattcggtataacaaccttaaaaacgaatcaatctagatgccccgctcttgccatctttgatggaattgaatcatcaactgacttacttgaggaataaaaaaatctgcagctttcgattcttgtctatcggattctattgagaagaagggacaaccatccatcctcccagaaactagtttagtgcctgaacgagattggtggcacttatgacgagaaaacaaactctttcttctgttcaaaagctagtagtgccgtagtgccaatctactccgaagaacaagcttctttgcaaaactactttcttctacggagctacctccgtctcactcttgtaccgaatgctacctggcataacatccttacttaaatatcttccgctctccagacttcaacagtgccatcttccagtaggaagagaatcttttcatcctcccacccaaccaagtaggcttcttttctataggaaatgctgtcgatatttcctgctaaatcctgcttatccaaggagagagatgatggccggcctatgcactgaatgtgctgtgttctaagatatcttgaatcagatcaacttatccggtatccaagctaaagcaagaagaactatcgggtgagggcatctttcttttcaatgagggaagggttctatatcagtaagaccatcacagcacacccccaaccctcttctcttgcttgatagggtcaaggcaggaaatatagcatggagtggcgggggaactatttgcttctcagcccactgatgtatgtatggcttgctttctttaatcagaactcatgactatggattgacttcaagaatacaacaaagggttgtggtgaatcccggtgtcggcctagatagaagacagcaaattcattattcattagttgcaatggggtgcccttgaagtgaatgaggtattgcaaaaactaaatcaaaagatgcataaaaaagaggaggtcctccgtgtacagtagtgaaacacaaggaccaatcctgaaagaccactcctccctacctacggagtttgacaaagtcatcaattgggtcaaagcagaaagaaatgttgcgtgatcaagttaaaaaaatggaaaaaaggaaggtgatccatggcccgatagaaaaggaaaacttgaaccagattatattagatcttcgccctagtgaatcatagtcagaaccaggggggatcctcataggactgctcgtgagcgtaaagagtacttttgactggaatagggccttcctttcttttgaactcttattaggtagcaaggagaaattcaagtatgtgttcaaaacaaaatcaacacacaagcccctgaagtcatttatttgc

SEQ ID NO: 50555 - DNA, 1501 bp, Oryza sativa
tgatataaccttttgtttgcaggtttagtcttagtctttgagtgatgcgggttccgattgcttcttctaggatgagaacttaatggggtaaacccctagtcggtgtgcttgtgattgggtagtcaagcttccgctgttctctaataagtctatttggccggtcggcctatgtaattattaagttgttgtaagtcttaagtttctttcatcttagttgtgtttgctatgtataatcatgcttaagatgaaagtgtgaatctagtgcacatcctgggaactagattcacatgagtatgagttagggatatttgagaggttgtagatctttagccatttttgtcaagtctcctgaatgtgtaacacatctgatcgccgccttcgagtggtttgacgggcacatctcaggctgaagttgactggcaggctaagggcccagcaatgtctctaaaattcctctctcgaggcattggatgtttcattatgctcgtttgatgacttgaattacgcatttcatctctcaaatataatggaaggtccggagagcctacgacataatgggaggctgaaagcgaggggaaaccgtttctcatgtgggtattagcaagttataagacaaagagagtcgttagtggaataggtttttcttgtaggagagagatcgggaatccagacaacagggctagggtttggggctagtgcggattagtttgggcggaaagaattgaagagaggagaaagccatgaccgatagagctcgggttggatagggaaaggaagaaaaaggggtagggtcaacctaaggatttaaaacctaagcttaggctgacgactgcttcgagagcagatagaggatcctcttctgggcatgaatctggttttcaaaaagaaaaaacctttttactaaaccatatcgacgagcaatgaatctaatcgcaaaacgagaaatgaatccccaacgaatgccaaacgaacaaaggctcctcttcttttccggtgtatcctttgcccaaaagttcttaagtaaatttagaaaaagaacctaaccgtcagtctgaactcccaggaaatgaatagctaacagaaggagtcactgttaagtggtttctatgtgtgctcttgaaagcgcggctaatatagctcggttaatgtagtgattgtggtttccttttgtctagtggattaatcatggtgcaattgattggattatataagcatggaagttcgctaaagtttacaccctattgttaggccttattctaggcttgaatgcgtaagaccgaaactcaaggcgggagagataacctccgtttgctggatcttctaggcacttcaaacagaaaatctacttatccagtaacaggggacggaacataggaaggagacacgtgctacgaagaaataggagattgtcaaaaatagggaaggctacagatacacatgatgctaggctaacaagtatcttcgtttgaccctggattggggttaaatttcctatgtttaa

SEQ ID NO: 50556 - DNA, 1501 bp, Oryza sativa
gacgatcccgtagcaggttcagacaggccacaacgctgaatgagttccctgtacgcagatctcaccgtaaatatgctcgttttgtcccatgcccaagcccaaaattcatcttgctctgttctcggccttggcatgttcagaatagcagccgcatccaatggaaggaaaatccgctgcaccttctccacatcccattggtttgtattatgcaacatgagatcggcaactaactgaactggatcatcagtcattctccctaacggcttcattgtttagtagtccatctatccattgatcatgccatatttcagtggtacgaccatctccgatcctacagatcaatcccattctcagtacctctcttcctttgatgatccaagtagacgaggcacctcgagggcaattagcagatagaatatctcctcctttgctgtatctccccagcaaaacacgtgcacaaagactatcgggcctgtccagcaattgccaagcttgtttggccagcacggcatcgttgaaactctcaagatcccgaaaaccaagtcctttttcattaaagaagcaaataaatgacttcaggggcttgtgtgttgattttgttttgaacacatacttgaatttctccttgctacctaataagagttcaaaagaaaggaaggccctattccagtcaaaagtactctttacgctcacgagcagtcctatgaggatcccccctggttctgactatgattcactagggcgaagatctaatataatctggttcaagttttccttttctatcgggccatggatcaccttccttttttccatttttttaacttgatcacgcaacatttctttctgctttgacccaattgatgactttgtcaaactccgtaggtagggaggagtggtctttcaggattggtccttgtgtttcactactgtacacggaggacctcctcttttttatgcatcttttgatttagtttttgcaatacctcattcacttcaagggcaccccattgcaactaatgaataatgaatttgctgtcttctatctaggccgacaccgggattcaccacaaccctttgttgtattcttgaagtcaatccatagtcatgagttctgattaaagaaagcaagccatacatacatcagtgggctgagaagcaaatagttcccccgccactccatgctatatttcctgccttgaccctatcaagcaagagaagagggttgggggtgtgctgtgatggtcttactgatatagaacccttccctcattgaaaagaaagatgccctcacccgatagttcttcttgctttagcttggataccggataagttgatctgattcaagatatcttagaacacagcacattcagtgcataggccggccatcatctctctccttggataagcaggatttagcaggaaatatcgacagcatttcctatagaaaagaagcctacttggttgggtgggaggatgaaaagattctcttcctactggaaga

SEQ ID NO: 50557 - DNA, 200 bp, Oryza sativa
attagtctacgattaattaggcttcaaatatgtgctcatatactttaaaaacttacacgtacccaaagaactaaacacaccctgattgcctttttggatatgcgtaacaagtatgggtaaactacactaattgtcggactgccttacatcttccaattaatattggcattatatctcccttggtgttttagttcctgaga

SEQ ID NO: 50558 - DNA, 1501 bp, Oryza sativa
aagtcctttatttatatacaacacacacatattcctttcaacttacgaacatgaaaatccagtggatggtttggaaggctggaagagtgaagaaaggttctttacccccggagaccggctttcgtgaaagcacctttgggcgatggtttctcgatcctctctctcacttgaaggaagatagccactatatatatatatatatatatatatatatatatatatatatatatatatatatatatatatatatatatatatatatccatttatttattccaaattttcagtgatttttcaggtggcgactctaaacccctttttcttctactgggttgcttaggtggccaaagtaatgatgatgtggcaagcggtgccaaaatgcgggcgtacaacacgcgactccacaagggaataaaagccttaaatcaaaggtttttggcttataaatataaatggcttgacttgaaaattcaccaacattcccatttctttcctttgtgaaaaatgtagtttgtataaactaagggttaacctatttgcaataagcacacaccacctcactacacctaagcattgcatgcatatgcgtcttgcatatctggaattttccccaaataggaaaacctggtgggaagtcttggttggcatggtccaggggccgagtcatactatccccaaaaacccaccacctactgtcaagtactcctcttaggagggtataccaaagtgggggtgcatagtaccgcttgaccagtccgacgtcctagagatgaagggctgggaggtactccctccgtccctaaatgtttagctccgttgccttttttaaacatgtttgaccgttcgtcttattcaaaaattttaagtaattattaattttttttcctatcatttgatttattgttaaatatacttttatgtatacatatagttttacatatttcacaaaagttttgtaataagacgaacggtcaaacatgtttaaaaaagtcaacgatgtcaaacatttagggacggagggagtatattttaaagccctcattgctgtgggaaccttaacttgtgttactatagcctaaattccatcatgtagtggtcatagaactactgaagtttaggactacccagtaggatgcacatgagcactaagcaacactaagaggtgatttggtttttgtttttccttggcatgggaaaagatggattagatgctctgtgaatgtgtggctaaacctgtggggctgtatggtactttagccggactttacaccagctctattcactgatagcgttactggctcttttccagcatttcttgaaagcagctcgcactcaccgctgcgcgcctagttaggctttgaaataataggaacaaagatcttccgcaatcaatgttgtactcaaatcctctctggccggagagggggatctcttaagcagagtattccgagtctagggctagcggaagcattgaagagggatatcattttcaaagaaggca

SEQ ID NO: 50559 - DNA, 550 bp, Oryza sativa
attgctctaaccataagctatggcaattccagttcgcacccactctggcccgcccagcgaggcctgagtgagctcagtggtcagcccctgacgttaggggtctttcgcttttgccagatctatagagatattacgagtcctccatcccagattcccttgccgcggccatctggttcaccggtactaccaaaaagtctcatgcttacgttactgtgactgatatataagtttgatcccagactacgaagacccagtcgtgcttctggtttccattctcatcatcatattgaaggaaactcctcgtgctcttccataagaacttggagtccgtatcatggtgaaggtaaggtaacgctgtgattcttgctcaaaaaactgaccgaacacgttcgagttattggctcgtccgacccggacgcattcatgagtcgctcgttcaactgtccctcggagacacggtcgagaattgccatgtatggtcgcccccccctcccccgtcctttctttctctcggtcccaccagggcgggcccctctgtggtaataaaaaa

SEQ ID NO: 50560 - DNA, 1501 bp, Oryza sativa
gaggtatcataccaaggggttgaagaaagggtttaaccagcggattcgcatatctttttccaatggcttccgcatccctagttttttaactcctggtttcgggtaacggttatgggtttggcccccttcccttggcgagcataagaaccattcgtatacgttaggagcagaagttgacgtgggtatactcttcatttcatccttttcattgaatcccctatcctattatccagcaacgcccaagctgtcgatgatcacctagctcttgttggaagcaattgaagtatactctacatcaacatgggattgaaaaggtgagggcgtagcgagcgctagagctattcctacgaaaaggggagctattcctatgattcctagtatccgttcatcgatagactgtcctcgggcaagggaaatatactaacactattactcaacccataataccctttccaagggctcaaaacgggtctttgctacaatccaatccattttcaaacaaaagaaaagagcaagttcccacaggcgaagagctgcttccgagaaatatttatcttcttttaccccctttacgcccttcgcggctgctaacaatgagctaatacacaggaacggcacggctcctacaccgcttaactccaataacagaacctggtcccacatcccttgcatttgataatgaaacaatcagaatttgttgaattgaacatatttcaatctcatttcttttacgtggttttggcaactatcaattatctctttcctcggcttcctacacggatatagccgtaaacggtatctagtaggcaacctgggaactacattagcttagggggatcgggtagcgagcgctctcctcggcaaagcacatgattgagatttgaattattgtattgtgaataaaggcatgaaaggaatttaatagtagttaggtattaaaaagaagatctaattcaagtggtaaagcaagtatataatgatgataaagtccagaggaaaggaatattgtttcacgcctgcatagacaagtaagtctgccacgaacccctgtccctgccaagtagaaagctagtaagcaagtactgaacttcaatcctgcattctcactcttgtttttgtcgctcaatccaaagaaagaaataggaatacgaatcctcatccccaaagcctgggtcctagactactacgaatagaaagatttctatggatatcctttgtatcaattttataatgcttatcacctccttctgagctattcccacggtgcctgagcagttgccattgagaatgttgtggggaacgattgggtgacttagcacaagcagcgcgtaacaggtcctttgcagatggtaagtacctggatttcagaggcattgctagatgtgtcgacttgcgagacgagattgcggtgtagctcttgaaagaaagaaaaagaggggctcagtaacggcaatcaacggctcctcggaggcaacctagccaattgagtagagatatgaaa

SEQ ID NO: 50561 - DNA, 1501 bp, Oryza sativa
gcgggggaggcaggtccagttaacggggagaatccgctaggctgaggttaaaaaaatcttccaaaactttttctttagagatagaattcctcccgagaacacacgaaacaaaaatatgaactaggtaaatagaaatggaaaagagatgtttccaattcatcacaaaatctaaagctttttctacatccatatgatctactttagtagattggtattgcccatataatgaaagcagatcttggtccatggagtcccaagaaggttggaactccaacctgtccgatgctttttcggccaaataaatagaaaagtgggaccagcacaatgagcaagctgcgcgaaaaaccgcttctttttccggttccgcaacaacttgggcgaaatggggttctaccgggaaaccatggtcgagtttttgaccttggttactggtcgagccactggataagaatctctggagatctttcctctccacttacttgtaacaggctttccctctgtataagacttcttccgaatggcataattgtcctgtcctattgacacctcgatctttaaagaaaactgactcctccttctcttttaggatttgattgttgttggtccttttttcagtaatgatctcaccatagtagttcgcgcgagggactatcttttctatcgcttgcttttcactctcaagacaacggtcggtctctctatgctataaagcgaagcaaagcgcatggcgctgaaagttaagaaagctcaaaaacacacacgaacacaatgcaaggcatagcataaatgagaccgctgatcattttgcttgacctttttctatgctttttttgggtgactcaccaaccgaccgagcagtgatcgatgacaaaatggtacgaacaaatcatagtcgttgaccattataccgtgctatggcacactactagatagattgtatggctccgttggtgactttctgatcacgggtttcatttgaaaaactccaacgccattcatcttgcgtccggtctttcatgcaagagttttatttttggccgctactacgttcgtcgaaaacttcttgatggcaccatcatctcattaccttatttttgcccttcgacttcggctatgaccaatgccccacctagctgaataggcgtaacaaagctacctgaaaaaggcaaggtgcaccttagattgaaatcgacaaattgcgttttgccagatggattctttagaaagattcccggataaagttcagtaaaatatttagttagaatctaaataaaggtgcatacgtgggcgggcagggggccccactacttcttcattcaggggggctagcctcatgacttcccactgggcgaggggtgcgcctaacccacctactcattcatcaattacggtgttcagctgacttgcacagaaagacccctattgtttagtaatttggcgccccatcttttttttgattgactgttgtcaactaatcttttcaatgttcgattctactcta

SEQ ID NO: 50562 - DNA, 1501 bp, Oryza sativa
aaactcacgccacgcacgaagatttttctattgatagagttaagggctcggctcccctgactctaaaaggttaggttactaccaacttgcctctacggaagaggtgtactttgtattgtctgggggttatattatgggacggagtacaagttgaagaaaaaaaatattaagtacatattagttatagctaagaaacggtgatattgtttttcatatataacccttaaattgatacccgagatcttctatagctgctgtagtagatatatccatttttgcagtaaattaattattaaaaaaatagggcacaatatagcacgagtagtgcacgagacaacaaagaaattattgatgaggtagctagctttaagctgttgtgggaggtcatcgcctcaccaactgcatgctaaatatatcgatagatatattatgctttgttatattctgtcttgcctaaccggccgcatctcccccttcctccactcactttaagcatcgatcactgcttggtactactacgtcgcttaatcacttcttgattcctttgctaacctactactccactacttggcctgccacagtttgatagctagcttagctagctagcgatcgatcgacgtcgtcgttgatccatcgccaccggcgccggcggcgatgtgcctcccgttcctctgcggcggtgacgaccccgtgaaaaatagcgaggtacggccgccggcgaggcacccgagagaaggtccaaacgacggcgacggcggccacaagccatcaccacctccgcatgccggcggcgccgtcaacggcaacgggggagctgctccgcctgctccggcgacgtcgccggacaccgaggtccgggcgcccacctatggcgataaacagatcagtcctccgaaggaaggcgcagctgggaagccgcctatggtggtcccggcggcaaatcatccgcaagctcccaccggcgaggaggctaagaaggctcacggcggcggcggcgccgtcggtcgccgcaatggaatttcgtccacggtactcacggcgccgccgccagtgggacccatggctgctccagcgacgacagtgaaggatgctcctcctgctgctgctgctgctgccgccaacgacgtccatggcgatgctgatgagcaacaccctggctatggtgatcacggcgaggtcgacgaccgcaagcctcgacgcagatcatggttgtgaggtgagcaatggcacgcaactacatattggctgtgctgtgaattgtgatcctcgttctttatgcatatgccgctctcggcgctgctggctggtgatcaacgatgcatatatacatatgtgctatatatatttttacaggtttgcaaaaaataaagagacattagttgctaattgttgttcttgtgccctaactagtttgggtgtaatattgtgttaattgttgtattttagtatgtgcacttgtatgggtgttgatgaatcatggacatatatcagtattgcatga

SEQ ID NO: 50563 - DNA, 1501 bp, Oryza sativa
tgacttcaaagtttaaatcttaggtcaaaaccttgaaagttcaaatttcaagttgaaaattttaagaatagtttcagtttgcgttgaaagttagaaagttttaaattttacgtgaaagtttcttttagtatagatttcttttcaatctattagttaaaaaaaacaaccggagaaaagggaagacttaccttaattattgtcactatctataactaatacaattattagttacgcttattactccctaaaaacgcgtgttcgcagggcgcgcgccaactaacttttccgatatacaatgttgttgtatcgtactcctttcttcctagaaagaatcgatttctggagagaagcatttgtcccagaaaaaagcgattagtgatgcattgaatgagatagcagtacagtcacagctgagcaaccaggatagtagtctatccacttgttcacgcaaacttctctattctctctcgtttctctcgtctactccctctctcattcacacatgcactctgtacgagagtagtacttgtgcacggaagtttgtttttttatttgaatgatggaatagatgttgtacttatacaagggtatttgggtctttaatagtggtagctaaaattgcctcgggtatcagaattgctatttttggggacagatggagtacctgtcaacgtatagtaacaaggaaccttaaaaaacaaagtagaagaggaggaggaatctgtatctgtgattgatgtaaatgatcagcttgtaaggacatgtacaatggttgttaatagtggtctcttagcgttgctaattaggaatacttgttgacatgaaggaaagagaaagaggagagacaaaacatcggggattgttatgcatgacaacagcttaacaacgacttttagtcactataatatagaaatatgattgcatgaggataaaaatatgaaaagaatattaacaaaaggaatattttttgagttaatgattagagcttttgtcgtctcaactattgtaaagacatggtctctaaataatcttgtattgtttaagaggtcatacccgtctctatcattgaacatgccctaataatgcaagctagcatgatctgatgtgtacgactgtaactgcatgttctcatcaaacgctcaatatagtatcccgtttgtcgtcgttgtatccatctgtcaacatagaacaaggagctctttttaaaaaaaagaaaaagaaaaagaatctgaatagaggtattacgtgcatgtttgtccggaaccactatcgctaagagaaggctggaataaaacgcagcatctatcttttcactctcgcagtgatgtcccggtcaagttagcttagctcccggccggatgggcccaccaccaggagaaatattctgatgacgaacagggatagagtttgatgaacttacattggcttagttcagcgcaaagtttagattttggttaaaattggagatgatgtgactgaaaagttgtgtgtatatgacagg

SEQ ID NO: 50564 - DNA, 1501 bp, Oryza sativa
atgtgcgttcatcctttcccgacaatagacggctcggagatcagagaaatcaagccacaagaaaccttcctcggccatgaaagcttcatgcggtgatcgaacagttaaaaaatgaacaataaatattagtaaacaaacttaagttcactataaggatagagaactattaataactaagagatggtgttaacaacggaatttcgcatcagattcagagaagaaggaagaagatcaaagtagttttgatgtggaatcgagttgaatttggagtcagactgcacatcggctggacaccatatcggcaggaaataaagtgtgagttgatcaaggttgatgtagccgatggtcgatacagtcgatatagtatgacttgggctcagtctgggcctagattagaataactgtcattgccaattagagagagagctcgattaaggaaattgtatctttagttacatcagtttgtgttagatttggcaagagaccgccgtatatggttttgtttgtattttatctttagaaaggtttgagtcgtgtccataatagactgagtctgtatttgaggtataaatatgaatctcctagcattgtaatacggggcacaatccaatacaacttcggcgcatcgccacccttttcgtttttacttttcgacgagttcgcttcgcaagcggtaacccatcttgatggcttatgctatcggggctattatgtcgttttagatatcttagtccttgtatcatgaccattgctatcatacgtctctgttaatctagtcttagcatatcgatttagctctatcggctgcttctcgctttagggtttccgccggtatcgactaaatcgtcttgttagattagattagcttagacatctaccaccctgaaaatcagtctacggcttgattgtctagatattatgtttcttttcatacttagtgttgcatcagtacattcgacctactaagtcgtgtttagaatcatgatctctagcctgcttctggattgctcgtaggggtagcatcgagctttcagccgatcttacccaatatacatgtttctttatctatttcatgtatatttgtcatctatatagacagcattgagctctatttggtatagtactataggttgatttgcctatatagatctgtactagagtattagctagtacattatctttctagctccaaatattgttgtattggctattttaataatattgtcttatgcttcttcatcaatcttgatagacagtgttacagccgatgatatttggggtttaatattctttgatatatccagtccatagccgatttggtctaactccatcggttgagaccaccaacgatacgctatcggtcgatcgactatcgactgactaactttgtttttgtctttcttgttgattgcaggatcaaatcagctggcacacccttgatacactcaagtctagccttggaccttcactggagctaagcagatctcctaggccaccgtgt

SEQ ID NO: 50565 - DNA, 508 bp, Oryza sativa
caacttttattggagaaaaaaaaccataccttatatagggttggtatcaggttccatgaccatcaaattgatatcgtattcgccgtgtgtctgtccactacataaacagtatattcataaactaggttgtgtttagatccaaagtttggatccaaacttcagttcttttccatcacatcaacctgtcatatacacacaacttttcagtcacatcatctccaattttaaccaaaatctaaactttgcgctgaactaagccaatgtaagttcatcaaactctatccctgttcgtcatcagaatatttctcctggtggtgggcccatccggccgggagctaagctaacttgaccgggacatcactgcgagagtgaaaagatagatgctgcgttttattccagccttctcttagcgatagtggttccggacaaacatgcacgtaatacctctattcagattctttttctttttcttttttttaaaaagagctccttgttctatgttgacaga

SEQ ID NO: 50566 - DNA, 195 bp, Oryza sativa
agcggtggttccaagaagttgtgcgttatatgctgatgctgtcgtgtactcgccatggttagtaagcttccatgttatattgtcctcctcgtgctctaccaggtgtatagcctgaacggcgatccaaaccccgacaagttgatcaatcaggtctgtcgtccagctcgcagtccctggcaagtccaagtcaagaag

SEQ ID NO: 50567 - DNA, 1501 bp, Oryza sativa
caatgtcaacattagtacctttcttagcaagccaagcccgaaagccttcacagtccctctgtgcatgaccttctgccttgcaaaacttgcaaaggaacttaccagcagaattttgtcctgctggaacctgagctttgcccttatgggcaccattagaagcctgagtggaaggagtgttgggtttctttttcttgttttgggagttgctggactccccttgatagaactttttcttgccgcctttagcaccatgaaggaggttcagctgatccttatgcttctgtttgtcagccttctgacgatcctcctcctcaacagaatgagaaatgagttcttcaatggaccacttatccctctgattattatagttaatgatgaaagactcaaaatcagaagaaagtgaactcaagataaaatggactagaagatcatcattaattcccatgtccatactcttaagctctccattcatagcacccatctgtataatgtgctttctcacaccatctttataattatagcgcatggacgttaggcgcttaattatagagctagcgtaagacttagaagaactcctgaagttcctattaatattttctaagtatgtcttaacatcatcagaatcctcaataccactaataatgacagttgatatgacactcttgatgtacatgagagaaatcctattggacttctcccattcattagttttctcacgatataacttcagtttctcctcataatcgtgctcaacactaaaaggctcctcaggatggtcctctctaatggcataatcataatcaagtatgcctaagttgagcaacacgtcagccttccacttagcataatttgacccatcaagaggctcaatgagtcggatctgaccaaaagctgaaaaatcatgaaaaaatatccgtaagtacatatatgcaattaatttgcgttggctcaattaattacataattaaacaaaaataaattcccctaattacatcaccgttgggcagaaataattttgggaaacataatcataagtaaatttacgtgaatttataatcaacgttggtcagaaaataaattcatatcatggaatacaaatatctagacaaatttctcgttggttccatttagctagaattaaattaataagcctccataaaaatttcataaattttcagcaattttaagcaatataaatggtactaatgcaatttctgaaaaatacttaaaggtgaattggaaagaaaaaaaatatataatatttgggccggcctggcgcgtgcggcccatgatgcacggctcggcccaacccggagggcgcgctgcggcctgctaatggcggtggcccgatcggaagcgatccgagccattcgcttagatggacggctcggatcgattaatattagtaaaagagaaaaaaataataaaaaaaataaaagtgccggctcaaccctaaccctaaaaaatttccccattcttttcctctctctctctcccgaaa

SEQ ID NO: 50568 - DNA, 1501 bp, Oryza sativa
aggaattcgcatgtgtaataactgcagaggacaccgcttttaagttgcttgtgacacttcatgacatacacatagaaggaactagttaaatattgcaagtaaaacaattgaaatacattaagtgtgtggagtattactggccagtatgtatgcactagtggtttctcccttgtttgcagtagttctccacctttaccttgtagtagttatacacattgtatggatttacagattcgcattaaggaggagatttaattataattcatgaaagttagacatgcatttatcagatcacttactatttgaagattgttagaaattgacggtacatcatgtggttataatcaagggggtccaagactgtcacggtgtcgtacttcgggtagatcatcaaacaaatataatgatcgctacatagtaacgacgatgaagttagtcacggatgaaataacacatatatgtacaaagaaatctactggacttagttaaagttgtatgcggcctttatgactcttttatgttgaaatttcaagaaggctcatccaatgtactctgcgacagtaagcatcttggtcttgtgaaagcccttcttgtattctgctatctctttaggcatctgttaacgaccaaatttggtaatatcagcatcggagatgaagattagatcgaaacggaatcgaagatgaggattatcgcagaagcagagtaagaatcggctggagttcggatcggctacgactgagatcggctaagaccgagtcagactgggttaagtgatacagctgattctgacaatatgactcatatccgacatcgggtttgaattgatgtgcttcgagatgattgtcagactgggttagaatattttatgtaaattccttagagataaatatgggcaaaagtctgccgcaaagacttatggtatcttagagtttgttagagataatagtcgtgtctggtatggacatatcttgtaattctcgggtataaatagaccctgagccctatgtaattaataacagacgtgcaatacaatctcggcgcatcgccaccctttttactttcgttttgtttcgacgagttcttgctttcgggttgagctgcatcggtttcgatcttcaacaagatttaaaacttgttatgacggcttgtgttctcgggattagtgcttccatctttacgatactctaatcttgtttatgtaatttgtcgagttatcatatatctcatataatcttcgataatatcatcatctagcctataatcggctagcatctgttattagaaggcagccgattaggttaaatagcgacattggcttagattatgtaagatatctaccactccttgaaacatccagcggcttgattgtcaagatattattcttctttttatacttaatgctgcatcagttgagtttgatcttttaagtcgtgcttagaaccataatatctagcctgccttctggttgccgattagagtagtatcggagtttcagccg

SEQ ID NO: 50569 - DNA, 439 bp, Oryza sativa
ttaatagatacaattgccttcccaggactctatccatgtatggcaatcatctcaaagcacatcaattcaaacccgatgtcggatacgagtcatattgtcggaatcggctgtatcacttaacccagtctgactcggtcttagccgatctcagtcgtagccgatccgaattccagccgattcttactctgcttccgtgataatcctcatcttcgattccgcttcgatctaatcttcatctctggtgctgattttatcaaatttggtcgttaacacatgccccccaagtccgcgatatttgataatgttccgaatttgccgtgtacatactctgaacaggtttcgcactttgccgttttccgaccgttattcaagcgctttaaatactaactgctgcccccgagaaatctcacaccgttacttccgttttcaccgcttaagc

SEQ ID NO: 50570 - DNA, 340 bp, Oryza sativa
agcctcatttacttctaaagtgttaatttgccccatggagtccttttgtctttgctcatgattgtgttcatctttgtcctttccagtctccttcagtacctatttatactactcattttacggttggccatggtggaaattatgatttgaggctgacagagtcatttcctggatcacttatttgcaaattgaagcatgttaaggtatagttgcacattcttttttctaaattttgacttacgtgttttcatcttgccttttttttttgagtttcttactcaatttttgacctgtttgtaccagaggggtgctgctcttgagatttacgtatctaaagctg

SEQ ID NO: 50571 - DNA, 1501 bp, Oryza sativa
gcttgccactcgatttgatcctataatcaacaagaaacaaagacaaagaaaccgtggttaaatccataaatgatagccaatcggttaggtgccgatgacatatcatttattttaggccgatgtcatatgtgcatcgatcggcaagtattaataagcaaatcaaaactaaatctactcgatctgccgtagatattaatgatatataatccttgtatcaatatatacttaaatctagtgattgggatagatcagtcgccttgccgagacagtacaaatcgcttaaatcgaaatatgtattaatagttaggttatatgtattcgtagcatagccgatcagataaatctagcgtgtatcggctaatactccgataccactctaaattaagatattaaagcaagtagaatacaccaaacaaaatcctaatatacttaaatgcaacaagatcttaatataaagggcagatttaacatgtcaatcaagcatataggataaaagtagttaaatcaggtaagatcggctgaaactccgatactactctaatcggcaaccagaaggcaggctagatattatggttctaagcacgacttaaaagatcaaactcaactgatgcagcattaagtataaaaagaagaataatatcttgacaatcaagccgctggatgtttcaaggagtggtagatatcttacataatctaagccaatgtcgctatttaacctaatcggctgccttctaataacagatgctagccgattataggctagatgatgatattatcgaagattatatgagatatatgataactcgacaaattacataaacaagattagagtatcgtaaagatggaagcactaatcccgagaacacaagccgtcataacaagttttaaatcttgttgaagatcgaaaccgatgcagctcaacccgaaagcaagaactcgtcgaaacaaaacgaaagtaaaaagggtggcgatgcgccgagattgtattgcacgtctgttattaattacatagggctcagggtctatttatacccgagaattacaagatatgtccataccagacacgactattatctctaacaaactctaagataccataagtctttgcggcagacttttgcccatatttatctctaaggaatttacataaaatattctaacccagtctgacaatcatctcgaagcacatcaattcaaacccgatgtcggatatgagtcatattgtcagaatcagctgtatcacttaacccagtctgactcggtcttagccgatctcagtcgtagccgatccgaactccagccgattcttactctgcttctgcgataatcctcatcttcgattccgtttcgatctaatcttcatctccgatgctgatattaccaaatttggtcgttaacagatgcctaaagagatagcagaatacaagaagggctttcacaagaccaagatgcttactgtcgcagagtacattggatgagccttcttgaaatttcaacataa

SEQ ID NO: 50572 - DNA, 323 bp, Oryza sativa
agttgctgaaatatctgcgaacatgttaaggagcttcatatacaacattaatacttttctgaacaatcaattacattagtggaacagatgccagtacaagcaacacttatgcaagggtagttggtgatgaaaggatacataagcatgtctcccaagtgaactaaaaataacttcatcgcctccaaccaatgtgaccttagcagtcttatctaataccttcccatttacatggacagctttagatacgtaaatctcaagagcagcacccctctggtacaaacaggtcaaaaattgagtaagaaactcaaaaaaaaaaggcaaga

SEQ ID NO: 50573 - DNA, 333 bp, Oryza sativa
catcagcttttactccatatgatcaaaagaaattttcttgacatgaaattatctataacattaatatagactatcattttgtcaaaacttcaattttcacaatacaatatatgtgtcaactgtcaggtatttttgcttcaattttttttagggatcagacaagtgaaacggattatttatgttcactgaagtagtgcttgtcaccataataaatatgtagatgcagtggtaagttcacatacaggaaaacaaaataaaactacaaacccctgcactgcagatatttggaaatgtagtaactcgcaaatacatgtccttcaactgacatatgtc

SEQ ID NO: 50574 - DNA, 838 bp, Oryza sativa
tcgtcccatgcagatcaatatcattaggtacttgaaaaccaaattaaacacaagagtgagtaaagaatactcagcaagtacaatattgaactagtaaaatatacacaggtttaatgcaataagaaaaccaatatgaaacatttgacttcctttaatttaaaacgaaggagacaaaaggtagtagttccctcccgggcaggtgtgaatatcctcttagcattaccggtaagccgagcaagcgtgatcagcgcttctcaaggatcatgaataaagatccaaattgcactcccatgactacgcatggtacttgaataatgtaaacaaaaagattcaaattgcattcccatgaccacgcatggtacttgaataatgtaaaaaaaacttccggaagaatgaaacatgaataacgtcgtgaacttgaacatgaagtgaaatatgaatatgtagcataataccaaaaccacacaattgataataggaagcttcgaataataattgggtaaatgaaaccaacaaagcaatacagtttatccaccacacaagtccgtcttgtacttgccttaacttcatcgataatccaactcaactccttcaacgttgcaaccctccacacacctatggagcaaaactacgcataataaaccactatattcaactaatgatagttacaagggacatttactaaaatcgaaacctaaaatatatagttttttaccgatttatattaaatatatatagctgttcccttactattttatgtgtaactcacaaaccgtctaacggaatctagcaaataatacaacttcggacatctagacaaaattgtctacaactttca

SEQ ID NO: 50575 - DNA, 648 bp, Oryza sativa
ttcttaggttactgatgtgtgtttttttctggccataaatgagctattattgaacagtcatattcaatgaacctggaactacaacaaatggacggcgagacaacctagctagcgcatctttatttttaagaaaaaaattattcctaatcctatctttttctatataattggtacccactaaggggcattttctcctataataaagcaagacatgcaacaagccacatcatcgataattttaagccattagatgatattagtataaagataataataattggatcaagaagctacttattcatccaatttaatcatttattagttatctattcacctccctttgctctacttattgtcacacatatcactgttacatattttgtgcataactatggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccaacctatataaggagggcagggagcccctctaggggca

SEQ ID NO: 50576 - DNA, 1501 bp, Oryza sativa
tgcacggtagaggcataccaacatttttcttttaaaagatggctcaaaagaagattcagtgacattttaaatctggggcgaagatgttgatattactagttgaataacatgacacagtttgcattcaagtttgttgtcggaacactctttcttttgggggtcatatcttcatccaaatccaacttagagtcttagacacatactagttgaaacacctaaagaaaaaggctggagtgtgatatgatctctctcgataccatcctatatgtactaaaagcaactttctgaaactgcaaaggatatgctctatgattgtgagatgcgagacataactagaattttcctgcctatctgaaagtctgacttatagaactcttgatagtctgctgcctattgttacgttataaaggtgaatttcctgctgactgctgtgtcacacttctttgttgccatctgctaaataactcatcgcatagactttctgataatgttgcctagaggtaaaggtaatatgacaatttgtagatcattgtttggccttttctgttggaactttcttgtagcacatattaaatggcttcatgttaactctcaattctttgaggcagaagtcatattcaagagcaattaaggttgttcttaggacagaagctgagagcaaagccttctatttagcttttcaacaatggaaacaccgagtgattagtggaaaagctggtttgtcctttcatttcttgtttcagataattccagtagcatattttgttgcattatttctgagtcatcggcccatgttctcaatgctaaatttcagattatcatgcatatagtcaattacagctctccatgtctgtttttctttaagtgccaatagctgcccttcaataccaagtgtttttaagactagataatgtttttcactttggtttgatatattctgctagctctagtgctctactatctaatgaaatgcataatgccatttaacttgcatatttggtcgtgcctggtctgataaaaaaataatgctattaggaatttgtagaagtagcatgtttactgctttatatctgcacatccagttttcttgaaggataactgtagttaatgaaatcaaattacatcatgcatgattatattaatgcatgttattttggagaacatacattaatactttgcatcatttctcttggtagaacttggttatgagatgctcattgtagcacacctttttgtgcttctctttgtattcgtttcctttttcaaaagtgttatttgtgacgaagcaaagtggcaactaagggacaacattgacatgttaatctcaaaacttatgccaacagtgaagccagagtcattagcccttttttttaatgtaaaatgccatagattcttatttcaacatattgctgcttcatggcaggtgaacctttggaaaatggattaataattggttctaaaagcaaatttgatacaaaaattgaggcctcatcagcaaaga

SEQ ID NO: 50577 - DNA, 1501 bp, Oryza sativa
acaatgaagacaccagtcggcggcgacgaaggcggtcgacggtgaaagcgaagatgcccactaatggcggcataataggtcagccgtgtaagcggaaacaccagtcgacggcagcgaaggtgagccaacggtgacgatgtagacatccaacaacggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggtggtgaagtcgtagacgcccaacagcggcggcataataggccagctgtgtaggcggaggcaccactcggcggcgacggaggcaggccggcggtgaagtcgtagacgcccaacagcggcggcataataggccagccgtgtaggcggaggcaccactcagcggcgacggaggtaggccggcggtgaagtcgtagacgcccaacagcggcggcataataggccagccgtgtaggcagaggcaccactcggcggcgacggaggcaggccggcggtgaagtcgtaggcggaggcaccactcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacagcggcggcataataggccagccgtgcaggcggaaacaccagtcggcggcggcgaaggccagccggtcggtgaagacatggacgcccatgaacggtggtgtgaccgaccaaccgtataggcgatgacaccagtcggcggcgacggaggcaggccggcggtgaagtcgttgttgcgatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgaattcggcaataataaaagggggtagcgcacgagacctaaaagtggatggatgcagagacaaaggatttagacaggttcaggccctctcgatgagaggtaataccctactcctgtt

SEQ ID NO: 50578 - DNA, 1501 bp, Oryza sativa
aacctactgtaaccctgtttagtttcaaagttttttttcatacttccaactttagtgtgaactaaacacagcatgtattttaaagtactactccctcagtcccacaatataagggatttttagtttttgcttgcaacgtttgaccactcatcttattcaatttttttttaaatataaaaaacgaaaatttgtgcttaaagtactatagataataaagtaagtcacaaataaaataattaataatttcaaaaaattttaaataagacgagtggttaaacgttagaagaaaaaatcaaaatctcttatattatgggacggggagtagtacgtacctggctaggcgagtacagtacgcacggagatgagaggtcgtcggccgaggcgtcatgatcatctgattgaaaaggtgcggcggaaacaggaacagtggagcgcaacatgcgtcatggttgtgtgtgcaaacatagcccaccaccgaacacccagctattttaacgctttttcggtgttgggaaatcgcgccgtctcccatcacggagcgttgcgttggagtagcagtatttggggcggacggtgtacgccagccgacttgaccagcccagctagctagctacaccaccacctgtagatcgcacgtgttcggcgttgttccatcgatccctgtactgctgtcaagagagaagagagtggagtagcaggttggtggggagtactgtatttatttactcgctgcgcggcgtggcgtcgaaaggcttgtcaatctgcacgtatcgtcagcggggaccgacgtacgccacgcgagtgtgcgcgatgaggtccagccccttatcgcttgtagttgtatcgcttgtgagagctaagctacgcttcctgaagtataatttggttcttctaaggacagatcgtccagctagtagtagctaactcccccgttttcaaaatactaaggacactgtataattattggttactgaaaaaataacaagccaccattttagcggcaataattgcattgaaattcgtgcaaactcttttacctatccctcttgtctacccctccgtccaaaaaaaaaaaataatactacctatgaacctggaaggctggacacaaactaagaattcgttttttgacagagtagtattccgctcttcgcatgcagtttgtcatcaccgcctcccctcccaagtcccaaccacgctagtcctcatgatcaccagctaaccaagaagcccaataacaacgtcgaggaaccgctgcaccttgcaagcctgcaattggcggattggaagctggcctacatacaatggaggaataagttcatataggtatgtcattttgtcatcgaatctgaaaggaaaaagtacgaattatgcccctaaaatatcatggtcggccgaattacccccctaaacttgaaaaccagatattattcaccctgaattttcaataccggacgaattacccccctcgaccctatccaacgcggttttgtcctacatg

SEQ ID NO: 50579 - DNA, 1501 bp, Oryza sativa
ggagtgtacctgtgcagcaaataatgaaagaatgccactaccagctccaacatcaaccacaactcgaccctcaaaatcggatcgattttccattacagcagcatagtatgttcctggagtaaaaggttgtaaactaattacatatatacagaaaggagaccttcatgccattattttaactcttttgacaataggccagagatactgacctgtcctgacaaagtcttgcaacatattttgctgatgtaataactggccatagtagtggaaatacatctttgctgatgaggcctcaatttttgtatcaaatttgcttttagaaccaattattaatccattttccaaaggttcacctgccatgaagcagcaatatgttgaaataagaatctatggcattttacattaaaaaaaagggctaatgactctggcttcactgttggcataagttttgagattaacatgtcaatgttgtcccttagttgccactttgcttcgtcacaaataacacttttgaaaaaggaaacgaatacaaagagaagcacaaaaaggtgtgctacaatgagcatctcataaccaagttctaccaagagaaatgatgcaaagtattaatgtatgttctccaaaataacatgcattaatataatcatgcatgatgtaatttgatttcattaactacagttatccttcaagaaaactggatgtgcagatataaagcagtaaacatgctacttctacaaattcctaatagcattatttttttatcagaccaggcacgaccaaatatgcaagttaaatggcattatgcatttcattagatagtagagcactagagctagcagaatatatcaaaccaaagtgaaaaacattatctagtcttaaaaacacttggtattgaagggcagctattggcacttaaagaaaaacagacatggagagctgtaattgactatatgcatgataatctgaaatttagcattgagaacatgggccgatgactcagaaataatgcaacaaaatatgctactggaattatctgaaacaagaaatgaaaggacaaaccagcttttccactaatcactcggtgtttccattgttgaaaagctaaatagaaggctttgctctcagcttctgtcctaagaacaaccttaattgctcttgaatatgacttctgcctcaaagaattgagagttaacatgaagccatttaatatgtgctacaagaaagttccaacagaaaaggccaaacaatgatctacaaattgtcatattacctttacctctaggcaacattatcagaaagtctatgcgatgagttatttagcagatggcaacaaagaagtgtgacacagcagtcagcaggaaattcacctttataacgtaacaataggcagcagactatcaagagttctataagtcagactttcagataggcaggaaaattctagttatgtctcgcatctcacaatcatagagcatatcctttgcagtttcagaaagttgct

SEQ ID NO: 50580 - DNA, 409 bp, Oryza sativa
aataggacccatcccatatgatattgtaaaacaatgcaatatttaatagaaatgcgggacatttgtaaattgggtacaatatgatcaattgcaatgtatgacttgccttgctctcgcactgatggaaccacagcaacttcttcgagaaaccacgaatcgacgaaacgggcgaaatctacgcgaccaacaaagcacacaagcaaaacatgctataagtctactgaaacaggaaacaaaaccatttttaatggattctatacatttttatgaatttactgagacttaaatggacttaatcggagctcggatgaattacttatgatttttagaagattatctgtgtttttactaataaagaaaaagccttaatgtatttattgcgcaatattgccctagggctgacgtcagc

SEQ ID NO: 50581 - DNA, 198 bp, Oryza sativa
gtacagtcgttcatcaatacttggagggtcaagatccggcattacggttgagatatacgaattagattagacctatatttgagggggttaaagtggagctattccaatttgatggtcttggcaaatttaattgggtagacgggtaattgagagcccattagaaagcccatcaaaactacccatattgttccctccagg

SEQ ID NO: 50582 - DNA, 1501 bp, Oryza sativa
aagaggcatgcactggtgatggtgatgactttacactgagaaaaaaaaaaggggggccgcaaagctgacatgaagctgtgtagtgtaggctgtgtgatagcaaaactctttttaggtcaccagcgacggcaagcaggcataggtccatctgaaaaggagccctttgcattgcattgttgggtccattcagatacatagcaatactactagtatatgtattgtcatgactgatcactcttgtgaagttgtgatgtatctttcgatcggccattcctcaagtcttagcttagaagtaattaacctagcatgaatgccatcactctcatgattgaaagctcattgctttcacaaaaccaaactttacatgctttatgctaacttgctagtatatcccttgtgtaaaccaggtcaaccaaacacaccctattcttcaagagcgaatgttcatgtacattgtaggccgtcgatcggttgcacgtgagtcagacgattggattgtatacatagcaatttctgttctctaataaatatacaacaacagttgaaactaaagaaaatacttcctccgatcctaaatataagcatttttcttgtttactcagatatatagccaaaaatagttatctttgggaaaggaggtagcagactcatcaagaattgaactgttttcagtgaaactcacatgaaaatggcttgtcctagacaaagatttacaggtaggaagctcgtagaaaaagaaacattcggttaaaaaaaattcatgggttccagaagagattaggttaggtaaaagtagagagtggtggcacccgtgcacaacctaatcatccactgaagacatcgatcgacacgtagaatagaatatgcgtgcacggcttaaccaagacgttaacatcagacgggtgcaaagagcaggggatcaaaccggcagagggcttcagccaggtaagccgtgtctgcatgcaaaaacacacagacattgggcctacaggcactccatgacacactgccatggcatcgtcttcttcctaatcccctgctaagttgttgagtacacttaaccagcaagcacaaaaatcatgtttccagcagcagaatcagcaggctctgcacgcatggtagtatctgcctatcatgcatatgcgtccatagttgtactatggactactagggagtacaggaactgatgggcagtgtagcatgcagaaaaggcttcagagaattggattttaatttttaggaaatggaagatgcagttgttactgtacactagagtactatactgcactggtaaataccagatcagagcatcagtattccagtagctaaaagagaccaagagtggaatatttgctgctgcagcatatataggaacaaaagtatacatcattcagttaagtgttcagtcatccatgagactacagaggggagcagcaaacttctttagcagcaacagcacatatcattctcatttgggtatgttggcccctgaatattcagt

SEQ ID NO: 50583 - DNA, 1300 bp, Oryza sativa
aaccaaataaaccagatattttgaatttgagcagtgatgtgatgttacctaccactccgaattgtgaggcaagtggaggcacatttggcgccaagaagagtctttggccaggctagttaagctggcgtcctgttggctcacaggcttttgtttatgagatgattactctgcaaattaaacaaagggccagagttgtccacatgtaatgcaatgattcttgcgttgttctgtgatacgctccttgatttgattattttggggaaagcataatggaagggtagtggacaaatcagcaagggcatgagactatgagagtggacatggacttgtttgtttttcttaattatgaatggagttgtttaaattagcatttaccagtggtactcttgatagtatttcgtttaaccaatgcgccacttgtttgattgatatagttagtgtttagggatacgatagtctcggtttgtttaggggtcgattgttggccagccatatacagtttaccacttctaaagttaagttagacaaatttatttaactgagacagttgttcagttacttatgataagattctcgtatccgccatgttttaatgatttagaaaaatatggaaatattcttttagacctgctggacaaatattttgaacacttaatcttgaggatgtttggtttcttttgttggcaagtgttagcaaactgtgactgacaacgcacagacctattgtttcgcctatagccgattataagccctaatgcttattagcgaaaaataatttataaataaaactttcacacacatatattcttaatcacttaaaatctaatgtaagtaaaagtaattaataatattaagatcaacactaaaagtaattttaaaatttaaattttggttacagttaataattaagctagagagcaaacaatatatcataattttcattacagaaggtagcaattaaaaactaaaaatatgtttggcagtttgagttgggagcaaatccctcgtgcacctttttgagcaactcattaatacgtgattaaaaatagattaatatggtttataaaacaatttttttatatatgtattttcaaaaaaaaagtctgtttaataatttaagaagcgtggacgtaaaaaaaaagagaaagaagagacggcaacattaacaacccaacacagctgttggtcaaagttgtgttgtgaccaaaaggagcacagagactgttcatctgtagtatagtaggtagtcgtacaaggcagggagtatatatgcgaggtttaatttgttgtgtacacccca

SEQ ID NO: 50584 - DNA, 1306 bp, Oryza sativa
tgttgttgcagaagtactgcatccttctcagagtttaaatctaagattgtgctttttaactctcttgatgtgttttccaggtctaactttgcattttccaactcttccagttcctttgttgatctgtcaagattttctgtcagctttatcacttcctcttccaactgagaatgcagattcttaaacctgtgaagatctgcttcagtttgtgtgtgcctattgcattcatcttgcagctgggcatgggcactatctgcttcctgtctcttctgttcaagatcttgcatcagcatctgaaccttctgttcaatttcttccagctcaggctgtagcttcaagagttgagattccagatcagatactctttcaacagactgctggtgttgaaatagggttgcatccttctcggtgtttaactgtgaaatggtgctccgaaggctttggatttcattttgaagttcgttctttgaatccttcagagaattaatttcatcgcgaagttcttgtataagcagctcggaggagcggttttgttcagtaagattctcgacttctttcttcaactcagaaacagcattctcaagatttactttggtctgcttgagctcattcaacttttcatttgccatctggatttccttagtcaacctttgtacttcttcttgacattgagcaagttctttcccctctgaaagcagagcactttcagcctgcatgcgcttatcttgttcttcctggaaggttaagttgaagcttttcagttctttctgcttttgttcaagttcttcttgctgctcttcaccttttgatccaaagcctcaagctcagactgtatttcactattgcgtgcttcagcgctactcagcttctgaacttctgtagccatttcatcagttagcttcttgaggtcatcctgggccttagagagctcagactccagagtagataaccgctcagtggactgattatattgcagcagaacgtgtctttgtcagaattcaatttcaagatggtatcctttagaacctggatttcattttcagctttgtttgccctctcagattctgataatatctgttgtttcatgctgttgctctcagctaataatcttgaaatctcttgttgcaaatttaccatctcattgctgatggcatcactgcctttaacttctgggcttccaaagcttaggcctttacgcactttcacatcaaaaccttttcgatttggcagtgcactggcttcctcagggtgtgtaccattcctcttggaggtgaattgttgtggtgacacacctactccatccttc

SEQ ID NO: 50585 - DNA, 1501 bp, Oryza sativa
aaaagaccatctattttgtcacaataccatttgctacatgttagatcatcgatctattttgtttcagcgttatcttgttggcatctaactgaatctcctctggtcacccgtaacatgattagcaccatttctaaacctacgcacaaggaccctcagttacatgcataaactgtggatgaaacaaagcatgtcacagaacaggatatatagtaggctgggtctaacacagaatccaattctaaaattcaaatttgtcccacaaacagtacaatactacttgtctcacgaatcatttctcatctcaccaaactatccttacacttaaaaaaaccatccctcatttaacgaggagtatctcaggcacagttgaaacatattacttcctccatcccataatataaggaattttgagtttttgtttgcactgtttgaccactcgtcttattcaaaaaatttgtgcaaatataaaaaacgaaaagttgtgcttaaagtactttggataataaagtaagtcacaaaaacaataaataataattctaaatttttttgaataagacgagtggtcaaacagtataagcaaaaactcaaaatcccttatattattagacggagggagtactattaattaagtagattgttgctgcgaattatctacttaattataacgataaagtaaatatttttataaataaacttaacaaataacttaaaaaacaagtggtcacaacaatataatagaagaatctttttttaaatgtatttttaaagcgtggggctaataacccggtcctataatctgataaatgatacgaaaagttgcaagcctaaagtcttttacctttcctactaatttaccttttgaatcctagaattatattcttggccgagttctttacaagcaaaaaaaaagtatctaatttttcgcatgctcgcttcctaaattgctaagcggtatgttttttgaaaaaaaaatctatgaaaaaattgttttaaaaaatattaatatgttttctaaatttaaaatatactcaattaatcaggtcttaatgactcatcaatcttctcccattctctcctctcaaatacactctttagttggacagaaggagtactctacagattagacggaaggaaaactagaaatggcccaacaagaaaaataaaaatactactatatactcctgtgttgaatgaagcttctcacatgtcagcttaagtgcaagggatcctgacatctcagcgttgcacatgtactcactccctcaaaaaaaaaaaaaaaaaaccaaaccctgggtttctgtgtccaactttaactgtccgtcttatataaaatttttttataattcgtatttttattgtttagatgataaaacatgattaaattttatgcgtaacttgtttttttaattttttttcataatttttcaaataagatgaacggtcaaatgttagacacggaaactagggtttgtcttttttttttttttcggggggacggagg

SEQ ID NO: 50586 - DNA, 341 bp, Oryza sativa
cccaaaaggaggatttaaaaacatttttctatttaaattattcatgaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcttttagacttttaaaatcatttctaataattccttttaaacaacaatttataatttaaggatttttaaacaagaaaaactcttaacaattataattagatcattatttatcaaataattactgaactgttctttgtatcatttagg

SEQ ID NO: 50587 - DNA, 415 bp, Oryza sativa
tcctgcagcccatagttttacatatttcacaaaagtttttgaataagacgaatggtcaaacatatttaaaaaaatcaacggcgtcaaacatttaggaaaggagggagtatataataaataagtactccctccgtttcacaatataagtcattctagcatttcccatatttatattgatgttaatgaattaaatagaatatattgtgaaacggaggaagtggttactacttactactcctagcttaggattttataagtgaatgtatcctgaaccatctccgttttgcacatatgaaccacccatattattggttctgttagaaacaaaacccatgtggtgtctgctcctcaagaagtctttaaagtctgacctgctgcaaacagcagcaacacctttttttttttttttgcaaga

SEQ ID NO: 50588 - DNA, 231 bp, Oryza sativa
ttcctcctccccacccaaagctcgagctcccgctagggtttcgccgccgccatggtaagtccccctcgctttctccccgccgccgcctccaacctgacctcactgcgtgcccagttcctcccgggattcaccgctgatcatctcagcacccgcgagtctttccgtttcctcgtcgttctcgctttttttttttttattttttttgagttttctcctggacgagttggctgc

SEQ ID NO: 50589 - DNA, 191 bp, Oryza sativa
gctttgcactgattttgatagttgagggacccgttgtatttgattttctggttgaaggatgaaaattggattcgttgacaagttaaagggacctcaagtgaacttattccttctcgctcttcaaggactcggagccgcggggttggtccattcgcagagctcagcggtggaattagctcgaagctcgatca

SEQ ID NO: 50590 - DNA, 1501 bp, Oryza sativa
ttgattatgtgctccaactgtagcaacatctccagcatcctaatgatcttgttattaacaggtcatagaggaccagcttgtcagtgcttcattaacatagatcccaaaaattaatattaatgtttggaccctaccatccgtgccaagtgctgcaatacataaattttgggggcagttgctccggccgtgtgacctaactgcatgaacactaattaaccaaaagcaattgcaattgcaattgcatttttaaattgtgtatgtgacaaatggattcctatacttatttattggccccaaaaagttgttgccgcttgctatagctgctagcagctgcactactcgattgttccacgtcggatgggccatttttgtattgtcaaactgtacagctagtttgatcagattaactgtactggctggatagattagaacaatggattggctgtccaatgattcctgcttaataccttaatcatattagggtattttggtatgaatttatggttgcaccgcgacgaagtagtagaaagcgacaaaagatgatcaaccgatcatgttttttagtttttttttcgtaggtttaggttgtcagtttctagtatgatgagcaactgtatccatattagaatgtagaccttacaagttacagcaagataatttgccttttttttaatatggaattcattccaacatttgctttaaaaagttacaaccaattattacagaggttactggacgaatatctgcaaactacgaaatcacagctcaagaaaactacttagaataccacctataacgcctattgctaaaccttcatctatagcaagagaactgactctacaaaactgtaattgcatttgttgctactgacaatttcagagatccatccactcttgtgcattttttttcatctaattctgaaactttatgattctacagtagctgtacacatgtactagcaataagttggagatcaggttgaagtgaaagccactacacctgcaactgaagaacaaaggagcaaagcaaagaggtgacccaaagaaaccaagaaacagaagagtgagaaaggtgaccccaatccaaggctggtttccccctgaaagcccctactgaatgattaacaatgcctggtttattcccttctcattatgaatttgtcttgagaccatgggcaagggcaaccacctcaattattattccattccctaccaccactgagagtgttcttacaagaagctagcccaggaggttctagcttacactgattgatgctccacatgaacaccacatgcatttgtcctgcatgtcaactactctaaatcacatagcttccttcctacttttgtgccatggagtaactcctggcctgtgttgggctacagttttggttcctagtaaagaaataaaactagtaagagcaatgtacttgtatatgaaaaaacagcaatgctgaagctgaattttacatggtaacatcaggaatttactcctttctagt

SEQ ID NO: 50591 - DNA, 394 bp, Oryza sativa
gttagatttgttagtccgtgtactaggcgagaaaaatctttcgtttttcgtgcaaatgtttttgggactgttatcagaaaataataaaagaataaagaaaaatgatacgtttatcggaaaaaaaaaagacaaacggacaaggatacgttaatcgaatgaaaataagaaaaaagaaagacggacaataattgtttttgcaaacataagatagcaataagaaacatgcacatgcatgggcatcatagcgtaggtaacgaactacagttcttgatccgatgaaaataagaaggaaaataaacaaacggacaaggattgtttttggactcggtattactgcatatccttgactgctggatcgacaggaaacggccaagaccaagctgggagatcagca

SEQ ID NO: 50592 - DNA, 348 bp, Oryza sativa
attttaagaaaatctagttgtaaaatctaaaaaaaataaattagaagctataagctgagggtttcttctcacccactggtattcccaccatccgtttctcagaatcaacagcctcatttttttttatgcttatacttatccgttaagatttgaattttcaaccttaaatttggaaatgattttgaagtttttttttatcgtagtttatttttcagtctttgctcttagatcgttaagaacaggtatgtaaaaattttatttataaattattttttatttacaaatatacattgttgtttcgcttttttctctaatatgtcaaacgatggggctcgctccccaaacaga

SEQ ID NO: 50593 - DNA, 190 bp, Oryza sativa
aagttgattaagcaaacaacctagcatggttacatcacaccccactgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagc

SEQ ID NO: 50594 - DNA, 183 bp, Oryza sativa
ttgttgcagagagggcgtcgcggcggagccacgagcggtctcgccggagcaagatcgacctcgacgctgcggaggccaccgtcacgttggactacaggtgcgcgtgtgtgcatatctccggcgatcgccgccattgctgctgcaccgatctccattgatccgtaacaatgtcgtcgtcgtcct

SEQ ID NO: 50595 - DNA, 1501 bp, Oryza sativa
tatgtaattaaacacacacacgttcaatacaatttcggcgcatcgccacccttttgctttagttttgtttcgacgagttcttgctttcgggttgagctgcatcggtttcgatcttcaacaagaggtaaaacttgttatgatgacttatattctcgggattagtgcttccatctttacgacactctaatcttgtttatgtaatttatcgagttatcatatatcttacataacctctggcaatatcgctatctaatctactatcggctaacatctgttagcagagggcaaccgattaggttagattttgacgttgatctagattatataagatatctaccactctatgaaacttctagcggcttgattgtctagatatcgttcttcttttcatacttaatactatatcagttgagtttgatatattaagtcgtgtttagaatatcgatctctagcctgctttctagttaccgattagagtaacatcgaagtttcagccgattttatcagatttaactatatttgttctatatgcttcattgacatgttaaatctgccctttatatcaagatattgttgtatctaagtatattaggcctttgtttgatatattatacctgctttaatatcctgatatagagtagtatcggagtattagccgatacatgctagatctatctgatcggctatgctataaacatatatagtcttgttaattgatatatatttcgatctaagtgatttatactgtctcggcatagcgattgatctatcccaatcacttgatttaagtatatatcaatataaggagtgtatatcattaatatctacagccgatcgagtagatttagttctttcttatttattcatgactgccgatcgatacacagatgacatcggctcaaagataaatgatacgtcatcggcacctagccgattggctatcatttatagatttacccacggtttctttgcttctatttcttattgattataggatcaaatcaactggcatgctaacatacccgaaggcgagctttggacctgcactggagttaagcagatctcccaggccacgtgttttcagtcaacagcgctgctcctcccccgccgcccgcgggctgctcctcccctcgccgcctgcgcccaccacccgcggtgctccgctgcctccccttctcctgcttcgcctgtcgccggccgctgaagtcctcctccgggtctgcagcctctgcaaccactgcctccccttttcccgtattgtcgccgcctccgcggcatcgccaggaccaggcgccgccgttggcaggagctggaggggtgggaggcatggcgcggggacgggggaggatggcaggagcggcggctcattagagccgacggccaccgccgcccaactcctctccgtcggtcgtcgctcctctctcccagccaccgctcctatctgttggccgccaccgctctctcccggccaccgttcctctgcccactcgttttcgctagc

SEQ ID NO: 50596 - DNA, 1501 bp, Oryza sativa
attttcttgactaagtgatgcttgctacagttctgcttgtgtaaaatatgtgtcaaaattgtgccctatcattttctttgtcaaaatgtgtccaaattttatcaatttgtggcacaattatgtcaaattttgtttatattctatcaaattttttgtcaaacttgcaatagcaagtaagggtatggatgtctttttgccaacgatttaacactgtcaatatgtccatacaaattagggttaaaactaaggttcgtttcagaaaaaaaataagggcaaaattgaaaacctaaaaaagaagaataaaatcaatagtaaacattaaaaatacgaataaaattgccccttttaataatgtgatggtttgtttttaactgtgtttttactatgtttcaaaaattttaattaagctcatactttctcagttctaaaacataaggatttttaggttatttagcacgtacgaaaattaggtcaaaacgattctttttatcattttatgtcaattttaagttttaaattgatttttaagcatctcattgtctttggaaccatagaaatagaaatgatgaaaataataggatttagtgcaagaatacctacgttatggtatacaatttgaatgcaaatttaagaacggaagaagtataaactaaaaaaaatccaatcactcctaaaaattagggagaacacagtgtaaggatgtgttcgtttgaacgacacaataaaaagaaaattatcgattaatgcgtgtacgtttttcaaacggttaaacggtaattttttttacaaaatatttcaataaaaaagttatttaagagaacatattaatccatttcttaaacctaaaataattaatactctactcaattaacgatagactaacttgttctacgtatcttccctcttctctttgccactcctacagtcctacccacagcctaaacccaaggaaccaatgtccgaaaacctaaaaaaaacggagttgctagaaatatggcgccatatgctacagtcgatttttttttagccacttacacagtagttacacctcatttacaccccacttacatatgtaattagtatatgtaattttcaaatttacatatgtaattttagtacttacatatgtaattttgagacttacattgtaaatacactaaaattatatatgtaatttagggacttacaatgtaagtatataccgactattttttgataaaaaatatgacgccatagatatggctgcaaaaaaaaaaaaaaaagaccttccctgccgcgtccacgtacaatgaacctcatatgcccccacctgcaactgcaaagctgtccatgtacaatgcgcatgctaacgcgggccacagccgctgacaacgcgggcccacacgatcccccctctcccctgtcttaaaccccacacaaacacgacccaacgccttcctctcctcctctctctctcccccgctcctcgcgccgccgacatcgccggagaaaatgagtcaac

SEQ ID NO: 50597 - DNA, 927 bp, Oryza sativa
ttatttacctaatcctatttaaaaaatcatatgcatactcaaatgctaaattagatacagactgtgttgaacctggcatcaaggctaatcaggacggggataaaaaaaagaaaaagtgttttgcatgcacaccatgtgccttggaaatgtattgctaaatagaaacaattaaagaatagcatactactgacggtttggtgagcaaatataaagtgcagtgctaattacaatttcatgatatggatcaaagaaatgcataaacatgactaaatgagctaaacacagaagaagacccaccattgagattttcttggagccatttggagttcttggggctgatatgactaacccaccaccatgaatactgcctcgcgtcatgaccgaccaaggccgccattggtgccacaaaagcaaaactccaaacaataattaagacctcacttcctcagcacttgaattatgcaacaatgcaatattctgcagctcccaaagctaagaactgccttaatttttttcccccactcttcagaacaggagcgaaaccgaaattaagagaatgaaaggcacagagaacagccactgcaatttggcaatgattgtacctacaatatcagaaacagaaatggtacagataatatcaactaaacaagttgtatacacagctatgagcaacagtagtctagagtagtacttacaggttctaattctccaattaattgaaagggcaggaagatacactggcaggtcgcaactccctgaaactgaatcataaaaatgtatcaagcaacaataagatgaggaaaaataagaaaaaataattgttgcatgcacaaaaaagcaaacacaccaccagagtagccaccttatcctctaataacacagaattcccatcctccgatgcaaacaaacacagaattctctcaacga

SEQ ID NO: 50598 - DNA, 842 bp, Oryza sativa
tcttagaaactggaccaaaggctagaatgtttgaggagattctgattccgagagaagctgctgcagttagaagctctcccaaacaggtctgtaacagcccccctctggaaccgtgcaaccaatccattcgacgggcggactcactaacatgcatcactccatttacactttttacacttttatcatcgttttgtgtaaaaggtttaacccatgaaccccacaatattttttgcgtgaaaatgggttccacatattttttttaattctaataccacgtaagcgccacgtcgacatcacgtggaacaaagaccaggttaacaccgccacgtcagcaaatagctttccaaaaccatcgagggagttaaattgcaccggttttaatacttggggagttaaacatatcaggtattgtggttgaaggagatgaaattatgaatcaaattcgcacactagctaagggagacaatgtgaacttagcccacctcacatagcggtactacctgcaaagcccaagacatcattggtgaggcccatatagctctcatgggctaacactcaggaggcccaagagagcttataaatcccgaagcgaggcctcttttttcctcctttcctcctcccccacccaaagctcgagctcccgctagggtttcgccgccgccatggtaagtccccctcgctttctccccgccgccgcctccaacctgacctcactgcgtgcccagttcctcccgggattcaccgctgatcatctcagcacccgcgagtctttccgtttcctcgtcgttctcgctttttttttttttattttttttgagttttctcctggacgagttggctgc

SEQ ID NO: 50599 - DNA, 826 bp, Oryza sativa
cattttggatccccgttcagtgtggaatttattaataattctcttccttgaccaactctgcaactgaatcattgaaatgttgcagaacctagtggcgaaagatagattcagaatttcagacggttacatgcaagaaggaattaagttatgagttcttacattttcttactcactcaaattaatcttgtatgcaccaaatgaatgtatagtgccacgttagggctttcaagaacaaagaatgtaagctagtgggttttgcattatctttattgatctcatctcttctttgccggctcggtggcgaagaagtgccctgaccaattttattaggattaagagaaggtaaaatattttcaacaaacatggttgttaagattacattacgtcctgtgaacgaacgtgactttgcctagagcatacaaattaacctgaaattgaaacgactttgcctatgtaaaattgtaatctctcatatgtactttctactattgcacttttgaatgaaattcagttgaggaatctcttccctccggtgagttgttcaaaaaaaaaaaagccttctccagctgtttgtcataattcataaatatgttaaaacagctgattgtttgtatccatataaaagaacatcatcatgacttgccctcctccaaaaaggttcaaataaaacagtatgtcagcatcaatatacctcacgcttgcactttcttcacttttccccctgtatattactagccacaaaccaagccctagatgctatatcaccaaactaaccatcgtcttcctcctcaaatcatcatcttccaaacatacaattcggcagagg

SEQ ID NO: 50600 - DNA, 395 bp, Oryza sativa
caaaattatgtgaaacttacatataagttacactgtaattacatgtaagttacagtgtaattacatataagttacagtgtaattacactacgattgtactataattacatctgtcaaatttttggagaaaaacttgtcaacaaatgtataggtagtcccacggttttgtaagttgagggatgtcacatatttggttttgtggttgggggacgattttgtatctcgatgacaagttgagggaccttcggtgtactttttccaatatctcttcaagctgtcagaggcaaactggtaaccaacccagtttagcccaattcaacatgggcctaaactacagcccactaacaaaagcccattaagagaaagcccattattttctctttctctctccaagg

SEQ ID NO: 50601 - DNA, 284 bp, Oryza sativa
ttatttacctaatcctatttaaaaaatcatatgcatactcaaatgctaaattagatacagactgtgttgaacctggcatcaaggctaatcaggacggggataaaaaaaagaaaaagtgttttgcatgcacaccatgtgccttggaaatgtattgctaaatagaaacaattaaagaatagcatactactgacggtttggtgagcaaatataaagtgcagtgctaattacaatttcatgatatggatcaaagaaatgcataaacatgactaaatgagctaaacaca

SEQ ID NO: 50602 - DNA, 1501 bp, Oryza sativa
gagaaatgccaacaacccaatacagagtttgcttaaccaaaaaccatcaattccaaatattaaaaccgttgcaccagcatttagttttagatttcacccaaataaatactccaatcccagtaatgacgcagttattcccaaaaaaaaaaaaatcacagctcatcgcattagtattaggcagcaaatcaaatcactggaatcactcactgctcctgaagaaaagtttccccttttttattcttcttgctcaattttttttttctctcttgttgggacctaccaccaccttcagtggtaaggcagcctttcttcttggtggcatcgaagcaagcactgcacagcgcagagcaagaagccagactccagactgtgagagaaggggaggcaggatgggttgaggaggaggaggaggaggaagaaaggaggcgacttggtggatccaaggaggccactgcttttgctttgctgctgctgggattccacttggtatgcttctcttctctccctttctatatcccctcgatttgcaggattggatctttggtttttcttttctgctccggttactggtttattgatctttgtttgttggtgcttgaaagatccgattttttttgtggttcttggtggtgtttatgtgatttgtttctgctggggaggaattgtttggtgttgacggggtggtggtggtttggtttggttggtgggacaaaagaagagcagtcggtgccaagcctaaggaatgtttgtgtggaatttgatcatgtgatgaatttccttccccccggtttcttgcccttttcttcttgatgatttggttggattgcttggttcgtggttcgtacgatctcgtttcttcctggtgttcttcttccgtaacatcgctgttcgcgatttcctcgaggagcttatggaattttgactctgggctattcttctgttttggaatcctgcccggttttaccggtcatcgttgagagaattctgtgtttgtttgcatcggaggatgggaattctgtgttattagaggataaggtggctactctggtggtgtgtttgcttttttgtgcatgcaacaattattttttcttatttttcctcatcttattgttgcttgatacatttttatgattcagtttcagggagttgcgacctgccagtgtatcttcctgccctttcaattaattggagaattagaacctgtaagtactactctagactactgttgctcatagctgtgtatacaacttgtttagttgatattatctgtaccatttctgtttctgatattgtaggtacaatcattgccaaattgcagtggctgttctctgtgcctttcattctcttaatttcggtttcgctcctgttctgaagagtgggggaaaaaaattaaggcagttcttagctttgggagctgcagaatattgcattgttgcataattcaagtgctgaggaagtgaggtcttaattattgtttggagttttgcttttgtggcaccaa

SEQ ID NO: 50603 - DNA, 1501 bp, Oryza sativa
gagaaggaagcggcggctaccttcgggttgacgacggcgacgatgctccggcgggttccgacggctgcgaaggggcggacgaggacggcggcgacttggcgagcacgacgacggtcttcccgagcggcggcgacagctggagcgacggcggagcacggctgaagcggcggcggcgacggcgaagctagggcacacggcgctagagctcttccgacgacgagaggcgaaggcgagggtggcggcggaaagagaagggcatggggatccttttaaaggggctcggaggcgacggcgaaggcccacggcgacggcaacggcgaaggaaactcgcggcttggaaagagggaaaaccgatccgaatcgaactcgattccaacgctttccaaagcgatttagccgaagattccaaaggagaaaaggtagaggagatcccggagatcatttcccctctattgattcggccggagaaggaaagaggcggccggatttggaaggaaacagcggcggcggctcggcggcggcgcgctagggtttcggcccgaggaagacgacgggcctgacaggtgggacccacctgtcagcggctgcgagggcgcgcgcgcgcgcgggcggctgcggactgggccggctgggccgagaagagagagaaggcggttttgggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggcccaattttatattggaatttattaattagaattagattttcttttcaagacttttaaaataaattctagaaattccatttaaacaacaatttatatattttgaattttcagggtgtgacaaacctaccccccttaaacagaatctcgtcctcgagattcggaagaactggcgaacagaagcggatgagctgactttaattcatcttctcgttcccacgttgattcttcttccgagtgattactccattgaactttgcagaaacggataactcgattcctggttcttctctcatttgtttccagtatacggattggtttctcaccataagtcaaatcctcttggacttctatctggtcaatattagcttcttcggtaggtacccttaaacactttttcaattgcgacacatggaacacattatggactcctgccaaggattgaggtaactccaactgataagcaacctctcctcttctgctgacaatcttataaggtcccacaaaacgcggtgccaattttcctttggtctgaaaacgatgaactcctcgaagaggcgtgacacgaagatacacataatctccttcttcaaaactcaaatctctgcggcgattgtcggcataactcttataacgagattgagccactcgcaatctttcttgaatgatctttac

SEQ ID NO: 50604 - DNA, 243 bp, Oryza sativa
tgcagctactggagctagaaatcacacagaagagtgaaagtatggacagcctgacgttgagcctgaaagacgaaactgagaaagggttcaagctgaaacatcactcatgtcaatggagagtatgtatcctcagtctcaagaggaagtgaatagattgcatctagagattgatattcttaatttcaaattgaatgaattggaaaacttgccatctgaacttaatagcaccatcttacttctaaa

SEQ ID NO: 50605 - DNA, 1501 bp, Oryza sativa
tctgatcagagtaaatctattcgaatagccgagccctcggatatgggcaagcctagcaatgtacccaagttagtggtttaattcttaaaatttgcttaacaactaaaatgtggaaaggttggcctgggttggcttgggacgagctgggacccaggtcgggttgccagttcggtccgaatcatcgtaggccttgggttaaggcaggttcgtgtgggtccacggccttgattaataatattgtgtagctctaagatcgtctttataaaatagctttgggcaactaagtgacttttaaatgctgtttactgcaaaacctaacccctattattatccccttgtaccccccttgcattaatcatgcatctgccggtgtggcttgctgagtactgtggttgtactcattcttgctcaatcttttcccccttcagtaagagaagctttggagaagatgtcttaggtggagtcctggcttataccccagttgagcgcctgtggagatggagctgtaggcccgctagtccgctgctgtttatttttgattgtcaggcctgaagcgcctttgtaataatgtaaatattatcgatataataaagatgtgccttttgtatcatgtttgtttggtgcaccccggcttttcctgggacggggattaatgcactagcgttcgggaaaaggcaattttctcggtcgcgacaagctggtatcagagccatctcgactgtaggttaagccaagtggataaaacctaaggacatattttataaatgaaactatttgcgaaagttcctttttcctccttcccccaatgctatttggaaaaggtttattcccttcttcattcttcggatttcaactagtactagatggtcaggtcggcaaagaagaagacatcgtcagttgtctgccgaagctgcagaaggctgttggattcgttagcgaagcgaaggaagcagtgaagccagatgtgaagcaggagtgaagatctcggagaacccgtcgcagaacctaagccaccctctagggtagagtcgttagtcgtgtgtttccttgcttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtgacactagtccaacacctgattaaccagaaccgattgcttatagagatactacagcagcaccagacgccaattctgaacttgagtcaaatacaacctcaagtgcagttggaggcagtccaagcactcacaccacaagtcagcgcaccgccaacatcccaga

SEQ ID NO: 50606 - DNA, 171 bp, Oryza sativa
gagggctctttttagaccaaggagaatttaacaaaaattctccgggccatatttgaatttttcttgtacgtattttagtgtttgccaatttcttttcgaattttaattaattctattattcctgttagaagatgatttttatttcgggatgaatttatcaggacgtgacat

SEQ ID NO: 50607 - DNA, 301 bp, Oryza sativa
gggtccttttttttgcatttgtcaactaagagaataggaagtgctccaatctaccgcgtccatttcaaatctaaaggctagcaataggatatcgcattctcccaccgagaagtactattgcactggatacttcccaacttcccggatattcccttcattctataatataagggattattctctactgggtaagattaaaatactagaatatcctattaaatgatatttgcttatgggtgattaggtagttgggagttgtagaaatttggacatgctctcttccaaattcacagttttagga

SEQ ID NO: 50608 - DNA, 1501 bp, Oryza sativa
gtcatcgctgcggcgtgttccacgccgtcctcgcctccatgcagccgttgccggctgccctcgtcgtctcctcgccggctgccctcgtcgccttctcgccggccccggtcgtcgtcgtcctcgtcctctcgtcgttcccggtcgtcgtggcgtttgtccctccgtcaagccgttctcgttcgtcgtcctcgcttcgtcaagatcgctgcagccccgtcctcgtgttcgtcctcggctccgcgtcgtcaagcctcgtgccggccgcgtctcgccttcgcccaaggatcgccgccgaagccgtcccctcgccgttcgtctccgttgtgcccgtctgtctccgccgcgcccgttcgtcgttgtcgttcccacgcctcgtcgcgtggtggtaaggtttcctcctctcgcttccccgccctcgtcctttcggtgtcgccccgtacccgttgtgcggtcgtcgaccccggtacccgtgtaccggtgtcggtagtcgttcacgcgtgcgggtggtgaccgtgtagtgtccgcgttagtgtgcccgctcggtagccgcgtggtttccacgtgtgcaacccgggtggtgtctagtggagtccgtttatcggccactcgcctcggttgacacacggggtccgcttccgtcgacccgtggaccgtctctgtgtacccggtctaccgtggtcctttaggttgacatgtggggtccgcatgtcaacggcgcagccttcctgtcttttccaggctagcgcttacacatgttttataattgcaaagcttaattataataattcgcaaatctccatataacagcattaaacttcggatgatcatatcttggtcatacgaactctgaatcgacccgttcaagtctcctaatgtttgttataacctaaagaaccctgtgctttctttttatgtgttgttattgcttctttataggcttttagctttgcttgtgtgcttcgcgtagcttctgtcgttccggaggttcccgaagcgtggttcgtggtcgtcgccgaaggttcggaaggccgttatctctgagcaaggcaagtcacatcatccttgaacatattgaatcccagtttgtaaaattatgttgatttaaattattgcattatcgctttatttaaattcccgcgttatcactgttttatttagccatgcctattcacctttgttatgacattattattgctattgttattattaccttgttcaccctagaataaacaaaaccccaactagtgggtactctattcctggttccactagtatgaatttaggtagatgcttcgctgattaataggacaacattaggtggtttttataactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaa

SEQ ID NO: 50609 - DNA, 1501 bp, Oryza sativa
tgttgatttaaattattgcattatcgctttatttaaattcccgcgttatcactgttttatttagccatgcctattcacctttgttatgacattattattgctattgttattattaccttgttcaccctagaataaacaaaaccccaactagtgggtactctattcctggttccactagtatgaatttaggtagatgcttcgctgattaataggacaacattaggtggtttttataactttagacttgggaaattctcatatcatttggacactatggaatggttggcttatgttggaattggacacacacctctcttcctctttcaaaacccctaaaacctgttttcggtggggtttgggtgcatgccagttgtgggaagtagcaccccggccactataaggattaagctcgggcctctgttgcaaagcactactgtacttccacatgtctaatgggtaaggcttagtttgtggctcagtctagtcataaacaaaagtacacggattggagatggatgaagtcgggtgtcgatggacattctccagggcaaatgaaggctacacgagctgcggcccggtagtcgagatgtcatatggcagagggttggtgccctgctgctaggggctcagttctgcctgcctgtcccgggtatcccggccgtaggtgggattgggtcggtactcttgtctaaggctaggatgggttggaaactatgtcacgtctttcgcctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatatggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatagctttgggcaactaagtgacttataaatgctgcttttctgcaaaacttaacccctatattattactccttgtacccccttgcattaaccatgcatctgccggtgtgacttgctgagtactgtggttgtactcattcttgctcaatctttccccccttcagtaagagaagctttggagaagatgtcttaggcggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccagtcgcgacag

SEQ ID NO: 50610 - DNA, 1501 bp, Oryza sativa
ttatcaaattaggaggataattactgtggtacatttcttcaagcagatgcattacctccttgactttaccttcccttcccaatcctgccaaaagtgtattgtaagtcccatctgttggctctagattcatttcttttagttgataaaagatccgccaggcttcatcacccctgcctgccttgtagagtgtatcaatcaaagaattcacggcaagaacatcaggaacacaattattttcaatcatatcatagaaaatcttcacagcttcatcaaattttaatgccttactacaacacttgatcatcatagtgtaggtgatagtatccgaagaaaccaccatagcttttaattcatgaaataccctttttaccataccaagtctaccagatttggcaagaccaaacaaaacagcattaccagcaacaacatctggcacaatccctttgctcttcattagttcatttctctgtattgcctttatagattcaccagattttccatagtaatttatgaaaagaacatgtgtgtaaccatttggtttaggtccatgaatatccatatgtttaaacagctctaaggcatcaccaaatctatcagctttaagaaaccccgatatcagcgagttgtatgaatactgctcaggcactatacccttttgtttcatctcatcaaacatttccaaagcttcaaagaccctcccaacttggcacaatgcatcaataactgctgtataagcaacaacattgtcattgtacccatcagctttcattgcattccagatttccatcactgattgcgagtcaccattgtcaccaaacttatctaacagagtaatgtaggtcactcgatcaggtttttgatcactcttcttcatcttccaaaaaacatccttggcatcactgatacggccagcatcgcaaagaacctgtataagcacggtatgggtaatgacatccggcttacacccttcattctccattttcgcaagtatccgataagcttcatcgaatcttttggcttgtccaagaactcgaatacagatggtgtagctatacacattcggcttcacgccatgagcctccatttcacgcaacaaccaaagaaccgtctcgacatccctcctcttcccgaacgccaccatcagcacagagtaggttctcacactaggcacaacaccatccaccatcatcaccctataaacctccaacgcctccctatcaaacccggacttcacaagaaataaaccaggccattatacgtgtacgcgttcaagacaatcccggcctccttcatgaccggcagcgccaccggcgcgctccggagtcccccctccacaccaagccctccgaagatcgccgcgaacgtgcccacgttcgccttgacgatctgcctctgcattacgtcgaacacctcggccatgtccccgacccggccatggccgcgcatgagctcgagcatgtagttgcacgacgcggtcgtgtgggccaccctgggcttccgc

SEQ ID NO: 50611 - DNA, 1501 bp, Oryza sativa
cttctcgtcgccgtcgccgtccgttccttttccgccgccgttttggtcaccggtgtgttcgccgcgttgtcctctacgtgctggtgccctccgttggtgccgtggtgccgccgttcgccggcgagtgtccgccgcccgagccgtcttcttcgccgagtcgccgccgtcgtcggtgacgtcatcgctgacgtcatcgggatcctatcccgtgagccggtcgtagaccgatcgatcttggccgtccgatttggatcggatcaatctcggccgtccgttcgtgtgaaccgccgcccgtgcgccggtccacccaaaccctagttgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttttgtgctgttttggtgattttgctcttttctgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttatattaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtgaattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccatgcccgcggttatgggcgggtctaacaatgtctttcgtgattagtctcacacctctcatcatagtaaaagatgcttaaactggtaataatttgattagct

SEQ ID NO: 50612 - DNA, 237 bp, Oryza sativa
gagtgaaggggagggccgcctatctccatctggcgagcagagcaagagcaagggaggggatcctggtgtggtgagcatccacatcctcttcatgattcatctctctctctcccaccgggactacttttgcctggaatttgctttgctttcgttaagctcctctcttaatttccgatacttaaccttaatacaagtagtaacagtttgtttgttcgtctcaagttggattctcgctga

SEQ ID NO: 50613 - DNA, 1501 bp, Oryza sativa
tcacggcctcttttcagtatgtcgtggtggcatgtcggcgcacggaaacgtgtcgtggggctgtgtcttgtgggtacagttgtacacctctgatcagagtaaaactattcgaatagtcgtgcccgcggttatgggcggtcgaccagatttaccgtaattagtctcacccctagttagctaatggaactggttagttcaggtggtggtttgggcctgtcttaacgtggtgtagcgttgagcagtgattggttaatattgattaattactgcaactgttttactgctttcaactactgcttttaaatgctagctttatgcaaaagaacctttagcctcccttggatatatcctgcatcatacctcctcttctggtatgacttgctgagtacagtgggtagtactcagtcttgctctctttttcccccacaccagagttgaagttcttctcagttggtgatgtctcgaagaggttggtttcgtcgctaccgtcaaggattgcctgtggaatggagtcgcccgctgcaggagtcaagtcttcaggcttatctcgtttttttcttttccactgcatttgtaatcttttatatttttgtaagacgtagatttgtatgtcaacaattgtcgtttgtgtaccctggctggtcctggacaggggtttaatgcacattcagcttagaaattctggttcgtgaatttttgggcgtgacaagttgttatcagagccgaccttgaccgtaggacaagccaactggaaaccctaagagccctctgaaaccttttcatctgcacatgccttttgcacttggatttgttttgggaaaattttggggtttgctcttttgattcgtgggaaaaatcttgatcgctatttcaattggatttatcgactaggaatagtatggtgttttagaaaaacattatttggaatttatttggcagtcagtcgggaatttgttaggtgatatgcactaagtcgtgtctaggttcgatgggcaattttatgtgtgtattatagctatgcatctattttgtgcattaatttatcgtttagtcagttgcattagtatctttgtctgggttcatgaaaaatgttccacgcataaaaatcatcatgctcggcgagttacttgagtcatttgttgctttatttaatttggttttgagcatgtgttggttcctatccttctgtcctctttagatgttagacctgttcctcgttcgcaagcgacgctccaagcttcagagtcgtcgcctttagccttatcatcttcttagttttgattgcttgctagtttctgtgtttaggtttgttgcttgtgggttagtcggcggtcgatatcaagtgccagtggtatggctgccttaattaggagttgtttgcttccttttcagttttttaatcaagattaagataattgcacttaaatttacaagaaagattagttgccgagccatctgtttaattcctttctcttatttctacctatcctcgtccagatgg

SEQ ID NO: 50614 - DNA, 375 bp, Oryza sativa
ggggagaggagagagagggagggagagttgggccgagccggcccaagaagggaaggggggaaaaaggactttttagggctttttctttttataaaaccattttaactttgtttatttcttaataattattatttgtgctctgaaaattccactaaaatttgagggctccttttagaccaaggagaatttaccaaaaattctccgggccacattcgactttttcttgtacgtattttagtgtttgccaatttcttttcgaattttaattaattctattattccttttggaaaatgatttttatttcgggatgaatttatcaggacgtgacagcagttatgtatggtggatgcatggccccggacatattatgaagt

SEQ ID NO: 50615 - DNA, 1501 bp, Oryza sativa
attttgtggccgggatggtctcttgccagaggagtcgctggcagtggaggcggtcagtggtacttcggtgtgctggacagcggcggcatccaccatggccttcacctgagcgatggtggtcttgacggccgggtcgcctggaatcggcatgttgtcgaggagggccttggcggctatcatgttgttctgtagcgtggtgaagacatcatgttctcccaacttgacttggaggatggcattttgggcgagacggccgcgctgtcgcagctcgtttagacgccgagtgaggtcctcctgctgctactggatacggcgcttctcctcttcgtactcccttttctcctcgtccgtctcttgaaagacgatgaagacctcgcgggagtgatggcttgaagtccgggtgttgttggagcttcccgagtccgagtcggagagacgtacagactcatcaaggaaaccaacccagcaggatctgagctcccgcggcagtcgaggacggtgacgcggagcggccgtggtgtcccgggcaccgcgggggtttggacgtgatcgggcggctggtgtcgaggttgccgacttgaaatgccttggcagaggaagcaacgaagttgctgataccgagaggtgctggcggtgtagttgtcgatggcgtgagttcccacgaagccagcttgaggacgccggagttggtggcgaagaagtcgagactgccgaaggagagagcttgattcctggagggtagcggtaggctgtaaccggcccgatgacgccgaggctcacctgacagaccttgccgaagctgtcggcgatgaagtcgaatgcgccaaaggagatttgggtggtggcagggaagtggtggtgttggtgatctcaacgccggtggatgccatctccgccttgaaaataatcaagcgccccctacctggcacgccaactatcgatttcttggatcggcaatatattttatggggtgcgctagataagaagagatggtgacacataagtttatcctggtttaggccctcagagtgagataataccctacgtccagtgtgtttaactctgtatccggtggaaaaatgatccgaagacctccctcagactgccaccggcgccttttatactggcttaggcccgccggcgctaatcagggtacagtatccttataatctagatacttgcctactattacatgatacgtggttcattgccatatctgctatagcttaccaactatacaacacctaccatactcggaattgggtcttcggcccacccctgaggacgcgatcttagtcctcaatatggggtacccgggtgccacatacctcacactttttatgttggttttaatagttagagagggagtcattattacgaatcagattcgacccatatctgaggtagctaaatagacttttttttcctaattccacgaaaaacttaaagcccatctgaaatcgttagttttgctcttgctcagttgccagggcccatctga

SEQ ID NO: 50616 - DNA, 1501 bp, Oryza sativa
caaaaacaacttctcctccatcccgccctgagctgtgggcgggcccagcattctccaattcaccacctgcctagttcgctcccaatccccaagttctctctgcgacagaaccgcagcatctcacttgaattgccactatttgagcggtctgatgaagtggaggtgaagccgcatgctaaatcggctccttcctcgccggtgggtggatcagggtttgacttcttcaatgataatgaaactgctgttgcgacggagaatcttaggaggattctccatctggatatttccgatcattgaatgatgggaggatggaagggtagtgtctgtgtacataggttatcatccactgactttagttgttcacatgcatagtagtgtatagagtaatgagaataataagttaggtagtactgtatggtcaaggttatggtggaggtggagttttgtaggtgaagcatcttctgaaagttgggtagtgaaaactgtcatatgtaggtgttgttaaggtggacagtggggtaaggatagggtggatggcagttgacataccttcatagcttgggctcacctatgatgttttaggtgtagtataaaatcttatttgcatccatggcacctgtgatgaactgacagtggcactctgccagtgcagaaacatctgcggttagttcatttcaggtagaatagcatagtctggcagcttgttaacgatagcatacattctagtatcttagaccccaatcagatgttaaatagttctagggaaactacttttcttgcatttctttgcatatatataacctcctagctaactgattctcacccttcaaccatcctgacctccctggtgctctgcaaagaacaccaatatatctcctcactggctcttctgctttttggaaggaagaagctgggtggaagatggaagctgtcccctctcttgctcccttctatgtcaatactaactttttcccagtttgctgcatatctatcatgacatgttctctccaccttcattcattctagattcatctcatgtctcttcacaagttgcatttagtaccaacctatattcaaatcatcatacaccctccgaatccctttccgctttcatgagctctagttttctacttctcttcaagcctcgatggtcttgaggaacaaagttagacaatgatgtctgcggaacatgcaagtcccaatatggtaggtttgtgcttcattttgttttttcagatttctgtgaaatgcttgttcccttactagatgcttgatattagactcctgtacttatgcaggttggctttgctgttcatatttaccctatgtgaagacttggaagttacctgtcttagttcctgctacattactatgtttgccacctagcagtcaagaagcactttgctggagtattagttctgtcaatgtaattccaatcttagatggctgtccatgttgatgttctggtgtaaatcagcaggcatagtgttaacaaataatg

SEQ ID NO: 50617 - DNA, 399 bp, Oryza sativa
catatactaatagtataataaacaactattgtataaattagctattaaattggctatagataaattagagccagtagttggctataccattaaccttgctctaagagcacccgcaatagtaaagtaaggtgctatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaagtaggaaaatatgctgacatggatctcttatagagagcctatagataaccattgtgggtgccctaatactacatgcataatactacatgcagtca

SEQ ID NO: 50618 - DNA, 1501 bp, Oryza sativa
tcctaatagagagttatggtcaactctgtatcaaagagacggtaaaaattcaaaaatgtaaaaataatacatgttttaacagtattgatcaacattcctcctatataatgatataaacttctaagctggatagtggccagtgctcaaattgtagtagcttagttcaggtgcctggccttgctggcaagggccacgacagctgctatttcaggttcagaatcaaagcttcaagtttcaacctcccttagtaccatgtttagatggagtaatatctcaataacatgtaaatagcacaacaatcatcagcatttacatagttggatttgatcaaaccaataccagatcaactcagattgagaaattagaatataataaaaaattggctatcaatggcatttagttgtaatataaaacataataatattatatagttctgattaatgggatagtaacattatttgttaacactatgcctgctgatttacaccagaacatcaacatggacagccatctaagattggaattacattgacagaactaatactccagcaaagtgcttcttgactgctaggtggcaaacatagtaatgtagcaggaactaagacaggtaacttccaagtcttcacatagggtaaatatgaacagcaaagccaacctgcataagtacaggagtctaatatcaagcatctagtaagggaacaagcatttcacagaaatctgaaaaaacaaaatgaagcacaaacctaccatattgggacttgcatgttccgcagacatcattgtctaactttgttcctcaagaccatcgaggcttgaagagaagtagaaaactagagctcatgaaagcggaaagggattcggagggtgtatgatgatttgaatataggttggtactaaatgcaacttgtgaagagacatgagatgaatctagaatgaatgaaggtggagagaacatgtcatgatagatatgcagcaaactgggaaaaagttagtattgacatagaagggagcaagagaggggacagcttccatcttccacccagcttcttccttccaaaaagcagaagagccagtgaggagatatattggtgttctttgcagagcaccagggaggtcaggatggttgaagggtgagaatcagttagctaggaggttatatatatgcaaagaaatgcaagaaaagtagtttccctagaactatttaacatctgattggggtctaagatactagaatgtatgctatcgttaacaagctgccagactatgctattctacctgaaatgaactaaccgcagatgtttctgcactggcagagtgccactgtcagttcatcacaggtgccatggatgcaaataagattttatactacacctaaaacatcataggtgagcccaagctatgaaggtatgtcaactgccatccaccctatccttaccccactgtccaccttaacaacacctacatatgacagttttcactacccaactttcagaagatgctt

SEQ ID NO: 50619 - DNA, 333 bp, Oryza sativa
caaggtttgttcattacctcgtgaatggcactgcataagaatttcatttcactgcatcatacaatcatagttgaatatatgaaaatggtttttcagtagcacaacattgtaaatgtgaacttgctgccatggcaatgttcttttgaagtagtcattcataaatcatggcttaaattcactgcgtcatatgccaaatatctgcattcagcattcgccttctgtatggccagttgcctggtaaatggattcagcaaacaaacaatatcagagagtacttgcgactacaattctgcagttatcctgtagaactgacaatatgaaaccatatgcaga

SEQ ID NO: 50620 - DNA, 421 bp, Oryza sativa
aattatgcgttttattcatagtcccatttgttgttttgtttctacttatataagttgaatttgaatatgcatgtttgtgaagtgacatgtcacgtattaatctatcttactaaatttttatattaatctatcttactaaattttttttgataacctttttaagtgaaatgtaaaaataatgggatattctcttaaaggatgaatatagttttcctgaaagacactaaacaaagagggcagctaccgcatgggattctgttacaacatgaaagtcacgggataactaaacaccctcggccgatttaatacattccattttcgaccaagtgccacgccatccacacgattccccctacctaccacctccacgcaaaaacctcgccggcgacgccttccccatccaagagcctactcggtatca

SEQ ID NO: 50621 - DNA, 159 bp, Oryza sativa
tgtttaacgcgccgttttgcattttagcaagcatctgagcccagaatctgggattttacgggcgagttaggccgtacaatctaagattgacgtactgttcgcttaatcattttgtaacttgaatccttgatagctcgcctgtttataccatttcgtagt

SEQ ID NO: 50622 - DNA, 1501 bp, Oryza sativa
tctttaatatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactccacatcagcaggatccgcttcatcttcttcagcaactagggggattatttatatagagcaagggtgagtacgggagtactcagcaagccaggggaaataagtgtttaatgcaggcttcaaggagaggctggtgtttttgcaattgattttatttgaactcttttctgaaacaactaaatgagtgcttctcaaacgacacggatgagacagtgcgtctcgtccggtcggagtatgtgcaatgtatcagtctttagattttgaaacgaggttggcacccggccaacagcttttcaaacggccactcgggccaacaactttcaaacggccacccgggcctagctgattccatcagctacagatttttcaaacatcgaacccctttccacaacagcaatttcacaagcagaagttaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgccgagaggggtcccagaccaacaacaggttaggtcccagaccatactgtgccaggaagcccaggggtcctccccgacaccacctcggcgaatccacatatctctcggcatcaaggctcccctgataagctagttactcagccaggggtgtcccattccacccatgtggtcgtacttgtcttatgtttggatgaaattccaaggaaacggtccttaagtgcaagagcgggaaaccgtacacccggtacgttccccggtccgcggttttggaaattcatttagttcgcaagcaccgacctaggtgtcgggttttccaagtcttttgtaaaacccaagttttacccaagttgtttttcagattttaagtttgaaggcgtccgtcgatactcgcactgggtgcacgaatatcgagacgcaactagatggttgcaaggggacatggtatcacaattaacaaaggacggatcaaatgcaacaaattaggtaggtctgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaac

SEQ ID NO: 50623 - DNA, 1501 bp, Oryza sativa
ctcgttagcgtcacttttatttctcttgcatcagagacactgtgacgctaataatgtatctgcgtcaagcatgacattgtggcatggatatgtagcgtcaaacaatagtcaccataattattaacaatttatgtaccttgtattgggcactaaagcttagatcaggccttactccataactcttttgtgctgttagcttaggcgttgttagtgcttttattaagtttccttgtcagtcttgtagatcatctgtgcgctttttatattatattactatagggtttcccctactgttctcttaataattaatttccgatgaaaatgtttaacaagcactactacttcaaatgcacttacttttttcatatactaacaactttagtagtatctactaaattttcttccttttttgccagtcacaaagtgacatacatgaaggcagaaggcttcttttccaaatgggcctggtgcatatgaaatatatggtttcttagccacaaacactatgagctcaattggtgaaaggggcgatttgttgataaaggtatttctatatctttcttgacagcttctcttgatagttccttcctggtgcacagtccttcatcaacaaacgcaggctgttttatcttctttcaaaaagagagattggctcagccagaggcagatgcctttaacatatttgcacattagacggaaaagtcaagttacaaaaggaactgtcttgaaaacaatgtcacttcaactactagatccagaacatgaatgaaatagctagctagtgcctaggggagatctcaatgagcacaatgctcaccataatgattttgtacatagccgtggtaataaaagttacacctttggttgatctgactgctcttattatcttcacaatctgccactcgaagcttgatgtgctgcaatgctgctactcaagtggtcttaactgcacgaccatgtagttaaccgtttacaatagcgcaatatgattattgagaattttaaggatattttattataaagttcagtactactatatttagtgtttatttttaacttaatgctgatttttgagaaacattttcaaatgagtgtgttctgtgtactgtagataactatggaatgcatgaatccagctgagttcacttttacaaaaagctttcccaaactgccaatttataagcattgcctaaaagaaaaaacttagtttgtgctacttgcagcagtcataaagatctagtttgttatcaaatatgtactgaggtattgcctggcaaatgcacactaggtagattgtctccagtatgctaaggtcttcaggctaacaattaacttggaactcttgtctgtaaaaaccaccaaaagatggttggtggcttgatgcagcttcaagaaccaaacgcagtttgtgtacaagagtaaatatcgagtgcaaacctgtttttgagtgttactatttactagtggactaacatgcatgatgtgttcttatctgtccagg

SEQ ID NO: 50624 - DNA, 974 bp, Oryza sativa
ttggcgcagattgtattgtgtaaaatcaatctttgtgagtcattgtgacacgcactcaatgaaaatttcatggctcctctactgctgtgtggtgctagaatgctggaatcgcttagggcgctggtggtggtggaggttttatgttgaggaaaagggaattagatgggaactaatataatagaatgctgggtagtgagaaacagaagagtttaggagtgctgttagagcaaatttgcggtttgtagagtagcattgtttgcaagcttgttctagaggaacactatgagagaaactttatgacattttcttttagattttcttctctatgtacattgcaattgagcttctctgcgaaatgtcactcaattatctagtctgagtggcattccgccctgcttagcggacagcactggggctggtttatcaggctgaaggacaatcttccctaattagtggacatgcactggggtggtttgattaacccagactgatgattctggctgtggttattgtacccttgcaagctccctttagttgcaacaatgttccacaataacagatctttatagtttgcattgcatatctcttttgggttctgttgtgattgccttgttgtaattgggcagaggatgggaggagtaacactgaataatgcatcaaccatgtgtccaatacattatttgcttgctagttattttgttgaatccagctaacacgatgcagaattctaacatttgctatattagtctgagttctttttgttctgttgtgtgatcctccttgtccatggcaggcaaatgcttcgtgttgggagaatttgttcaagatcttcaacccgtgctgtttcttcattcctggtgggtccaagacatttgattggtcatgaaagcccacatttcttgggctccaagtgttgttggactaaccggactggtgcaattgggttcctgaacacaaagctaaatattggtagt

SEQ ID NO: 50625 - DNA, 181 bp, Oryza sativa
ccaattattgtcacttggtacacaaacagtaggggctcatgccttaaccattctttgttgcgtagggagtacttgtgtagggtaactaatagccaaagcatcacaaatcacaaaccagaacttgacagaaaattggcctttttaaccagcacctgacaaccagccaattttctgttacagc

SEQ ID NO: 50626 - DNA, 965 bp, Oryza sativa
ggcagccaccgagtcaggagtgccgcgcgcaggacgggggtgaggcggcgcgcaggctcacgagccgcgacggcgggctacgcgtgagcagagcgcgagcatgccagagtccgcgtccgcgtccgccgcgaggggaggggatcccggcgacggcgagccggcggcgcgcgccgcctctctctctctccgacgcagcgtgcgccggccggagaagacgagtgggctgaaataaaacgaaacgccaggcagatgtaagattgggcttttgttatcgtcctagtgggcctaccgaagcccaagtttgttacaaaagcccatgtaggcccatccgatgggctgggacttaatcgcacggcccagctaggttttagaaaacaaatcggcctgaactaggataaaaatcaagtttcgttgaaaacaaaatcttttcaattttggaggaaaacagaggactgataaattgataatactagcaagttctggatcgagaggcaaagagctcatctgaaccatattttttttatgctgttgagtgctactattgcttatccaattgaaaaccatggtccatgattttctttctggatttttgtactgttctttttttaggttgttctcaatgactttggataattctctgttaatacatatagctaatactctcgattcatgtttcaacaaaagcaaattatggttttttttcctacaagaaccattaacaacatgttcagatgattcagatttcctctctaacaaaagatttacaaagcatccatgcacagaattgcttgtaaaactgaacagctatcagcaataagctagaggcagagaccaaatgcaacactgtacacttgctgcttagagatggacagtccaatcaatccgtaccactattaccacactgacccactagcactgccattagtgctggtcactagcactaatgacatcactgacatgcaaat

SEQ ID NO: 50627 - DNA, 1501 bp, Oryza sativa
aggtggagcccttgcttgagcacctgcgcatggagctcccgcacatgggcgacccgcggaggttgtgtggcagcgacgacgtccctcacgtcatcggcggccggactgccgacgccgacgcaaccatggacatggacacggacacctcacaattcctctttggcggcgcgacggccgaggtggtcaccggagaggaaggcgtggtgagataggcgtggccggcaaggaaggggaagatggaaagggggagttggaagaagtggtggttgccggcggcaagatgggaggaagaagacgactgggtgggatcgatcccctttctcacgcaagtcaacgaaatggctaggggcaaatatgtcggatcacggtgaaaacatttcgaaataacctaaattggtcgaaatggcattttagcgagttggctttgtttgaaagtgacattttaacgaagccatattcgggagtagcattccagggaaaccctatcccgaagatggtaaaatatcaattttctcagattagtccaaactaaccccaccaaagctaaaacgtcatttatttttcatacaaacagttaaggctctaacgtcaactaataatgaactctaggattgttttacaactcccgccggagtcgttcgtacgtcttgccctagaagccgctcgccgtgcttctcctatgcgcgccaccgctcgtgctgcttctctaatgcgcaatgcccgacgatcgataaaaagaattgattagggctcatgttttagatgtgtagcgcatgggtaatatggttgtatcccttcatatttcagccaaaaataaaaggaaaaaaacaatatctaacagtcatagcaaattttgggtggtattaaagtgtaccgggaacgtttagtgatataaagtaaaagtgggggaacgcttgatggtgtggaactaattttgcctttgtattattagcggtttaaaagctaaatccggaaaatagattataataactaaagtgctcaaaatcaattttaaaaattgagtttcaacaagaggggccatccgcccatcacaggaaaatatgtagtgcaaactctatatgcgtagtggaaacttggaaattaccgttggatcgaaaaatggacgttcgagattcgtccacgtcatcatgagttaaaattttactctaagtgaatctgcaagtaaaatttttacccgtgatgatgtggactaatatcatacgtctattttttttattcaacggtagtttccaggtttacattttatatacgtagtttccacattatattttctcgcccatccctgccacaccctcggtcccacgtgtcagtgtgttgcacagtcctctagggcctagctagctcgcttacctgctcgcgttccatatatccagctgcagtcaaaaccggagagaagcttagctgcactgcatcaactgcatctgcatgcatgtatttaacagacaccactggagcttcgctaatggcgacatcgtagcta

SEQ ID NO: 50628 - DNA, 515 bp, Oryza sativa
aaaccaatcactcaatcacattgatgttttgatctcaattaaatcctctttggaacaaaggaaaatgaagaattctttttaggattttaatcctatagttattttttaaaaaaatggtcctttaaacaaaggactggatctatgatttttttaatggctcaatccatgaagatgttggagaaaagttagcatgggattcaacctcgtgaaaaatttatttgagtctatctctctcattcaattcttgtgcatttcttatggtctttccaaataaccattcatcatgtgttttctatttctctattttgcatatgcatttctaccaaaatcctttttcttctattcctgccgtttacgattcttgtgttccaaaggtggcctaagtgctcttaaccaaatatttgttccatttatggtatatttgcattgtttctgtcaatattaattcatcctagggtctgatagtacttcctttacgaaaatactttcttacaacatgcatacatgcacattgt

SEQ ID NO: 50629 - DNA, 426 bp, Oryza sativa
gatatatcattcgctaaatttcacgcgcactcgtggaaaagggatggagcatatatatgttagggtgttggacgtttattgtcgtacctaagggatgcgacatctttttagcagcacggcttgacgattttttagcagcacggttcatatgtttgtaaagttaattatttgtcttgactttgctatagttaaaagtacaaaacatgtggtaagcaatacttcgcatatttgtttcagattagctggtctatttgtttcagatttagcttataagctgcaatcatttttgaattataacttaattttaagattaaattaggagtattgtgctaaaattgttttaactccggattattcttttctttaacttcgaactacaactttctgtttccgttagtatgtttttcaaagtattaaacgatacgt

SEQ ID NO: 50630 - DNA, 1056 bp, Oryza sativa
tttttttaatgaccagtttgaactttcatctctttacagtcatcaagcaagaaaattcttggcgattctggtttatatgacttcctggaagcagtaggaacaacaagagttactgaaccagaaattgaacttgccttcttcatgcatcagatgaaccataaagggaacaacactactaccctctccaaaattgagctgctcaggacttcgtagaaatttacagcttcaggacatgtgatttatccattctcttttactgtttattctaaaatgcaaaaaaaaaagaaattttgttgtagcttagattaaggcagcctcagctttgtggtttgccaagccatgtactgatatatgaatgtgatactttaattaatgttgaaacgcatgattatgtatttgaactgaattgactgaatgtgtcctggaatcggtttagaacttaatatatcaatcagacttttgttctttgcttactggtttttctgtgacatggagaaaagacgttgaagacataatacatcgtcgactgaatgggtcgaccttatggcttgttttgcaaattttgaaccttgtcctggatgtagtttatttggcttgtttatccctttcgagtatataataactgaggaacttctaataagcttcttaactaaactcgctcatatgtaagtcttaattaatgtcttgaatctatacttgatagcccaaacaatatattgtatatctttttgttgtttcgccgtagcgttagcacgggcatgtaactagtataaaatagttatcaaatttttttaaaagaactgataagatagatcaatatgaaaatatttcactccataaacatacaagtttaaattcaacttttataaattacaacaaaaatgacaaatatacccgtgaatgcgggttaactatttccaatttaatttattctttttttaacatgtggacgttgaatttaggagtattataatactcaatttgttcggctttagatgagtgagaactggcacagcgagaactggcagagccctggttccggggaggcgtcggcaa

SEQ ID NO: 50631 - DNA, 480 bp, Oryza sativa
ttaggggggcttgtttgcaaaactgggtgcatgaaactcagtgaagtgtgctctaagcattgaagtcactcatgtattatgttcttgttaacaacgaaatattgcatcagattcggattagaagaagaaagattgaggtggatttggtgtggaatcgagttgatctccaagttaggctacgcatcggctaagtatcgtatcggctgaagaccggacaaaatcttgacttggttgatatagcaagcagacgatacggtacaacttgggcttggtttgggcctagatttagataaccgtcatttccaataatagatagagcccaattaaggcaattgtatctatttattagattagtttaagtcgtttgtgactaattttgataagagaccactgtatatggtcttgtttatattttatctttagaaaagtttgagtcatatccataatggactaagtttgtactcagggtataaatataga

SEQ ID NO: 50632 - DNA, 1501 bp, Oryza sativa
  unsure (1)..(1501): unsure at all n locations
gtagaacaaattaacgagaaacaatttgctttccacgagaatcagggaaatattttgtaaatcaggattaaactattattatcaaatcctaaatcctaaatatccaacagattttgtatgttccaatggagaaggttaaaattggactgaaccatatagaacacttttcacacttctgaaggaaaaaaaatgggacaaaattggttgtatatgatgtcaaaatgatgagtaaattattgtgttcaaaattccccctctatgagtatagatcacaaacttaatgttccaattaaacgttgaaagtttcatagatttgacctttggaatatacaagttttgctgtattatgacaagaatcaattcaatatatcatgtagggtgataggtataatttcattgaagacaacacaaaattctttcattttagcacgatacaaatactcttttgtcatacaaatgtttgaaatagtttctcaaatgcgtagtataaaggaacaaatgacgtacatagatnttccttgaataataatatcataatgtcacaaacttatatgtttttaataaacttactttggtaaaaaaaatgatagtaaaagtaccaaaaagaaaagaccaactctttttttttttttgcggggaagaccaactcttattgttacattgctgggtacaaactgttttggtttaggttctacacttaacaagggtactcatatttaccgctaattatttttttaagtgcttgtaccaatctacatcaagatattcatggtaattttatcaatatcaaaatatgtcggcccggtatttcaaatgtgctcataaggataagatatgtgtgtatatgttcatagtgtgtgagtgcgcgcccattgtgagtgctacgtttgtatagtactcccttcgtcccaaaataaatataattttgtactgtttatgtccaacgtttaacctttcatcttatttgaaatttttttatgattactatttttatttttattagatgataaaacatgaatagtatttttatatgtgattcattttttaaaaaattttcataattttttcaactaagacgaacggtcaaacgctggatatgatatccatgactgcatttatcttgggacggaggtaatttcttcgtttcatattataagacattctagtatatgttaatgatatatgtgtgtctagatttattaacatctatatctatataaatgtatatgtctagattcattaacatatatatgaatgtggataatgttagaaagtcttgtaactgaatcggaggcagtaatatttaaaaaagttgatccccatttggatccgggctttaccggcacggacccgacccgacaaggcgcgacaacccgaccacatccgcattcaaagctgaagttaattcggtctctcgcgtccgccgccacacactctcactcactcactcccaactccgccatagctgcgagcgagcgagctagggtttggtctctctcca

SEQ ID NO: 50633 - DNA, 815 bp, Oryza sativa
aaccatgcatgaggtgaaaaaaaatatcaggagcaaatcacttgttgcagctacagtatcaagtccaaagtttgtgtgacggttgtggcctaatacacatgcatgggacctgtctgttaactctgaaaactcgcggttgtagtatgatacattaactagagtcacctctagttaccaacagggaccaaaacccagatatactacaaactgcagttatcacagaaatattgtagcagaagaaacccagacacaaatcacttccccgaaggtccatcaagtatcaaccatgccagtacataaacagatcacctagttcaatacaaaacatgcctgaatttaaaatacgaacgcgactcattcattcaatgttttcgtttttaaccgcaggagaaacgctaactcaaagcaacacctaaaataaataagcatcgcatctggtaattaattccaaacattgttcatagtatcataggaatcataaagaaaaagggcgagatatcatgcatgtaatccaatagctcgcagatcccgggaagtggatttgtcacagtatgctccaataactcctaggtccccaaaactgcaatcatcgaagtaatgtcagtagcatttccttgaaggtattgtcaaaaaaaaaagttaagtgtgtgtgccaaacatccaaatttccaatagtcagatcagaaggcaaaattatattacaatcatcctattcaaatctagatacttgcttaaattgatcgatgggccataactaagaactactaggaaattaggaggcagatgaatattcattacatttgtaatcttctagg

SEQ ID NO: 50634 - DNA, 600 bp, Oryza sativa
atcctatgtttttcctattcctccgttttcttcattcctgtgattcaaaggggcccttaagcaccaataatactacttcagaataacaatcagtagtgtactggtgtgtttgttttgttgctccctttcttcaaagattacgacagattaccagtattatattgcgaagaaagaggaaatgccttcatttagtggaatcaagatcaaaccggacccaattaattaattaattactccctccattacagaatataaaaattttaaagttggacacagttattaagaaaatagttagaagtgaatgatgtagggttgtgatcggataagtagtggagataggtgagaaaaatgaatgacggagggttgtaattagttagaagaaaatattggtagagaagttatattttagaataaattctaagagataaaatttgttatattttggaacggagggagtaaatcggactaataaaactacaaaatgtaacaaacacactacctcacctaaagctaaccaccgcaaactgaactagcaagctggaagaactctgcaaaatttgctacctatcgacctcgtcacctccgctgtttgtttgcagt

SEQ ID NO: 50635 - DNA, 171 bp, Oryza sativa
cgtatgacaggtaggactagatattaatagtgtagtatgtaaatattgtatgaataagctcttaaattggctatagatgaattggaggactatgctattaaacttgctctaatacaaaagcactcagctactgaagaaaaacaattccactcgcttcctcacctagccctc

SEQ ID NO: 50636 - DNA, 535 bp, Oryza sativa
tagtaatatattaaactttttccgataaattagttttggttgcttcctttaattttttgtcggcctatcaaccgtacatcaaacaatctgagccagtgtggtatgcatgggtccgaatgtgccttaatgccacttattgtaccattagaatcattgttgatgcggttgaactgttaggcgcatgtccatagggtggacttggacgcctcatggttgatacaactactagaggctgacatggatgtctttggtttgacctcaaacaaggggagaagaatgaagcgataaacatgtagtacttctgggattcggattcggtgacatcgttatagcatagcacggtgtgacattggagcgatctggaacgttgaaatctaatcgaacggtccgctgcgccggcccacctgcagggttcgttttcccccccaagcgctccgtttccctcgccccaatcccccgtggtcgcatcgccgcctcgccgcttcgcctgccttcctcgcccgcgccaggccgccgccacgccaggccggagagg

SEQ ID NO: 50637 - DNA, 1501 bp, Oryza sativa
tcggggtttcagccgatcttaccttatttaaatacatttatcttgtatgctttactgatatattaaatgtgccctttatgttaagatcttgtcacatttagatatattaggttttttgtttgatatattttacttgctttaatatcttaatatagagtggtattggagtattagccgatacatgctagatctatcttgttgttagtatatatttcgatctaagtgatttatactgtctcggcatggcgaccgatctatcccaatcacttgatttaagtgtatatcgacataaggattacatactgttaatatctacagccggtcgagtatatttagttctgtcttacttattaatgactaccgatcaatgcatatatgacatcggctcaacgataaatgatatgtcatcggcacctagccgatcggctatcgtttatggatttaaccgcggtttctttgtctttgtttcttgttaattgcaagatcaaatcaactggcacgctcacatacccaaaggcaagttttggacctgcactggagttaagcagatctcccaggcctcgtgtttttacatcaacagtttaatacttctaattagtgtccaaacatgacagggagtaaaactttagtccctgatccaaatagggtctaaggctgtgttcgttgcccctgttcccaactccccctctcgttctccgcgcacatgcttttcaaactgctaaacggtgagttttttaaaatgtttatatacgaaagttactttaaaaaaatcatactgattcatttttgaaacaaagattagctaatacttaattaattacgtgctaatggaccactccgttttccgtgcatgggacatgggttcccaacccaggctgccgaacacagcctaacacttcatttatgtggatccacatttgtagtgccacatttgtagtggcatggatccaattaataagtaaaccatctctataaattttgtagtatatatcataaaaaaatatatctaatatttgttcgcatttgcagagatgggtagaagttggatgtatggaattgatcgacatatcaaagaacgttgcaaattttataaatgtcgcggaaaaggggaagaaaagaaggaacaatgattatatgacttgtccatgtgtagattgcaaaaatgaggagatgcttgccagaagagtagatatacttttcatctaatatgtcgaggatttataaagggctgcacatgttggaccaagcatggagagcaagaatcaatcaatattgcagatgaaacgagcggtggacaaaatcaggaagatgaagctgaactccattgggcgacagaatggttgatgtcaataacttctctggaagcaatgttgcgtgatggtgaggagccagattacgacaagaaagatttcatgaagttcgccaggttggtcagtgattgacaaacacctctatacgctagatgcaaggcaaaacacatgagtagtggatggaagtttgt

SEQ ID NO: 50638 - DNA, 187 bp, Oryza sativa
ccaaactcccgcgtccgtctcgctgttgggtttcgtgcatgccgtgtgtacgcgctcgagcctcgagagaagtggagagccccatgtgctcccgcggcccacgcatacctggccggcctccaagccaactcacgcgtatgcgcacgcgtccctgcaatctccatgacatgttttgactccgtctagc

SEQ ID NO: 50639 - DNA, 320 bp, Oryza sativa
aatactgtatttttagactgattacagtgagcgatgatttcacagagtaatgttttgagtgatcttttatttatcttgcgattttactaccagaatgtggcatttgttacttaattgtgttgttattatgtatatctaattttgatacaaatacctattaatggtttccatcaatgcccaacacttgcttgcaagaggcacaattcccttttacaaaatcactgtaatgcaccacggtttctttaaactttggttctcctatgttgtgtaagtcaaatgcaaaatccacctctgtaacattttggttatagaaagagcca

SEQ ID NO: 50640 - DNA, 1219 bp, Oryza sativa
acattcggacccatgcataccacactggctcagattgtttgatgtacggttgataggccgacaaaaaattaaaggaagcaaccaaaactaatttatcggaaaaagtttaatatattactaggaaaaatacccgtgcgttgcaacaggtgaaatctattttaaccttattattgttatatgatttaggccctgtttgtttcagcttaagattattgtaatttagattattaaatcggattactctaagctggattataataagctaatctaaaataagctgcgagttatttgtttctctggattattgaagacatctaagggtagtgggtctttagccacccaataatctggaaaaagctcctccagagaagattattagattataataatctggcttacagattataataatctatttgtttgtttcagcttactcttaataatccagattataataatcctaagttgaatcaaacagggccttatttaagataaaattcactgtggaagttcgtttggatatatattttttcagaaaattatgagatgtagttaagagtccgatcatctcaagttagcatgcgagtttttttaaacagatttcttatatgattccttctgtattaccaaaagtgaacgatcgtaaaaaccgactcaaatacggatatatatttccaaaagcaaacgaacttaaaaaccgactcatacatggatggcataccaaaataccggcaaaaacatctttaatttttataatagtagacatatgttttaagttcattaaaagcaaatgcagaaaaagaaagaatgataaaaagaccttaacattaagttttaaaattcagattttgtctgggactaaatggacaaaagtaaacgatgagaaggttaccactaattagaattttctttttaacatttttcatttccttatctagtttgcctttgctaaataaatattatcccttatgccattcataatctaagccacacctagaattatctctagagagggaatgccccatgtagactgagaccacacctcctatcccacagtgcaaagttgtttcaggagcgttttcaatttttcatgtcaagccttaccatcttctattttagtcatcatgtgttttcattttacataacgtctaaaatttagcactacacaccctaaaatctctcccctcccctcaatctctccgttcctcaaccaaccaga

SEQ ID NO: 50641 - DNA, 1501 bp, Oryza sativa
gatccttttttgtagccttgttaagattcatgtaatcgatacacatccttcatccggttacagttcgttgagaattagttcattttgagcatttgcaacgaccgtcattcctcccttcttcggcacaacctggactgggctaacccactcactgtatggtacggatagataatcccggcatgcaggagtttcaagacctctttctttacaacctctcacattgcattattgagccgtcgttgaggttccctagagggagtactctcggggtcaataggaatacgatgagtgcaaagcgcgggattaatccccctaagatcctgaagcgagtagctaagaacagaacgatgcttttctaacacggtgagaagacgttgagtctcgtcttcagagagcttgtcactgattatgataggagcctctctgttattgtgtaggatggcatatcgtaggcctggaggtagaggtttaagctctagcggaggttgaggtggtggttccatgattggcaagtcgagagtctcaccgggatctgcttcttccttgatgaagtcggggacctcatcttccagaagggcctcgggagactcatgaggaggaactgcggtaacctctttcgctgactcaatttctaggagagggtcggtcaaggtgatccttgcccgcgagaatggaattgagattcattctctcccagtgttattttgaggctacctaatcggggtgtgttaatgagaagttgctcaatgggcagaccgattaggatatcaaagtcttggatttcaaagacgtggaaatccaagatcgcctccttgtcttcaaagcagacatgcacatcttgcacaaacccaaatccttcgatgatattttcgttcggatgcttgaagaatttgtttgtcggggtcactgccttatcgcttaaataagcgaatgcaaaagactcagagacgaggttggccccgacagttggactgtagggaataccgacatcgttcccttccagatggcaaggaatgattcggggtgcggtatttatccgaattacttcggatgaaagctctgcctcccttagccattcgtcgctcattatggatgtcaattcccggacaatttctcgtaggaacccaagttccataggattgggaggtgacaaaggaacggatggtttcctcttgctaaaatagttgagggtattgcagtaatcttcgtcaaaaccttccctgaacataattgcggcacaatccggagtctgaatttcttcattctcgacggacggctgctcaggaaccttctcatcaatcgagctagcggaagtggatggttcagcaagtggctcgatcgttagaggtttctctatcttggacacggatgcctccggctggggttcattggactgcgtcatgaaggaagtattttctagaaggcaaaatttgccacaggacacgcaaaaaacgtgtaattggctgggagacatcgcaaaaacgtgacacggctgatggac

SEQ ID NO: 50642 - DNA, 1501 bp, Oryza sativa
gcgtagccggagaggttggtaagggcgtcgggagcggatgcgccaaggggtcggggaggggccctcgtcggccgccaccggcggcgcctaacggggtggaggaggcggcggagcgggcgccgcgcgcggtggccggcggcggcattcgatcgaacaggtggtgggcgcctggtcggtggagcgctttcgtggcctcgtggactctgcctctcgtgatctcgtctcagaaaaacaggatgtagggcctcaggtgcgcaacaaacgcccaatttgacttttcaagaaaaaaggaacttttatcaatgtccaaaaaattgaacatttgctacacccttaactttctatacagtcacatctcatcctttcaatgattcaaagagatattggatgacatcaacagttcattttaaggctgaaaatgcttttaaatttaaaaaatgtacataaatgcaaattttatttaaaaaccatcacttgttatatacgattatgtactgacctagattgttttttcttgagttgtgtatataatagtttgcctgcagaaaatagttctatgatccgtacaaaatcattttgtttcttggaataatcctttgttttgtaacaagtccgatttatataggtttaatatgcacaaatgtgtaacccacattttctatactctttaaagtaaattatcaattttaaaattttaaatgtaatataataccatccatcggttggtattttaaattttaaattagtagctgaattgaaaagatcttttgaaaaggaaatacgcttacaaattggacggattagaacttacataaattttgtccaaaatgaaataaagcttaattttattatattttttgtcatgttttagcactactttcgacaagcaagttatatgtatcttgcttgtaaaaatatttcttttaaaaatgtttcatggataaggggataatcttttttagaattttcaagatcatttagtgatttttaattaatatatattttcaacattacgccacattgtcacattagtgctatgtcatcaacctaatttgaggttgagtttcaatcagcttctccattaggctagtacctctttttacataagttttttgaattgttaaacattatatgctttttaaaaatatgtatatagaaaattcattttaaaaataaataaatatattttttatgtttgtaacttaattagccataacttttctcatgttatgatcattgaaaagctcggccaccccgccaaatcaaacacagcctaagggaaaagtccgaattacacccctgaactattggtgaatacgaattaccccctaacccgaaaattagatatctttcatcctcaactacgaataccgaacgaattatccccttaactcaaaccagagtggttttggtcctataaggcagtccagttagcactttttttaaatcggtggtcccacctgtcagtctctcaccatctgtatctctttcccctcccccc

SEQ ID NO: 50643 - DNA, 1501 bp, Oryza sativa
ctttagacttgggaaattctcatatcatttggacaccatggaatggttggcttatgatggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcggagggttggtgcccaatgctaggggctcagttctgcctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttccctcttcagtaagagaagctttggaggagaggtcttaggtggagtcctggcttataccccagttgagcgcctgtgaagatggagccgtaggcccgctagtccgctgctgtttatttttgatggtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggaaaagccaagtggataaaacctaaggacatattttataaataaaaattatttgcgaaagttcctcttttctccttcccccaatgctttttgcaaaaggtttactccgttcttccttcttcggattttcaactagtactagatggtcaggtcagtgaagaagaggacatcgtcagttgtttgccgaagttccagaagactgcaggatctg

SEQ ID NO: 50644 - DNA, 1501 bp, Oryza sativa
ttttgccttggtgacgatccaaagaaaatatacatccttgagagaccagagagaaagtcaatatgaggaaaagagctagtttgcgaaaattcataaaaaatcccatgagtctggtagagaagcaagaaggactggaatcaagatcgttccatttatcaattactcaagatggtaagatagccactgaaaaagttcacaggtgcaggtatggttgtgaatgatttatatgcttgattcatcttttgaagaaattcattctacactaacctttactcagggacgagcaaagggctaagtgtggggggttttgttggcggctgttaaatgccgattctataccgccaacatctgcataaagattagataataaaacatctaacatagtgataggtgcttatctcacgtattccacaagtgttgatatatatttgtatgcaggtaataaaccccggtgcgggaggaaatctagactaaagtgaggagaattctgtatccatacaaggatgggttgtgaacttcatcgaaacatcagtaaatcagcccaaaataccaagaaatggatagaggaggaccaggggaggacttgggccaaaggccaagccagatgggtccagcccaggttcggccgaaccccctggttcggccgaaccacaatcttagccatctaggctggggtttggcgtggacgtcccagatgcatccctgatggcggttggagggcacttcggacatttccccttcgcctaccgtcatacctacccctatataagaacatcatctcattcacttctacacacacttccaagcttgagctgaattataagaggctctattgtactatattgtatactagaataggaagagagtagagtagaaggagtcggaagaattccggagttgtcggtaatcttctcctatttcttttattctgtttattactctgaattcaatataatattcttcttgagtaatttagatttatcttgtgagaattatctcttggttagtacctaaatagcatacgggattattgttcactataatcaattaaaatatagtgattgctttggtgagttataaacactaaagtagatattaattgcctagatgtggtgtttaggtaattattatccagtaattgttgcgtatcccacagtacgtttgaggtgggtgtagaggtggtgacagccctcgagatcactaaagtcctccttgtccgggtacgtagtagagtgacatctgggaacagtgggttgccagtgcctgaagtattgcgttaggattaaaattaagctttccctagacactgtttctcactagtaaatcctctctatcctggcctatctttttcttggtgtccttggataaaccggaggatgatctgaccacacacgttcccttggattcgatacccttggaatactccgtaggggaggtgctacttcggtatatccatgcgcttgcggattttatctgtaactgtatcaaataccaacagcat

SEQ ID NO: 50645 - DNA, 1501 bp, Oryza sativa
ctctataagcaatttgttctggttaatcaggtgttggaccactgccgcacaactggtgtcttgtgcttcattcactcgggagcttgaggtaccaatgtcctgactcctgaccttattgcctttctcattgtcagccatctgttgcaaaggtttggagagggagagagggaaaacgaaggggagagacagattagaaactaaggataggaccttaacagatctaagtcttttgctgttatgatgtatgttaggcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagccggcttcactgcttcctccacttcactcgcagatcctgcagtcttctggaacttcggcaaacaactgacgatgtcctcttcttcactgacctgaccatctagtactagttgaaaatccgaagaaggaagaacggagtaaaccttttgcaaaaagcattgggggaaggagaaaagaggaactttcgcaaataatttttatttataaaatatgtccttaggttttatccacttggcttttcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttaaggcctgaccatcaaaaataaacagcagcggactagcgggcctacggctccatcttcacaggcgctcaactggggtataagccaggactccacctaagacctctcctccaaagcttctcttactgaagagggaaaagattgagcaagaatgagtacaaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtgttattaaacaaggccgtgaaccctcacgaacctgccttaacccaaggcctacgatgaattggaccgaactggcaacccgacctgggtcccagctcgtcccaagccaacccaggccaaccattccatattttagttgttgagcaaattttaagaattgaaacactgacctgggtacattgctaggcttgcccatatccgagggctcggctattcgaatagatttactctgatcagaggtgtacatctttacccacaagacacctctccctcacgtgttgccacgtgccacataccaccacggtatacggacggaagacgtgacatagtttccaacccatcctagccttaga

SEQ ID NO: 50646 - DNA, 1501 bp, Oryza sativa
attcgttcgggaacaaaacgttgacgacgcagtctatttaagtctatacagataagatcatctggattaccttaccctggggcacgcgtgtcagcaccggtatgctgaaagacacggcagtagatagcacacaaagcagcggcctttgagacaaatacatacggacacaggaaatttaaggaagcatcagttttctggaccaaaggcaggaacagcagaatgttggagtcctctgtacatggatgaggatgcactgcagcaacgtcgacctacgtgagaatcaacgagacagatgccctgctcgatctgctgcccttcgatcacgagagcaacgaccctcttgacgtcaacggcgccaatgtgcaggtttcaacgggggaccatgggagcatgcaaaaccatatcttggcttcaccttgtttggatatcaccaaatcgcagggcagggtgttcttgctattaatttatggcttgcactcatttgcaacattgggattaattccacaattaatcatctttcattctaaatgacagtttatttaatactatggacacattcttagtcattgggttgggaatagccttatccataattttttaaagaattcctatgcatggggtttgagcaaatactctctccgtactcgtaaaggaagtcgttttggacagcgatacaatctccaaaacacaactttgacttcttatttctataattattgaaaagtgatatatgtatacttttatgaaagtatttttcaagacaaatatattcatataatttttacattttcaaactcaacaacttaatagttactccctctggttccattttaattgatgttttggacaataacacggtcaacaagatacatctttgatcttatttttctattataatatatattataaataaatgcatgtttatttttattataatacttcaaaaagacaaatctatatatgttgttctagttccttttaactaaatatttttaaagttattgatggtcaaagttataaaagtttaacttgagagagtattcatcatttatattcccaaggtttgacttcaaaattgtcctaaatgattttctttacgagtacagagggagtattgaccagactattagatcatttagtgtgatcgaggaatatagtacataattatcggcaaatccccggatccctccgtgacctcccagcctttcgcaaattttaacaacattagctccaccgtctctccgactcatcttgccccttttctcctgtggctcgtcatcaaagaggggtaggagagggcttgggtctctctactcccctagcagtggccgttgttgttctcaaagccagtttctcctacgagctaggttcttcatgttctttgttctcttttggttctcgaggtggtcatcgatgttggctaccctcgtcccaataatgtggactagggttcccgatcttccgaaaggttctgataaacagttgatttgggcggagtcgc

SEQ ID NO: 50647 - DNA, 1086 bp, Oryza sativa
attcctgcagccccaacctcaacgatgacaaccttaccgatgcttgctttacctaaaataattggattattcacgcgacaacatacatacatatacatatatatgtactagatgtacatatatatatatatatatatatatatgtgtatgtatgtatgtatatatatatgtatgtgtgtgtgtgtgtgtgtgtatatatatatataaaatctaaaatactctagacaagcgtttatgctagggaccctataggagaaacctctcggttgttctcgtttttaacctgcatcttgtataggcgtctggagaaccagtatccgtagagaagtgttcccctcgggtaaaactgcctggggagacggtaaacacttagctagttcaaatatgactagggatacttgaagatggttgcttaaataggcagataagtgaggcatacggctagtaccgagtaggactttaaaatttctaaatcaagcgccggctgtttttggatccgccaccctgcaaagatcctaaaaatttaaagaaaattttcaagtgaacagtaacgactgtgaacagtaattctgctactcataatagtgaattcagcactaagaatagtagtgaatagtgttagtcctagtaaagtggtatcagagcctagtaatcatagagaagctaaatttagaagctaatattggaaagttaataaatatcaaagataatatcaatataaggtgtagattaagccatactgaagaacatagttggcactctaataatagccaactaaatttaattgtagatttaatatataatttctatataaattggggtaagagacaggaagatttagagcaaaagttagaagatatatataaagaacaaaagcaatttgtagaacaatattcttttcttaataataagctaaatactacattagaattattagaagattataagataaggcaaaataaaatttcatagaatagtgattatattaaagaattaccagacaaaatcaactctagtaaaggtaaggaaatagttttggcttcatccggcatagtctcatcttcacaagccattaattctgaaaaa

SEQ ID NO: 50648 - DNA, 1501 bp, Oryza sativa
gagagatggaggtgaggggagggaaaagagagagatgattagggagagagagagaggggggaggggaaagagatacagatggtgagagactgacaggtgggaccaccgatttaaaaaaagtgctaactggactgccttataggaccaaaaccactctggtttgagttaaggggataattcgttcggtattcgtagttgaggatgaaagatatctaattttcgggttagggggtaattcgtattcaccaatagttcaggggtgtaattcggacttttcccttaggctgtgtttgatttggcggggtggccgagcttttcaatgatcataacatgagaaaagttatggctaattaagttacaaacataaaaaatatatttatttatttttaaaatgaattttctatatacatatttttaaaaagcatataatgtttaacaattcaaaaaacttatgtaaaaagaggtactagcctaatggagaagctgattgaaactcaacctcaaattaggttgatgacatagcactaatgtgacaatgtggcgtaatgttgaaaatatatattaattaaaaatcactaaatgatcttgaaaattctaaaaaagattatccccttatccatgaaacatttttaaaagaaatatttttacaagcaagatacatataacttgcttgtcgaaagtagtgctaaaacatgacaaaaaatataataaaattaagctttatttcattttggacaaaatttatgtaagttctaatccgtccaatttgtaagcgtatttccttttcaaaagatcttttcaattcagctactaatttaaaatttaaaataccaaccgatggatggtattatattacatttaaaattttaaaattgataatttactttaaagagtatagaaaatgtgggttacacatttgtgcatattaaacctatataaatcggacttgttacaaaacaaaggattattccaagaaacaaaatgattttgtacggatcatagaactattttctgcaggcaaactattatatacacaactcaagaaaaaacaatctaggtcagtacataatcgtatataacaagtgatggtttttaaataaaatttgcatttatgtacattttttaaatttaaaagcattttcagccttaaaatgaactgttgatgtcatccaatatctctttgaatcattgaaaggatgagatgtgactgtatagaaagttaagggtgtagcaaatgttcaattttttggacattgataaaagttccttttttcttgaaaagtcaaattgggcgtttgttgcgcacctgaggccctacatcctgtttttctgagacgagatcacgagaggcagagtccacgaggccacgaaagcgctccaccgaccaggcgcccaccacctgttcgatcgaatgccgccgccggccaccgcgcgcggcgcccgctccgccgcctcctccaccccgttaggcgccgccggtggcggccgacgagggcccctc

SEQ ID NO: 50649 - DNA, 165 bp, Oryza sativa
atttttgctggttgtattttgatcgagttattttttcttctggttttttatgttgacgtttttgttagagaaattgcttgccacgatctgtacagttctatagtcactctagtgggctttacgttttttctttgttgataattataagatgtattttgttacaga

SEQ ID NO: 50650 - DNA, 1501 bp, Oryza sativa
tgtatatctcgtgcctgccgtcaagcgcctgtggtcttcgccctagtcttccgctgttattcgttgtctttgtgtgctgggccttcgctgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacaagttggtatcagagcctcccttgaccctaggacgagccgtagatcccaagccttagcaatattttcaaaaataaaaatcctttattatttgtgaaaacccgctattctctctttgtcttgctgcttcacttatcatcaaaatctgatctttcaaatgttgcttttctttttgtttgtagatggccggcagcgttacccgtcgtggtttggacatgactggcttcgtcttggagctgcggggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggggattccttccccgccgcttgccagaacgccgctctcctcgccatcggcacccttcaccagcgctacccggacgagttgcagcactcgccctaccgctaccaccctcgtcgcggaggagcccgcgactacgccaccttccgagacgccagctcggagcatgacgctaccgtcgtgcatctggcacgcatggtggaggcatacgacgcagctcgtattgacttccatcagatggtgcgccgtggcatggtggagaacaacatgaagatcctggagctgcgccaagagaatttgcagctcaagaaggacctcgacgcgttggaggcgcagctgcatcagctcaagatcgcccagggagaggacagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttcctcaggagggggaagcctccggcgttggtagctcggagggtgcgctgttgctcaccttccgtcctggcccgtcgcagcggtagacgagcagttagtaggcttgcgcgtgtgtttttcctcgtttgtctttttgagtcgtgtggggcatggttacgccggtgtgtggtgtaactatgtcggggcctgtctttatttgtttgcctaagcaacttgaacattaatgaaccaatttaatagcagtgataaattcaagatttatagtagtcgtgggtggttagttttaatcgtcagctctccttctctgtttgctggttctgtgtggggttttcagatggtgacgaccaggagaaatgttaacaccggtgaagg

SEQ ID NO: 50651 - DNA, 1501 bp, Oryza sativa
agtcttcgcgaacttcgatttgctctgagtcggcctgctcggatggcactcgaagacatttcttgagttgcgacacatggaacacatcatgcacgttgcccaaggaggcgggcaactccagctggtaggcgacttctccgcgtcgagcaacgatacggaagggacccacataccgaggtgcaagcttccctttcgtttgaaacctgtgcacacctcgcaatggcgtgacccgaagatacacaaagtcatccactgcgaattccagatcacggcgacggttatctgcataacttttctgccgagactgtgccacctttagattatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttgatagctgttattgtaggagaactcggcataggggagactcttatcccaagtcttcccgaaatctaggacacatgcgcggagcatatcttctaggatctgatttagacgctcggtctgtccatcggtctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctccgctagtttattccctccataggtggtcttcacaggaatgaatcgagctaccttggttaatcgatccactattacccatatagaatcatatccaccttgggtttttggaaggccggtgatgaaatccatcccaatttcatcccatttccattccggcacttggagaggttggagaagtccggccggtcgttggtgttctgccttgacacgctggcacacatcacatagagccacaaactctgcaatttcccgcttcatgctgacccaccagtatttctccttcaagtctaagtacatcttggtactgcctgggtgaatggaataaggactctcgtgagcttcctgaagtatcagctgtttaagttctcggttatctggaacgcatacccgctttccgttccatagggttccgtgttcatcctctgtgaaacctgcggctttaccctgtttcatattcttgaggagtccatgcatgtccggatcattcttctgagcctcgcggatttgatcgagcaaggtaggcttggcttccaacgcagccaagaatccgcgaccaactaggcttaggttcagggcttccatctgttggttaagttcgggtggaatgcctcggacgttgagagtgttgcagtggctctttcggcttagagcgtcggcaaccacgttggccttaccaggatgatagtgtattcccacatcataatccttgatgagttctaaccatctcctttgccgaagattcagatccgactgggt

SEQ ID NO: 50652 - DNA, 1501 bp, Oryza sativa
cagatcactagttaattaagaaacactaagtatgtgaacataatgttgatcttttgaactaacgagctaaacgagtagctgtgagttgactcgttaagctcctgagctaaatgcttagcttggcttgacttattaagactacgagttcgagtcgatctgagccgagctcgctacagccgattcaagccacgagatttgagctttttgtccactataactaaccataaggaatacattaaggttatctctctctcccctttgccacccccctcgctttcttgtgtctttacttactgttacttttttatgtcttaataggtctcatgtctaaagtgcatctagagctcaccattatagcaacaaaaataactgaagaccattattatggggcctacccataaggacaatatccatacacattacccttagtgcccttaaattccatataggaaactaagcaatgagttcaaacctcgttttacttttcctttgaaaagcccaaccggcaaccatcttctctctctgtttcctcttatcccacttggaggattaacaaaatccccatgttaaatgatctctgaagaatatatgcataaggagagattatgtgtcgcgagtttcttactagtgataacttgcgactttgtgataacaacgaacctgacgttggaggaaagttttgaattcaacgaattatatcatgtttgtttatggctttatttgagaatcaagatagcttatacggtcgagtacggtactagttgactttagcaaaccgccaaacgtcgtaggtatggtgagcagaatgtcaacgaagcttgcttccgtaggttacatggaagttaaaagggagctaattaattaatcttcaccgccaaacgaaaaaaaagatctaattaattttgttgttattggagaaaaaagaactataatttcacgcaatgtcaaatctgtatgccaatggaccacatttcagatgataaacaacagttaaactaaatgtctgcctgtttcaagcagaaaaaactgcatgaccccatagaactaattcatgccatttgctcttggatcgattcatgatccattttgtagaaatcagaggacgcgcaaagaagactgcagtcggagtgacgctgctaagaagttgtaacaagactctgttagaatctactgtctttcgttaatgaaatgggagagggctagctccctctctttctaaaaagaaaatcttggaaattctataacatattttactggaatctttaatttctcagtgttctttaattacaaagctgtaccaaagtatacttgccaatctagattaaggttcaaatcaagaaatgacatgcaagtggccccatcgtatatgaactaatactaaccatgatatatactcctatatgtgatgtgatgatgatggagatctagttagctagcacagagctagctacaccggtggcagcgcctccgtcggcgacgactcatctgccgccggcgcagg

SEQ ID NO: 50653 - DNA, 1501 bp, Oryza sativa
tatttatcaaaattataaacttgttgtaatgaataattatgagcaaagttgtatgattatgttggaaacagagcggctggtttcaggaaatttcaattggtctgagagagctgtgaaagttctgaaaatgtttgaagcaaaagtgtcacacaatttcataatattttggacggaaagttccaatagaattgccgggttttatgttatatacgaatgagttctaaaaaagaaaaagttacacaaatgaggaaccggcccaacgatggcgggaatgacattacgtttccgggccaaaattgaagttaaatgttttacagttttccgggccaacattttacggtggataagttcacactatgtcccacaatttgtcacccagtttgatttttgtccttgaactgaaaatccaaacacaattcgtccccaaacttataaaaccagtgcaaacgagatctctcgatagtaagttgatgggctagtcggtacaggctcaagcatcaccatctcttaataaataaacatcgatataacgtcgagagcccctactctcatatccagcttaataattttcctacttggcccctgaaactgctagctggcacacatgggatctgtttggagggaggttctggcagctgcagcttctcctaaaatcttcagctgtaagaatctctctcaaataatctaaatttttacccagattttaagaatatatagttgtagaatctaaaaaatgaactagaagtcagaagctagaaaacttagctttttcatattcttatcagctatttctcgtaatcttcaactccctaaagccttgtttggttacgccgggatttaatctgggccgggaatgaaaagtatagtaagaaatttatgatagatacaatgagagatcgatatttattccggacctggaaccaatttactcatgatagggacaataagagaccgagaatcaatccactagttaagaggtgtggaaacaatccggatattttgttgtcttgtctctattatgagtaaattggtttccgacccgaaataaatcccggtccctcattgtatctgagttgaggctccccgcattctatacatctgttcatttcactcattctagatttctgcatatatactccctttctgcacccgtgctgccaagtgccagccactactgcaaactgcacccaccaaacacgtccactacgtacgtaccactacccccgccgtcttctccttctccactgcgactaacaaccataccccagcttctctcactctctcttcccctacaccaattcaagataagagagccaccgatcgatcgacgtccggccaggcgtcgacggtggtgccggccccggcctcatgggggcgccggcgaccgccgccagcggcggcggcgacgacgacgacagagacgtcgtgttcgagtacctcctttgcacggaggaggacgccgcctcggccgggtccttcttccagcagctacagggcccgg

SEQ ID NO: 50654 - DNA, 1501 bp, Oryza sativa
ttttttgtgcactggaaaggcagcaaaagggtgaaaatgtggggagagaataatatggtgttgtggatgtttcactgagattggaagtttgggagaaaaataagggtgggaatccaatgaggaaggtacatggaactatggaagtgtgatccaagatccaaaaacccaatgtgtaaaatgtggaattgcatttttttctctctcttttcattcaagaatgtaatggtagaaattgatgtcaggtagattcctaatcatattgatattagtagaaaacaagtgggggaaaagaatatagaaagtcaattgagatgaaatggctatgctgttcttaactactatacttggtctctctctctctctctccattctaaaaaaaaatcaacttctaaattataaacctgatgatgggacccatgtaaatattaataactagaaattatttttctaaaagaacgtagggtatacattatgcgtgtatgatcaagaccaacatcgatatctatgtgaccatgaccaccatcgatatcgtcgtcgattgcaaactagatatacatctcttagggccttagacaaatattgtggatgttaacattcctttttttcccttctaataactagagttttacaccgtatacagccatgtggatttttcaaccctatctaggagacacacatatggcatgctcaaaacatgccctgacgtagaaacaaaagaacaagtctatccactgggcagcccactgttaaacatcaattaatccggccgggcagaaagaaataattcctttttcctgttcattcacatgcctaaacatgtgctccctccgtcctataaaaaaactaacctagtattccctccatcctgaattgatcatcatatatatttatgcacaaagatcaaggataatttaaatcgcatcaatcaagacaccatgcacatattatcacaatgcatgcatcgattaaaacactatgtcaattatactctagcatgcacatatactcctatgctgcattaatccgtgtccatgcggttatatgatgatcaatttgagaaattttggattctattatatgatgattaatttgggaaggagagagtaccagatataacacatcatagtactacgaatttagacatacattttatcttgtactagaatgtgtcacatccgatcctaaattcattttttagaatgagtacaatagtaggctacaagtcagctgcaaacacatgtagaggagagaagagaagagagaagaaaagcgggctacagatttgtagccagctgcagcacgaactacaatacgttgtgtgtgtgcgagatgtgggaccatatattaatggtttatagataactattatatgaatgagctattaaattggctatagatgatttgtagttagtagatggctatactatcaaacttgctcttatgggacggagggagtactcctcctttgtccttcccaaaataaattcgtttttcatccatt

SEQ ID NO: 50655 - DNA, 1501 bp, Oryza sativa
tcagacttcggcatacacatctagcagtctccctacaatgaccttgttgtctactccaatgttgattgggttggatgtcctaacacacggaagtccacatccgggtatgctatccttcctcggcgaaaacttggtgtcttggtcttccaagaggcaaaacaccgtttcccactccagccccgaagcagaatacggggctattgcaaatgttgttgcagaagcaagctagattcaccaactcctcctagaccttcacacgccactccccaaagcaaccttggtgtattgtgacaatgtcaatgatgtctatctctcctctaatcacgtgcagcaccaacgcactaaacatgtggagattgatctacactttgtccgggagaaggtagcggtcggtgccatacgtgttctccacgttcctacctcctgccaatatgcttacaccttcaccaagggtctaccgacgcctgtcttcaccgagtttcactccagtaacaccgttcgtcctatcgacgttgcgactgtgcgggaggggggggtttagtgcatattgtgccatatatatccatctctcggcactcctccctattctctcgattctgttgctataagtcagttgagtggatagggaaggatgttgcctatatatgtatttgctccgtgatcaatctaatctatcgcgttgagtcgaattctcccacagataggatatgggctcagtttttctgcaaggacaaaattgcctctcgctaatagggatcactctgttataatctacttctaatcctcgccattgatgcgctttagttttcgtgctggtttttatttgagaagcatagaagcgcttctcaaaaaataatctaaagctataatagtctgcggttggttttcaatttcttttagatttctctggggtcctaaatacagttgacctctttgccttttgatgagatttagttaatgtctttattaatacttgtacagttccaccatctatgtggttggtagcctagcattcttggccgtgtgtcttttgtcgactgtcatccctatgcattattactctcccgttgtcaattattagtatcctaataataaaaaacaaattacgtttgtcgaatgtcgatacatatattcttgggcatcaagctactagctgattttattaacaggtttgacccacaaacatgagaattttcctgtgcatataagaaacgtttggacaacatatatatgtaagtttcagtttgaaaatatgaatcacgaaagggacgtaagagattagagatttacgaattgtgctaattgagatcatcagctcatgttctctctgccaagctacattacattacattacacaaaagatgtagtcacggattaggtcagacatgacgaatctctaattctctactagcttaattcgcttgtctttatttttaagatatatataatggaagatgaaagatacatctatcgatccctcttctgactttacttgataata

SEQ ID NO: 50656 - DNA, 1501 bp, Oryza sativa
ccctcccaggggacgacccgacgacggaagttggatgccatttgcgaggctactctccaggggcacgcattgttgatggccttagtggctaactttatcaaatcacaattgtgataagttgtggcttatcacagaattatgtttatagatccttatccacattacaagcttaggccttgtttagatccctagcaaaattttacaccctgtcacatcaaatgtttgaacacatgcatgtaatattaaatatagatgaaaaaaataactaattacacagattgtgtgtaaattgtgagatgaatcttttaagcttaattgcgccatgatttgacaatgtggtgttacaataaatatttgctaatgacggattgattaggcttaataaagtcgtctcgcggtttacaggtggattctgtaatttgtcttgttattaaactacgtttaatactttaaatatgtgcacgtatatccaatgtgacacgacgaaacttcaaccactagatctaaacacaaccttggttaaaaacttgaatcaatgacaaggaagtccatgtgtctaaaaagtttgacaagagactattgtgacaatgaaccaaatagttatttaaaaagttgtgacatactcctagctaaccttaaatataatactactccctccatttcacaatataagattttctagcattgcttatatacatatagatgttaatgaatctatatacatatagatagttaatgaatctaaatacatatatatatatatgaatatgaccaatgatagaaagtcttacattgtgaaacggaggaagtacctccgtcccaaaatgttacaatatttagttatgaatctagacatattcatagctaaaaatgtttatattttgggacggagggagtataccgaagatatcaaccaaacagacccgaagatatcaaccaaacagacccgaacttcttcccattgtggaatttgcaatcttttttcctctctctgccatctcctttacggtggtgggaaaaagataacaacttgggaagaggagcggagggcgcgtttttcgcggaggcggtggcgcaaaggcgaaactccgatcccatggccagagaaaaaaagcattgctggtagcgagagaaaagaagggaaacataaaagagggaggaaaagctcaaagcattgtagattccttcgacccaggtagtagctgctagctgcgagtgtgttgcattgcattgcactgctgctgcttcactccactgcgcactgggaggagtagtagtagaaagcaagaagcagcagctgtagctgtctccctttcttttcatcctcctttgttcttgctcctctttgcacgcaaagaatcggtagccgcctttgtttgctgctctctgaaatctctctgagttttgtgctttcactgcactgttctggttcttggactccctgttcttggttcctgcatttcttttcttttttgcctttgtttgtcccatttttgttggg

SEQ ID NO: 50657 - DNA, 371 bp, Oryza sativa
aaagggagctgggccgagaggggaggaggcccaagaggagggagagaaggagagggagagaaagagagggaggagggaaggacttcgggctgggcttggcccaaaggaggagggagggttgtttttagattttctttttaatagactttgataattgttgttgttgtttaataattatttccagtgctctgaaaattcaagtaaaatttgagggctccttttagaccaaggagaatttaacaaaaaatctccgggccacatttgaatttttcttgcacgtattttagtgtttgccaatttctttccgaattttaattaattctattattccttttagaaaatgaattttatttcgggatgaatttatcagg

SEQ ID NO: 50658 - DNA, 608 bp, Oryza sativa
tttcttcatatagaatccaacttacccaggactttagtaaaatcaagtgctaccgtgttgacatcgacctttttaagtgtatactatggttgagattagctaacactcttcccgaattacaaacaacgtgttttgtgaaaaatataaatttactaaaaatcaaataaattatttttttaagtttgtagtatttaaagttaattaatcacacgctgatcatctgcctcatgccatgaactagctaagcccagccttaggattagttcgtttcagttttttagcttggctaatcagccatacgtgaaatgagataataattaattagtgcatgtttaattaaatattaactactataaaattaaaaatgagaatcaagtttctttaaaaaaacatttataatgattttatttcatgaaacaatgtttagcagtttgagaagtgttagtggctaaaattaaaaagctctagataactcacctagtgtgttagagtgtgtaatcgcaaatgtgtaagattatgcatatttcatgtattttttttaaggaaattgagcttctcgatccgttcaatttctcgcgcctaagcgtgaacagctagccatgaggaga

SEQ ID NO: 50659 - DNA, 1089 bp, Oryza sativa
agtttcagtgattaatcatcgtgagattctcgcgtggtcatcactagatgggaatgtagtgtcctgataaccttcaaattaaccttttgcctctgtcttgtccgtgtaggaagcaatcatcaggtgctaccggctaatgcagcaattgatatctagtaacaatgttgggagagaatcgacagagataacaatggcgacgacgacgacgacggcgacaactgctgtgagctcagaggaggttgtgtcctcttctcccccatcaaagaggaggaagatgtgaccaggcacatgacagaatttgatgcaacattgttaattttcagtgattattcagcatttgtgtttgtgatatacataggggtcctagtttaattagcagagtttggttttgtgatgttatgttcctgcaatgtttttttttttttttggcccttcctttaaccttcttgtagatagccctactggtacagttgagtcatcatgccagtggctgcaggttctgaactgccagtctgtgaaggaaacaaaatgagatagatttgtgcttgtccagttgtccttgctggattgtagtactagcaatgtgtgcagcaggacatgctctgattcacagaatatttacatggattggtgaatgaggccttgtttagttacaaactttttcttcaaacttccaactttttcatcatatcaaaactttcctacacacataaacttctaacttttccatcacatcgttccaatttcaaccaaacttttaattttggcgtgatctagacacacctggaaagggcactggagtgagctgaaattgagctggtcaggcataaagtcaaggcttggggtcagatactacattgttggctactccctgccaagatctgttcatgttcatcagggaaagtctgtctgctcctgatgagtgatgtgtagtttttttattattatttttttggcttgctcctgtgtgttatcaagtgaatccaaacttgaaaggggaagcataatgcctgtactgcgaaaggcacatgcagccataaggctttgtccatctcctgctggctcattgtgtatttatgtgcaaacaaa

SEQ ID NO: 50660 - DNA, 1501 bp, Oryza sativa
cttgccgaggagcagcgtctccttgggcttgagcagcttgatcttggtgatcttcgccgccgcccctccggactcgtcgccgacggccgctccgacggcggagtgttcggccttgccgccaccgccaccaccggacgaggaggcggagacacggagcaacacgagggcgacgtagtggcctgggttgctgcgcatgacgtccgccgcggtggccggccagtaaagccgctccaccttgccgcccgggtgctggatcaccaccgccgccacctccgccgcctggcaattccccatcgccgccgccgccgcccgtacccacagcccaccacctcgccggcgtcaccaatggctcccttcgacgaagaggaggaggaggaggaggtcgtcgtcgccggcggcgtgggagctgcagctgagcttgtggttgcggcggtcggggaagacggggggtgggtggtttatatcggggcgggaggtaggggagcagagcaagcgagcgagagtgattagggaggtaattaaattaaattagcctttgtttaatcataatggttggctgttagcgacgtgattaacgaaggggtcaacgtgttaattagggtaatacttctccatccacaagtagtagtccccgtcattaaataggtaagtgaatgttctaaatagattggataaatagtggaggtaggtgggaaagtgaatggtggatggttatgattggttcggaagagaatgttgatagaaaagttgttatattttaggacaaattctaagggctaaaagttattatattttgggacggatagagtaattttttttctccttccatgtgtattctataataagtttatttttaaataatcattacgttgaagtttgtagaaatagaaaataattgtattattttggtagataaagtaaagaataattgtatttagatttgatagagcagatgtattttaactattttgattttatgtttatatgtgtgaaatggatgaaaaacgaatttattttgggaaggacaaaggaggagtactccctccgtcccataagagcaagtttgatagtatagccatctactaactacaaatcatctatagccaatttaatagctcattcatataatagttatctataaaccattaatatatggtcccacatctcgcacacacacaacgtattgtagttcgtgctgcagctggctacaaatctgtagcccgcttttcttctctcttctcttctctcctctacatgtgtttgcagctgacttgtagcctactattgtactcattctaaaaaatgaatttaggatcggatgtgacacattctagtacaagataaaatgtatgtctaaattcgtagtactatgatgtgttatatctggtactctctccttcccaaattaatcatcatataatagaatccaaaatttctcaaattgatcatcatataaccgcatggacacggattaatgcagcataggagtatatgtgcatgc

SEQ ID NO: 50661 - DNA, 1257 bp, Oryza sativa
tactaagatgaaatatgactatcaaaagtagatacagggagtatctataaacatatactacactattaatagatagtcatacttgtcatatatacactatgtcttagagtccgttctatagttggctataaatctgtagtccgctgctcttttctctcctcttttatcttcttgatatgtgtttatagctggatttggtctactattgtatttgctcttatctcatccacatgtgtttatagttgacttgtagtcactatttactacgtctatccaaaaataagaacagccgtggaaatccgtgtccaacgtttgaccgtccgtcttatttgaaaaaattatgaaaaaaacaaaaaaaaagtaacacataaagtattattcatattttatcatctaatgacaacaaaatactaatcataatttttttttcaaataatataaacgattaaatgttggagatgagccgtataaagctataattatttaaggtcggagggagtagtatagctaactattggctccaagtcatttatagttaatttaatagttaattcatacagtagttgcctatttttttggtcccacctgtcaacacatatgcattttgtagtctgtgctgcagcccactgtatttctctctccttttttatagctgattattttacctgctcttttaaatgtggatgagtactgctcctacagtacgtgcctgaaacaggtaaaccctcggtaggccgttggattcctgagccgggcgcagcgagacttgatgagaccctggcccaactggaacgccggccgagagggaagggaacgccatcccaatttcccaaccccttaattttttttctctcctcccaatctctctacctcaaaagccgtgcccgcatcgtaaagtttttaacgtcggcatctttcccagcgcaggcagagctctgcactgctcctccgtggacgtacaccgccacacgtgctaatatattccgaatgaatgattacattggtgtcgaaatagtaaagaaatgttactctggcattgtaaagaaatgtttgtgttgacagtgtgatcgtgtactagtcatgtcctaggttatgcctatgtcactttagagcaagtttaatcgtatagccaattactatctccaaatcatctatagctaatgtaatagctaatttatataatagttgcttactatactattaatatctagtctcacctgtcatataaacattacgtcttaaagtccgtgctgcagc

SEQ ID NO: 50662 - DNA, 203 bp, Oryza sativa
agcagatgaactgttgacatcaaccgtaccgcataacgggcaaaccttttggttttgccatccttctttttacaatctgtccgccgttcatactctattttgaataactagccaggagaaaaatcactactacactacagattttcctagacaccaaactagtttgtttccaggcggcccataagtgcaatcgtatagaaaaa

SEQ ID NO: 50663 - DNA, 1501 bp, Oryza sativa
agaaggacgatatctagacaatcaagccgttgggtttcatagggcggtagatatcctatataatctaagtcaacattgatatttaacctaatcgactgccttccaataatggacgttagccgattgaagattagataacaatattgtcgaagattatataagatatatgataactcgatgaattacataaacaagattagagtatcataaagatggaaacactaatcccgagaacacaagccgccataacaagttttacctctagttgaagatcgaaaccgatgcagctcaacccgaaagcaagaactcgtcgaaagtaaacgaaagtaaaagggtggcgatgcaacgagattgtattgaacgtgtgttttttgattacataggttcgggtcatatttatacccgagatacaaaatatgtccttgtcggacacgactcttatctttaacaaactctaagataccataagtctttgctgcagacttttgcccaaacttatctctaaggaaactacataaaatatcctaattaatagatacaattgccttttcaggactcaatccgtgcatggcaattcatatgaagcacattaacacaacccgacaacgcataccgagccacattgtcggaatcggctcaatcggctatctagtccgactcgaactctgccgatcctgattgtagccgatttggactttagccgattcttgctctgtttccggaactatctctatcttggattccacttcggttttatctcgatctccgatacttgaattaccaaatttggttgttaacaaggtggaggtggtggagggtaacgagtccacgcggttgggcgtgagcgttggatcgggagtccacgcggttgggcgtgagcgttggatcgggagacacgcgggagaagtgacgacgtgagcaaagtgggaggccatggcagttgctgtcccgaggtggctggaggttggggatggagttgacgggtgggactatcggagagagaagggtgaaccaagtaaggggtaggtaaagcgaactttggtgagggaaggggcgagcgggctgagtagcgagctgggccggggagagagaagaggggatggcggcccgaggtgagggagcgggccgtgcgggaaggggcaatggacttcgcgcaggcatgtaaagtaggttatgcttgagtaacatgtaaggtggaatatcaatcggatggtacctgctacgcttgaaaagtactatttctttataaattttcttcattgacattgcttagataattttttacaagatatttgtaaggtttgaactatataatatttaattcattactataagcaattaccaatgatcttctttattttctaaaataaagagtgagtccgtaaatacgtaggagacatatatattgtgcgcgtcgttttcctattatatatgtgatttatggtgttctttaaaaaaataactagccaacgtgagtcctaaatttaaagttgatagtagc

SEQ ID NO: 50664 - DNA, 1501 bp, Oryza sativa
agttgtatattgatagtacagaggattcataccatttttgtatgttatgcactattttggtaagggtgaagttgagatggatgtgtagagctgttgtattatgaatattttggggattcatattgattaatgttgatattgaagggcatagatcgtaggaacattgtaaccggtggttaatcgatagaatttttaaaaaatattttatttaggtctggagtacccatgttatgtttctatttttatagcgacgtattataatagaataatgcacatatttcatcggtaatttgatgtagatggatagattggtacgactccattttgatggcagtgtggtagatgaaagtactggtggtagccaatttgaggggatgtctgtcaggcagttagtgttttgcgccaaacccacatttgaggagttaatttcacgcacgaaggatgaattggattggagtgatgagtctgttggtatacaagggagatacgatgtaggtaccggtgcagtgtcgcataagtacatattagatttgaatggagaggtggaatgagaaacatatctggaaatagtcttgggttcacagttcaaatcgcttgaggtgtttgcttggaagaaagagcgtagggaatggaaggaagaattgtttgatctcaatgaaagtccgcacatagaatccctggtctattgtcatgaactgaagaccgatgtgcttgtggtggatcgaaagaagaattaattgaggacgatgtgcaggtaggggtggaaaaacaggttgaggaggatgtggatataggtgaggagaggcaccgggatgtggaagatggggaggtagagaagaaaatttcagatggtggtatggatgtgaatcaagcagataatgagaatattgatgaacttgagaagaggcggttgattttattcattagagaattccttgctgatgaaatttacactcgcgaggagtgtgaggaatctatgatatttaatggattaaacccgaatttgttgtatgctgatttggacaatgaagttgatgagtttgcatctgactctgatgacgatcgtccagtgggcaagatgtcagacgaggagagcactatgtttgagaaaatcattggtcgaaatccggaaataactcaattcgaggaccttagcaatggaagccttgctgttgcagatggtgatccacaatgcgatggagccttcgatgcaatgggggaggaaccgaggaagggattagaattttgatccatggatgagttgaaaatatggttgcagagctactctatccgggtgcaccgcccattccatgttaaggagtccaatgcatctgttaagtacactgtggcttgccttgatcgttactacgaatggcagattcgtgcaagaaagagcgctctagtgtggaagcaactggcaagcacttgcagctaacctcgaggtttataggtaacagattgcaggcatttgttagagcggaaccaacattgtctcctgcag

SEQ ID NO: 50665 - DNA, 1501 bp, Oryza sativa
ggacctcacctgcccaccgtcatcgctagcatgtgggatagagagaagaactgatatgtgagcccaagagcatttctgacatttcatgtgatttatctctcctcttaaaccagaaattattactttaatgcataccgtgtccaccagcaaatatcacttttgggagtgtcttcccctaaaagtcacttcgtgcggtgtcctatatctaaaaccgcgaagtcacgatgtcctgtagtaaaatttgtcttattgaatctacatatgggatggagaggataaaatatcttataatatcactactacaaatattttcccaggtggccaaaattgatatacacatgctgacggcattcctcctggcattaaaggactgtaaatttcatgttttttcgcagacaacctcttaagtcattggcctacaaaaatcttttccaacgctaaaaaatatcgcagccgtccgggcacctgcgaaaatccttttcggtgctaaaaaaaatcatagccaacaccgctcctcgcctagcgccgcctgctaatctcaataggacccacgaaagtccaatccaggccagaaaatgcatagcattgacattcacaaattcacagagtattcacattcacaaatcatcatcgtcgtggtcaccaggtccgcctctcgtctccaaatctgcatgaggcaaagtagcgggagtcaaggagctagcagtcaccaggtcatcttcacctcaacgggtgtgtgtcgtagtggtggtggttgtcgcggtcaccggatcccgagcatgacttcgccggaaccatcgccgctgagaccagtaagggtgagccctacccaccatggtcgttgccattgtcgtcactgttacagccctcgcttgttagaaattaatcttgttgtttatgtgttaaactgtagttagtggtctcatcgtggtgcgtggtggtggccaagagtggtggcatgatgtgtatgtacgtgtgtgttagaattagttttgcatgtgtgtgtggccaggtgtttggtcgatcgagtcattgcgcaagtttaggagcaggaagaagtcatagtctgttttgcatggatgcatgcatcggcggattagatacctgcaactgaacgtgtgagtgtggtgttctatatgcaaggagatgtggcatgcatatgtagggaagtgattagtggataagccatgcaatgtttggctgggtagtgcggccagaacatggcttaatgtgtgctatttaggcaatgtattagcttgtgttttgtggtgtgattaatagcagtgcgcttgtgagtgctgtggtgtgctggtgtgcagcacaaaaaaattctttagtccagtgtgtttgtgtttttcattctagcgtgtgtgcttgtgtaagaggagccgaatcatcggttagccaacagtggtatcagagctcaggtgccatgtctggagatggtgtgtacacgccgccgccgatccgtcgcagcagcggcggcaacggcggggatggc

SEQ ID NO: 50666 - DNA, 1501 bp, Oryza sativa
ttatccatctgtcacaaggtagaggttgagagggaaagcatacaaggaaagaatagaccagagctagggacaggaccttaaaggaactaactctttttgttgatgtgttgtttgttttgcttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatctatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcatcaggcctgacaatcaaaaataaacagcagcggactagcggacctacggctccatcttcacaggcgctcaactggggtataagccaggactccacctaagacatcttctccaaagcttctcttactgaagagggaaaagattgagcaagaatgagtacgaccacagtactcagcaagccacaccggagaatgcatgattaatgcaagggagtacaaggagataataatataggggttcagttttgcagtaaacagcatttaaaagtcacttagttgcccaaagctattttataaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtatgacatctcgactaccgggccgcagctcgtgtagccttcatttgccctggagaa

SEQ ID NO: 50667 - DNA, 1501 bp, Oryza sativa
tcctggctttcctacagcccccttcttgggctgttctgactgagctgacacagctggcggatctgactgagctggtgccattagtgggggtggagtcgagttgtggttgtgctgcttactattgttgtgactgccaccattgtaatagttgttgaagttactcgggcgatagggacggtgctgacagacgatcagggtggaaggcccacctagctgtcccgtcatgaaacgaggcttctgattgttcccctgaggaaagctgatctgagctgtctttctttttcggtccagctgtcttcctggcggatagccttgtccacaagcttctcaaagtcctcatagactccggagattagttggttggtcaattcatcatcgagcccaaacaaaaacttctcctgcttctcaccatcggtgcgcacgtcctcgggagcgtagcgcgcgaggcggttgaactcgtgcaggtactctgtaaccgttctggttccttgttgcaatgcacggaactctctctcttctgttgtgccataatcccttcaggaatctgtgccttcctaaagttttgacaaaactctacccaagtaaccttcgttgcatctggacgggtcaccacgtagttatcccaccaggcagaagcgggaccttgcaactggtgtgtagcaaaagcaactttctcttggtcgttgcattgcagtaggttcagcttcttctcaatagcacggagccagtcgttggcctccattgggttggtggtgcttgagaaagtgggtggctggatacgaagaaagtctaacagtttggacacgtgtgatggtggaggaccaaactgctggttctgttgcacctgctgcaacatttgatggtaatgttgctgcatctgttgcatcatcattgtcatcatctgagtgactgttgggttctcgggcggcggagatgaactgctaccaggtgcaccactggtatgagcttcatctgtctgctcttcgctgccactggcgccgttggagtcacggagatcattccttgtcttcaccatctggaggggataggtagaaataagagaaaggaagaaaacagatggctcggaaactaatctttcttatgaaattaagtgccattatcttaatcttgattaaaacactgaaaaagaggcacacaattcctaattaaggctgtcataccactcacacatgatatcgaccgccgactaacccacaagcaacaaacctaaacacaaaaactagcacgcaaacagactaagaagacgataaagctaagggcggcgactctgaagctcggagcggcgcttgcgatcgaagaacaggtctgacttctaaggtagacaagggataggaatcaatgcatgctcaaatccaaatttaaacaaagcaacaaatggcccaaacaactagccaagcatgatgatttttatgcatagaacatttttcatgaacccagacaaaagacactaatgcaactgactaaacaataacttaatgta

SEQ ID NO: 50668 - DNA, 1501 bp, Oryza sativa
cggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgtcgcaacgtggtgtaacgttggacagtgattggttaatatggattaattactgcaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccacaccagcgttgaagtccttctcagttgaagatgtctcgaagaggttggtttcgtcgctgccgtcaaggatgcctgtggaatggagtcgcccgctgcagaagtcaagccttcaggcttagctcgcttttatctttttccgctgcatttgtaatcttttatatttttgtaagacgtggatctgtatgtcaacaattgtcgtttgtgtaccctggctggtcctggacaggggtttaatgcacattcagcttagaaattctggttcgtgaatttctgggtgtgacaagttggtatcagagccgaccttgaccgtaggtcaagccaaatggaaaccctaagagctctcttaaaccttttcatctgcatatgctttttgcacttggatttgtttcgggaaaaatttggggttttgcctcttttgattttgggagaaaatcttggtcgcttatttaatcggatctcttgactagggacagtccaaggttttagcaaaactttatttggaatttatttggcagccagtcgggaattgttaggtggtatgcattaagttgtgtttagattcgatgggatgcagtctttatgcgcatcattattatcatgcatttatatcatacattaagttattgtttagtcagttgcattagtgtcttttgtctgggttcatgaaaaatgttctatgcataaaaatcatcatgcttggctagttgtttgggccatttgttgctttgtttaaatttggatttgagcatgcattgattcctatcccttgtctaccttagaagtcagacctgttcttcgatcgcaagcgccgctccgagcttcagagtcgccgcccttagctttatcgtcttcttagtctgtttgcgtgctagtttttgtgtttaggtttgttgcttgtgggttagtcggcggtcgatatcatgtgtgagtggtatgacagccttaattaggaattgtgtgcctctttttcagtgttttaatcaagattaagataatggcacttaatttcataagaaagattagtttccgagccatctgttttcttcctttctcttatttctacctatcccctccagatgg

SEQ ID NO: 50669 - DNA, 431 bp, Oryza sativa
ttgtagtcttggacagcaaacacacccaaggacagctagcccaatcacactttgccctcaccctcttgtgatcatctttaataaaattaatcactttcctttcagccagggcatattttataatggtcttcttgaactgatgcttagagctgaacttcattcctagctcaaaaacaggaacccctggctgcttctgaaaccttggaaacttgccctttcttctaacaagctcaccatcactgccaacctcatcatatgagtcttcatcatcactatctgcatatggggtgtcattgccatcttttggacctccagctgttctagctgactgacttttaaaccccctcaaacacaacctcatctagctcatgaacctttccagctctcatcttcctcttcaactctttgtagtgtccttctatctccctagc

SEQ ID NO: 50670 - DNA, 1501 bp, Oryza sativa
catcctctcccttttccccaactttcccgcactccccgcgctctctcccgctcttcccacgtgatcccaagtgccgccgctcgccgacgaccctccagctggccgctgccgccgtccccgcgccgcgccgtttgcgccgccggcctcgccacgcattgccgcaccccgtccaccgctccgcttctgcaataaaccacccgggcaccggtttcaccgtgcacccgagccacaacagcctctcgtcgcctccagccacgggccaccgccgctcccgccgccgctgtgctgtgccgcctccactgccggcttcgccgccttgcgggcaagctcgttctccactccgtttccccattccatcgttggaattccacctccactgccaacccgagccgcaaccatctttaccgcctctggccatccctcgccgccgctctgagcgacctccggcctcgtgtcctcctccggtggcatcgcggcggtggcggggtggtacagaaaaggcggcggagtggggtggctcgggcagccatggcgacagttggagccggaggaaggggatgggcctgacgggtggggccgtgggtcccacctgtcagtgaggggaggagggaggaggctggcacagggacgcaaagcagtcttgaggaagacgggtcgacggcccgtgagaggaagggaaggctggccgagagagggagatagggtgagcgggccgcgggaggggaaagggacttgggccgaaaatggcccaaggaggaagggaggttttattttgtttttctttttatttaaattgattaaatgatctttgtgactttgaaattatctcttgagctccgaaaattgacgggaaatttcagagagtattttagggcacaaagaatattgcaaaatattctcggccaatggtttttaagggaaaatttccggttgattggcttccggattcaccgcggcacgagaggggggctacccgttgcttgctgtggacgggggcgaaccctaaggtgtggtgcaatcggttagagggggttatgcgaagggtcctgtcacggcctctttccggtatttcgtggtggcatgtcagcgcacagaaacgtgtcgtggggctgtgtcttttgggtacagttgtacacctctagtcagagtaaaactattcgaatagccgtgcctgcggttatgggcggtcgaccagattcaccgtgattagttccaccttaataaatcaacccaatgcactgtagttcaggtgggttggttgggcctgttcaacgtggtgtagcgttgatcagtggagatttaatattaccttaattactcaacagttttactgttttgctcaataaaatgttttacaaccgcctttatacaaatagccacaaaccgtccttgtgttccccttgcacgtctgcatcattggtgtggcttgctgagtacggtggttgtactcagccttgctattattccccctttttcagaagtgtagtgcttctgagctgaa

SEQ ID NO: 50671 - DNA, 1501 bp, Oryza sativa
aataaagcatattctgcaaggagggacacaaaactgtaggtcctcaactatagtgctcacctgaattactcactgcctctgtgagctcaagtgacttcaagtttctgttgcgtgctatttggagtctacgaccagttgctcggataagcatggcagctataaaatctacggccacaaaaatcaaactgtcttgcattcatgagtgtaatataaattacaagatctccaacatagttcaaaaagataatggagtacattggaggcttcattttttttatttggtctgaatcattacatggtaacataaaaataataagaacataatttaaaaaatcatcatagaaaatccttttcatccatggaaatcaagtggctaatactgttagagaatagagacacagatcctaggtgtaatggaaaaaattacataacaacttatttacctgcaatatatatgatcatgatgtccaacagacctgtaataccatgaaatacaaggatgtgagtatttcaaacattgatctgatattgtgataaaataaaccaatcctgtcaaagcatatagctgcagtagtgcaaccaattgcgatcagagaagcatcatagacaaggaattgatcaccttttgttagtcaatggaccaagaaccaatagaagcaaaggggaaccatgatacattgaacctgaaagacaaaacattcaccgtgctgaataatcacttccagttcatgctacaagaaaaacacattgcaaagagaccctactaaaacatcatggataaacctataacaatgacaaatacctgcacaattatttgctaagtaaaaggtatggcaattttgcgcttattttttttaacacaccccattagtgcgggcttgcagcagttcatgcttaatggagcttactagaagaagtagcacccaatcaatttactttacttttaaaagtgctctcatgtagctagtaattccatccctatactgagctcaacaattcacgacttcagttgtcccccccaaaaaaaagtaatcaagcaagattaagatgtgtggaacgaaccggagtagggcgacatggaagcctgcttcagccagtacccttccgccactgcaaaacacacaggaaaacaagctattagtccaattacggcgacaacacagcacagctcaagtctgggacgaggaggcaggggagcaagggagcgcttacggcggcggatggaggtgaggggggtggagacctcggggcgggaggcgaggtggaggtccccgccgaagagcacgagaacgagccggaacccgacggccgccgcggccatcgaccagaagttccggatcgccatcgccgccgccgctgccgcaactccgatctgcgcacagccaccgcttcgtcgtcacggctgtaaccggagccgcggcctggcgattgggccttctacgccaagtcgtcatggatgtcgcctttgcgtaattgagttgggcttcagcagccagcaccg

SEQ ID NO: 50672 - DNA, 1501 bp, Oryza sativa; identical to SEQ ID NO: 50375

SEQ ID NO: 50673 - DNA, 1501 bp, Oryza sativa
gaggagagaagaaagatttatagccagatggaggagagaagaacagcgggaggagagaagaaaagagagagaaggaaagcggggaggagagaagaaaagagagtggagagtggaggatagaagaatagtgggaggagagaagaaagatttatagctagatggaggagagaagaacagcgggaggagagaagaaaagagagagaaggaaagcggggatgagagaagaaaagagagtggagagaagaaaagcgggaggagagaagaaaagagagagaaggaaagcgggctacaaatttatagccagctgcagcacggacttcaatacgttgtgtgtctctagctggaggagagaagagaagagccagctgcagcacagacttcaatatgttgtgtgtctagctggaggagagaagagaaagagaaggaaagcgagctacagatttatagtcaactgcagcacagacttcaatacattgtgtgtgtatgaggggtgagaccatatattggtgtattatatgcttatagagagaaggaaagcgagctacagatttatagtcagctgcagcacagacttcaatacattatgtgtatgaggggtgagaccatatattggtgtattatatgcttataggtaactattgtatgaatgatagtagagcaagtttaatagtatagcccagtactagctccaaatcatctatagtcaatgtaatagccaattcatacaatagttgcttactatactattaatacctggtcccatctgtcatacacatattacgtcttggagtctgtgctgcagctggctacagatctgtagtccgctgctcttttctctctttctttatctctttaaaaatgtttatagctggcttatagcttgctattgtacctgctattagattgactataaatgatttagagctaatagttcgctatactattaaacttgttataaggatgtaaaatactccacgataaaagcacccattacgtcagttaatataagggataacgctacacatatgactctgcatttacaatgtacgctattataatccgcggcaggataatgataaatttggtaaaagcatttcataacatgtacctttgatctatatttttttaatgaaaatttgtaaaactgcatgttgtcactctgacactcttgacaaatttgaatatctcaactgccatcgcttcgccatagttatgatgctttttctgcaattaaaaaaagagttaattgtaatttggacatgatttctttaccaaagttgtataatgaactagatctcatctcatctcatattttcactttgaaccggatggacttacaatttattgcaaattggaactaattgatacattagccacttgatgagctcctctccatgtcctcaaacgtactgaaactcacttcttccagatccacgcttacgcttccacactcatcaccactaatgagctcgtgagcaagctatgtccctcctaatgctat

SEQ ID NO: 50674 - DNA, 1501 bp, Oryza sativa
atggcatattagttctttttactatatgtcgtctactaaattcattccaataatttccggaggatggtttaggcttatgtctcagttataaattatatgtaaattgtttaattaatttggaatagtcttttctttaataggtttaattggaattaatcttgtaaaattcataactaattcatatgaagtcggaattaagtggttcaagtctctaaattcatctaaaatcatgatctacatgtttgtctactttttatgcactgtttatttgtttttttattagtctttttcttcgttttacgtgttagcttatcgtttccgtcattgcgaaggttcgtgagtgcgtcggaagtgttcaagaagattaattgaagaccgattattgcaaggcaagtcacacagatcccaaacaaccctttgagcatgttgaacctacttaaagctattgttttatttcaacttatgcattattttcgaatgtcatcgggtggtgagcctttctcaattaattatggccgaagatgactttattttcatatgggtaataaattgattagcttggaccttatatattggattggttcagctaattgctatatacataattgcttagccatgcttagaaacattagctcactaatgggatgaatcaaactacattattatttatggttatatttaatggtagctcacgatggttaatcgtgttatgataattaattgataattaaaacttgacaatggtgggttgtgagcacatggttttgaaggtcgtgctcatgacaattaaggaccggttcgcgagctactgttgtgagacattaaccgtgccaacctcaacccagcgtgggtagcggctttacctttcgtatagcgtggttcattgcggggcaccagactgagaagcggcgagaagtccatggggtcgctggggagtccatgcctctggttttttttaggggtgattatgatccaggattggtgaactgtggtgagttgtgttgtgcgaggggtactgtcacatttcctttccgatgtactgtggtggtattgaggcgcatggtaacatgtcgtggagctgtgtcttgtgggtacagtggtacacctctggccagagtaaaactattcgaatagccgtgcccacggtcatgggcgagttgagcaatgtttttcgtgattagtctcacacctctcacaataattatgggtgctataactggtaataatttgcttagctccaagtttggagttagatctgtacagccgggtatggttgtacaggatggttgggcctgtgcagcattggggtgctatgcagtgttgattaaaattgataattaattactctactgttttactactcttaaatgtttgctaaatgctgcttttgcaaacgagcctatattatgccatactttggtatccttgtgcacttgcatagttgatgtgtggcttacagagtatgtcatatgctcaccttgtaattatcaatcaaacctca

SEQ ID NO: 50675 - DNA, 242 bp, Oryza sativa
atagttccgggtcaggactaggttcgggggcgttaacaccaaacatacatgcggctaattgaacgaggcccggcctaagcagttattcggcccaattaatggattctggccccgaccggggagcggttttaagccgttcattgttatggacggctcagatcggctcctaatccatcaaaacccccggaccaaataagccctaatcctaattccagttttccccttcctcccctccacgcagg

SEQ ID NO: 50676 - DNA, 1501 bp, Oryza sativa
gataacaggatttatattgattttggacggctgagatcaactttgacctagtcgaccaaaattggatggctcggattgatctgatctaaggttttagatggctgtcacgtgggatctgagagacggcgtgacacttagatggtagggacggcagctaacaaggcgatgacatggcaaccatgcgggatcgacgccggcggctctattcggtggtgaggacggcaaacggcggcacaacggcggaaaccgagagcacggggatgaagaggaggacacgacgatccttactaacacttacgcagcgatgaacagcaaaggagatggccggcgacgagaacgggagtgacgacggggtactgatcgatgatggcggcggagtttcagcgacaggagacgacaaccgaggggtgaacgggcttctcctcggtgctgcgaatccaatggaggcggcggcgaccgaaggcgacgacgaacggtgcgagtggagatcaaaccatggcaacaacccacgggttcacggtgacggcaaccttccggcgggatttggcgcaaaagaactggcggccgtggtagagatcaaccttgcggagcagagggaagtggcggcactgatcgggaacggccggcgcgacgggaaaaggcggctggagatggcggccggagttggagagagaaggcgagcgtggggaggcggctagggttagggaaaacttcgggaaacagagggaaaccgaagaggaggccgaggggctgctatttgtaggcaaaggtggaggagatcggctcgagaacggatgaattcggtgaaggaagttaagatttatcccgagttcacccggataaaaacgactgaaattcgtgagatagataacgaattttaagggagttcttggagataagatagaggagatagagaggaatccgtttttgcaatcaattttggaagggaagcaacggatgcatcgaatttgatggaggacacggcggctctcgggaagaacacggcctctggacggctggctggagcttgaagacgcactgtagcaggagggagggcaatacagactttcagctgggcttcattttccaaggcctgattgaaggagggacaagaaatggacttcggaaaagagagggagagggctgcaggctgagaggagactgggccgagagtgagaggacttttcctaattcggcccgaaaaggaaaaggggaatttaattacttttccaattaaattaatcaccaaaatgatctttgaattgttaaaaatacttccaatgctcaaataatttcaagaaaaatcctgaaactaattggacactcaaagtacttaacaacgttataatcagaccatttaatgattaatttattatttaaataattgctgaactgctctttgtattattaaaattaagaattgagctccgaaaaatccgagaaaatttcagagagtataattaaccatggagaatttaatgaaaactaaatccagccatgc

SEQ ID NO: 50677 - DNA, 1501 bp, Oryza sativa
ccgattaatataactccatgtttttgctcaaaaattttacaatttttgcacatatatgccccctaattttacaatgacgaagacattgctaaaattataagttgaactaagggcgatatcataatatcggccattgtacatcggtaaaccataaccgattacaatatgaaaaacatctaagggcgatagaacaatattggccatctcaaggcaatgtgaacacatcggctatcatgcatcggcaacaccagccgatcatgcattgacccaaacacttgggtaatatttcttcaagtatttgccatttagcgatcgtccataaacttctccatcgagttcttgcaacacataagctcccttagacaaaacctgatagattttaaatggtccttcccaattcagcgaccacttgccaaatttgttatctcgagtcccaatcgacaaaatcaatttccatacaagttctccttccgaaaaagacttgggcacaactttcttgttgtaatgtcgagcaactcgttccttatcctaggtaacttttgcaagggctcttaatcttgattaaaccaagtcttccctttcatcgtccatgagattataatactcatcggctatcaaatcattttgcaactccgttcttcttgagccaattctaacttcccatggtaaaacaacctcatgtccataaacaagcttataaggagggacttggatcgatctatgaaaagccatccgataagaccataacgcttcggccaatcgagtatgccattgccgaggataatcggaaatatttcgcttaatcaatttgatcaaactcttgttagatgcctcggtttgcccattagcctatgcaaaatatgttgaagaattcaacaatttgatacccatactatcggcaaactgaacaaactcatcggacacgaagattgaactttgatcggttgtaatagtttgaggaatacctaatcgatagattatatgctcttgaacaaattgtatagcatccccagaatcagctttcttcaaaggaatcgcttctagccactttgtaaaataatcggttgccaccaatataatcttatgccctttgctcgatggtggattaatcataccgatcatatcaattcctcaacctctaaatggccatagtttaatgataggattcatagccgacgccggtgccctttgaattgctccaaatttttgacaatcttgacatcccttgtaatatttgaaactgtcgcgtcccaaaacgactctaaaatacatcctcaaaattgtgcatagaataagtaaaatccatgtgaaagcctccaacaattaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtcttttttc

SEQ ID NO: 50678 - DNA, 241 bp, Oryza sativa
cgctgcgcacgtaggacttctgctcatacgggcgaattcgagctcggtacccaggtgttgttccgagctgataaatcgacacttttatgcggattgagccaatcttatccaatcgaatcaaacgaaccttttttttcgccacccttactttttttgtctcccttatctcctccttttcttcacccacacatctttgtcttttcgcctctctttttctccgccttctctctctccaccggca

SEQ ID NO: 50679 - DNA, 272 bp, Oryza sativa
tattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcaga

SEQ ID NO: 50680 - DNA, 1501 bp, Oryza sativa
aagatcaaactcaactgatacagctataagtatgacaagaaggacaatatctagacaatcaagccgttggatgtttcatagagtggtagatgtcctatacaatctaagtcagcgttgatatttaacctaatcggctgccttctagtaacagacgttagccgattagaggttagatagcgatattgccagagattatataagatatatgataactcgacgaattacagaaacaagattagagtatcataaagatggaatcactaatcccgagaacgcaagccgccgtaataagttttacctctagttgaagatcgaaaccgatgcagctcaacctgaaagcaagaacccgtcgaaacaaaacggaagtaaaaagggtagcaatgcgccgagattgtattgaacgagtgttagtttgattacatggggctcaggtctatttatacccaaaaattacaaaatatgtccatatcggacatgtttcttgtctctaacaaactctaagataccataagtctttgcggcagacttttgcccaaacaaatctctatggaaattacataaaatatcctacttaatagatacaattgccttcttacgactctatccatgtgtggcaatcatcatgaagcacgtcatcctaacccgacaacatatgccgtgtcatattgtcggattcgtctcaatcggctaaccctgtccgactcaaactctgccgatcttagtcgtagccgattcggactccagccgatcctcactctgtttccgggacagtctctatctcgaactccgtcttgaatcctccttcacatccgatccttggattaccaaatttggtcgttagcacatatctaccatctcttagagagtagctacttttgtctcatatgcttgattgttatgctaaatatgccctttatattaagatcttattgagttaaagtatattaggctttctgtttaatatatcttgtctgttctaatatcttaatatagagtggtatcggagtattagccgatacatgctagatctatctgatcggctatgctataaacgttcgtataatcattatctgaatgtatcttttcacttaagtgatttatactgtctcgacatactgttcaatctatcccaatcacaaaatttaaatatacattgagagaaggattaaatattgttgatatctacagccaatcgagtagatttagttttatattgctttattcttcattgctggtctaatgccaataacatcggctcaatgattgatcatatgtcatcggctcctagccgatcggctatcgtttatagatttaacctcctttttcttgtcttttcttcttgttgattgtaggatcaaatcaattggcacacctttgaacctaaaaacaagattttggacctgcacaggagttaagcagatcttccaggccagtgtgtgtttttcgcatcaacacgcttttggcacgcccggtaggaccgagttgtaacaattcttcaaca

SEQ ID NO: 50681 - DNA, 265 bp, Oryza sativa
caggactactcggattggatccatatttggtttccctaattccaactggacaaagggaacacctatgggtataaaacaagggccccctaggagaagaggggagaccaccccccatgaaagccacccacaatcaacatacacgggaacaataggtcaagccaaagattcaacatacaagctaacatacgcaaagacaagacgccggatattgacttcagagataggcacggctagtcccctacggtgtcttccggatactgtcagg

SEQ ID NO: 50682 - DNA, 1501 bp, Oryza sativa
aaggtttgaagcaacagtattgtttatagtccaagcggcgtttcttgtttttgcgttttgaggtcttgaggccgtagatgcatgttatttactgttatatattcatatttgagagtgtttgctgaggctttgattgtgattaggtggtggtccttcagatcgtgtatgataccaacccttcattggaggcaagtgaatgtagctgtggtttgctacggttttatcatgttattttttccaacctccaccttgacactttaatacctacaatcactataattccatatgtgcaaatgattattttatgtatcttgctctgagctatctccgctcggctaactatggttaatgtggtatgcttttagtgagagtaattattatatgtgatatcattggaaggatttgtggatgtgttatctttcctctattattgtattgcattgcatttcatatgcatttcatttgaagttatgtcgtgaacctatggtcgcgaccgtaccgatacagcatcgtgtattgtcgtaacacgatgcagcttcacaccttgttgggtgtgaaggcaggaatatcattgcatttgcatcgcattgcactttggtattttggggtatggaagttatatactctattgagttcatgagagggcttctttctcctgaagtctttgcagatgtggtttatcctccttactcttgaacctatgaacactagatgtttgcctttatatttaatgttatgttcctttgttttcttataaatatattttaatgatttggtaggttaaataacttgataaaacaattctcttgctgagatttattctcacacccctacagtgttttcaggtgcttaaagtgatatgctcgcttgggggaaacaggagtagaagcacaactgcattccacactgccaccttaatctttcaagttgtcatgattttgataataaaggaactgtacccttgttaagttgcactagatgaatctgagagttgaaattagtttatttcatccctgaatgttcctttctccttgtttttttgtggatggctacttgcaatgctatacttatatttgacgcttccgcaatgcttatgttttaaaggagttgcagtcgaaatttctccttctttgttaaatgtatgtctatttagtagcatcccggtgtcattgtagtttctggggtgttacaccgatacatgctagatctatctgatcggctatgctatgaacatatatagtctcattgttaacatatacttcgatctaagtgatttatattgtctcggcatggcgaccgatctatcacaatcacttgatttaagtatgtatcgacataaggattatatattgttaatatctacagccgatcgagtagatttagttctttcttacttattcatgattgccgatcgatccacatatgacatcagcttcaagataaataatacgtcatcggcatttagtttatggatttaaccgcggtttctttatctttgttt

SEQ ID NO: 50683 - DNA, 532 bp, Oryza sativa
  unsure (1)..(532): unsure at all n locations
gtgaccccnnttggattgtatacgactcactatagggcgaattcgttctgttacccacacatttgcataaaatttttgaataagatgaatggtcaaacatgtgagaaaaagtcaacttttattgtctattaaaaaacgaaggtaggtaatcacaggttttcgcatcatggtctagcttgccacaactagatatagaagtgagtcgaatcaataaacccatttataaaccaaattacccgcgagacaatctgcagattatccactaattttacctatataacgggttggcccgcttgcattcctaattgggcctgcctgacccaacgagtagagcccgtccagtgccctgacagataccgcagcccaagtagggcccataaaacaacccgtgggcccgtctcttgtccgaccgttgctgcgttgctggcaggtggggcccacaaccagcagcggcccaactcccaaccccgttccgttccgttccccatctgctcctccttccttccgttccagcttgaccccgacgcgtacc

SEQ ID NO: 50684 - DNA, 161 bp, Oryza sativa
  unsure (1)..(161): unsure at all n locations
tttatgtactcctatattcagcccactnaggtaaattaaaccngctccctgcaggtcgactctagaggatccccgacagtttgtttacatttttacaattcagcattgttcagtgacatctgtaattgtaatttacatctgttctttgtgttcttgatagg

SEQ ID NO: 50685 - DNA, 1501 bp, Oryza sativa
aatttttgacgtgaactcctcaagcggcttcaaacaagctgtcacaattcttttgtaagtctcaccagattcctcaaagaaggccgctcgacgccatggttctaagttacattcagatacagcacacaaatcttggtatgcaagatactgcattagtgatcttggatcactcagttccaatgtttctaggatatactcagtaggattagtctctgcagcagcagtgctctgtggtggagcgaaactgcaccttcttgtatgcacaacctgaaatttgttgaaagcagttgaattatggttatgaactataaagtttcaggaaatgacgtcaatctccgcattccaggcaatacaacaagtacatcatataacatcttttttcctttgaagttggattgtgaagaacaaacctggacaaaatgatgacttatttcccaacagaaggcaacggcagtgctcattataaaaataccgatttgggcgataatttggcttccaatggatcctctgattctgaattgctgaggaagaacgaaaatcaagataaaggaaaggaagaaggcctgaagtgacaccttcagagccctttttccagatggcagaagccccattttcaaaccatagaacggaggtcgctggacaaaaaacaaattaagaaagcaagtaagacaattggcaaaattggtgggaagtgctgaaggattgcaagtaaacaacatgcaagcctaaaaaatcgcaagggcaaaaaaattaaccaaacagagctatagatatcagagaattgcacatataatttagatcaatataaaccatgtctccccaaaaaagatctagatggataaaaacttctctatcaataactatcaaagcaaactacagctcatgcatgtggattctgaatatcgtatattctggagaattataaaacagcgctatagtgtcttatcaaacatgataatcaaatttctcatctgagaatagcacatgtatgtccaatgtatatcaacctgaatattacagaggtgctagcagctattccctaatcatttgatcaattcatgaagctctctagtgggaagtgggaaccagttaaactcggaacaaatcacaaagaatcttagacccaacataccaataatacaagccacagttatcaaaaacatccatgcttagattcaataacaaaaaatcaccagcaccatcaatcatacctaagtaggtaatctaaaatcgtaacaagctaactttaaacctaaaattccgatctctatagtcgcaatacctctattaggagctacagccatttggcaatttgataagattcggaacgccattctagatgagaaccctacttttccccacttcactgacctgcacaacggggaactggagcaaccacctccgacgcccgaaatagtgcgcggcgaacacggctcccaacacagcgccgcggaactccatcccagcaacagccgcccacccggagtcctcgggtaccagc

SEQ ID NO: 50686 - DNA, 1501 bp, Oryza sativa
cagcacaaggggaagaaaagggtggccctgaaaattttcaactgttgatgctagctagcggctgatctcgctgaggtatctgtgccagtaatttttgtctgcggataggacaacatggagaggatgactaggaaaaggagcactgttcaaactatccaaatgtctccaaccaaaagtgatgacccatccttgcatatgtgcgcatcagtgcatatgttcttatgctggtgtggggtgaagattctggtgtgaggggcaaacggtgacaacggaaaagaaggttcgaatataccctgttccctgattacaaatacagttatgagttctgaccattggattgtatacatatgacaaaaagagagtaaacttcagttcacacatcagaccaaattgagtacaggtgctaccagtatttggctttcgaagatattttacattgggacagcgagaggagtaagttcagttcacacatcagaccaagtttgatgcagctgctcaatgctctgtttgttcgttttgtcagggaatatgggctaacagtgacccaatctggattggattcctatcaataaataaacaaataaatctggattggattgtggaaatgataagaacacgcgtgcaatttgatccactttttatgcgatcaatttgggaggaaatgctctttcgtttcgctctcacaaacctgtgaacaatttccaccctctgaactttcagcattgttcttgtattccccacttcctgaagttcttaattctgtcaccaaacgacttggcatgcagaacaattcagtccctcacgagatacagaacaagaagatatattatcttataccccatgggccaggtaggtacaccagcaacaatgcaaatgccgtcgcatcgcatctcagatacttatgcccactaagcttgaccattatgttaacttggattaggggtaggctagagattgattggggcttatatgataacactacatatacacataaaccacaaaatcaagctatcaacattcctcatctcgttgatgccgacttatatctgccctgatagcgcctaattaacccgtgaacaacgtgtcttttcatcgtccaagtgcccaaccaacacatgacaaaagcaaaacgagtaaataaatttatttagctgccaataaacaaaggaaactggacctgcccgtgtcgaatcaaatgctaataactcgaatctggaacaaaattaacgccaaaaacaacacaaaaaacgactctttttttttctccaaactcgactcggctttgagagttctaatcttagccaggctccaccccaacctgtgctgccctgttcgagcgaagaacgaaagcgacacgagccgtccatataaatccacgccgtcgccgccgaatctcgcgaaaaagctcgcaaatttctactcggggaagaagaagagccctctccaaaggatctcctcgcccggccggcggcgatggcggccgcggcgccgatgccggttg

SEQ ID NO: 50687 - DNA, 1501 bp, Oryza sativa
atagccgatgagaacggcgtgacgaacgccagggagctggagaggtatcagtgactcgcactccttcagctgtgctgcctcgtcgacgacaaggagatcaaacgggcttgcttctggcaggtagtgcagacgggatgagctagaagctgtgcagagtatgcttttggcgttccggactaggaaatcttctatcgaacgcttgtcgaaaacgttcggaagttcaaagtgatcagataggtgttttagcttctgaagacactgagctctagcatccttcagctctgtactcacactatcttgcacatatgtcacgaagttctgaaacagtgagctgatgctgccatcggggctgagtttgaacagggttttcaggctctgttctgatttgggctccacaagtttaccaaaaaattttagcatgtgcagggcctgggtcatgtaactgaaattctctgcagttgtagctgacctggggagataatcacagaaagtcttgacacaaacattaagatcattctcaagccgtttgtaattacttatgaagtattccttgaactaggaagatagcccgcgcattcgcgcgggcatgtattgtgggctgcatgtttcaaaaacttataagaacataatattaaccgaatagcactgtcacacttcgaagtatgttttctccacaaatattattcgttggtatttgttattttccacaaacgtgttatctaacaacttaaaagtgtttcacattgttgtaatgtaagcaacatgttgttaatcatatggtttaaaaatctttgtggcttttcctaaatatttatggctgaccaatagctagtctccaaaatatgctctaaagtaatttatttcttttacttgttaaatatagttaatttggatttcgactcatgaaagtttactgcaaataatctaatgaggtgcactaataaaaaaatagtttagatggtatagttgtttaaaaatttctatcacgaaatatgttttctatctaactaataagcatgaaaatagggcaatgggagagaaggaaaagaggaggcgaggttgtgctcgtgcatgaggggggagggcgcagacatgcacatgtacggacataacataataggacagctagacaggagggatgggattgggccttttctctttttgtctatctattaagataaatctaatggtaaaaaaataatgagaccatggtaaaaggcatatttcatataaattatgagtatatgtgattttttttaattatttcatattttattaagtcaatttagatgacatgtaaaaaaagtagggatgttgtctcttgacaaaacactatttaatagtcgagtttctaatttttgtttgacattgtagttttaatttacatatgaatgtttctagaataatgtggatgagaggaatggggaggaaggggaaaagatgtttttttatttaaaagtttaatagagatagatttaatgttaaaaataataggtttatc

SEQ ID NO: 50688 - DNA, 1501 bp, Oryza sativa
ccatcggattgcacataaacgtttggatagcaatcaatcaatcaactggggatagcaatcaaaataaacatttagcaacaactaattaaagaggcccacctagccatctcttaatttcgaaacatacagttggaataccaacagcaacacatgtagtagcccagcagttataagctctttaatcttccattgaagttattttatctcctgtaaccggtgaatcagatgaacagtcggtcttcatgcctttatatactctctataattcactgggactttgttctcgattgatcatctgtgcttggcagtctttccatgcatctagttgatttatttgcccactcctctgctcatgctgatgcttcaacagatcaacatgcacaatccgctttggtcatctctctcttgcttgcttgctcatggatttatttttctttttcttactaatatcatttgttgtttagttgtagaatctgaagagaagaaaagaagtagtagtttcaaatatttcttaactttctgttctttgtgaaggttgcagatcttatagagagaattgaagggttggtgcattactatattcacataccggttgaaataataagaacaatttttttttcagttggttaaaataaataagaatacctttttgtttcagtaggttattgacatcttcgactgaacttttgaaagtttctacttcattaaaactatagtttggaataagcaattacatagcatctttgtgtaatcacgatgacgtatattgtctaccatttttctgtcttgctacatagcatagaacaatctatgttagttttttttttgtaataatagaacaatctatgttagtaccattcaatttattgcatctgtgttcaattggccttagttctagtaaaaggaattggcctttcactagacaatcagcgtattctgttatgattcaaatttcagttgcttattattataacattggtgaagtgttcagtgtataacaatacaatcattcatacctaattttttatctttatattactcttgtatttccgcagcaacgcgcggggtgtcatctagttagatattcttggatccgctcgtaactgcgtttgaattgatgatggaagtttcaaagtactagtgttatggatcagatcattaacatgtattaacccatattggtacactcgtgcacacacgatgggccctgtcttaaactatgcgaccaggatgtatcaagacaagcagttagcttaaccactaagcttagctttgaactcatcgatggcgatgagaacttcaagtcttcggtcgtcaagtcacactcaagagtctcacgttatacgacagaaaacacgctttcaaacatggaaaacctccatctcccctcgggcactcgaaacacaccaaaaactcccaaattccccctacttcaaacgcgtcgatacccaaagagagaaaaataaagaggggaaattcaaaacctcccccaaaaccctcg

SEQ ID NO: 50689 - DNA, 1501 bp, Oryza sativa
taaccctcagagcatccacagccgatgcttcaccacactgagctaagaatcggctaacgtgctcataggttgaaacgctgtcctgtcctgagaattttgaaaaatatgaaaccttgaatcggttaggcaatggaaccctctcaaaccactcagcgtacggatgccgatacaggtttccagcatccttcggcttgagcccaaactgctctctcatcacatctgcaatcatatcggcccatggtctttgctgaggcactccctgcgcttgttgtggcattggctcgaattgattgtattgaggagcgaactggggctgagtcgaccccccttactgatattgaacttgtggtgatggaggctgatactgataattcaaattgcccccttgataattctgaaagtttagttgtatattacgcaccaaatgttcgggaataacttgaggtaccaccattttatctggttgcacattatgaaccaaatgctctgggacaacttgattcgcagcgtgctgtcttagctaattgtcaggtgttccgaacccagccgatgcattcaccaaaccttgatgctgaatcggctgaacaacctgttgcctcggtcttgtctgctgaatcggctacacaacctgctgtcttggtggcatctgctgaatcggttgttgctagattgtgtcaacagtaggctgagctggtaagaacatagcagcaacttggtcttgagttagccgattcacattttgtccattatgctatggctgttctctcaccaacaaccaaggattaattagttgacctggtgccgatgatggtgcagccggtgcaggagccgagactggtgctgtcggttgagccgatggtgcactgtgaggaattggctgaacagctggctgattattagtgaccaagggccgatagtttgggaaaacacctcctggcaaataaaccggtcctgtagcctgatactcagctatcgagcaatcaaccatcgacttcaccatgtttgacaaagtattgactaacacccaagattgattaattaaagcatgttgcacggcatagtcaatcctatcctggaagttgttaaattgtagctgtgccgtgttgccatcttgattatgattctcactgaaagtgcatctaggacccctcatttattttggtgttaatgacaacacaattagagggtaactaatgctttttgttgagacgtatgcaaggatgaaaaagtagtggatgtcaacacaataagtattgcggcatcttttgtggtaattgtcttctaatccatgcatatcttgtgttcttgagtattaggatgccgtactattaagaggaatgccacatgcatataattggtagaacactagtgctcaaaatcatttatttgaagtgttcctgttttatgtctgtcggactatccgatgttgattagactatccgaaatttcacagaactttgctcactgtcttgggtctgagtgttggctaaaaaatatcgga

SEQ ID NO: 50690 - DNA, 1501 bp, Oryza sativa
cccacttttccctctctctctccctcggattcgttcggaaagtttccccctaacttcgccggcgcatcaatggcggccggatcttccgtggccgattccccctcatccggccgctctctccccctcccaaccctatataaacgctccccgtgcctccctccgccgtttccgaccctcgccgctctctctccccgtcggaatcgagctcgcgccgtcgctctctctctccgccgtcgccgccgagctccggtccgccgccgtcgtcgccccggaccctctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgccgttcccgtcgtcgccatcgacccggggtgagccgtggaccgccatttcacttcccccttccctcccctctctcgagcgccgctccgccgcgccggtggtcgccggcggcgaccatcggggtgcgggtgcgtcgcctcccgtcggctgtgccggcgaggccgccttcgggcgcgccccgcggctgccatgtggggcccggccgtcagccgcccgcgccctcgggtgcggctgacgcgtgggacccacggcgccggccggcgtaagccgcgtgcacccggtccaccgtggaccgtgaggctgccgcgtgggccccactcccgtggacccggtccgcgcgcccctcccctcggctgacgcaataaatccaattttaaattaaaatttaaatgaagaaattcgtaaatatccatttaaagagcatataaacttcaaatggccataacttcgccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagccgacgtttgggaaagcgggcaaggcaagtcacatcatctttgaacatattgaatcccagtttgtaaaattatgttgatttaacttattgcattatcgctttatttaaattcccgcgttatcactgttttatttagccatgcctatttacctttgttatgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatattcatatcacctggacactatggaatggtttggttattgtggaattggcttcacaccgctccttctattcaaaatccccaaaaatggttttaggctgggctcggggtgcatggttttgatagtagcac

SEQ ID NO: 50691 - DNA, 181 bp, Oryza sativa
  unsure (1)..(181): unsure at all n locations
agtttggggcgtgttccgggcttaaaggaatgactgggacgatagcagattgcctgatgacgggcaacgagatgccagctgacatcactgccggagccatgaggttaggagaggatggagaaaagggttgatagtgggggtaaaattgtcgactagttaggatgggtggggtagagnacga

SEQ ID NO: 50692 - DNA, 1501 bp, Oryza sativa
tgctgctatcgatgggttagagctctaggatatgttacactagatacaagaggggagcaagctaatttagcataccacgatataactaatctggcgacttgtagtaagtggctaactttagtgcatcctcctggttggtccttgatgtggcttgtggctatagcttgcgattcaaagaaaattcaaggaaaaaaatatatgtaaccatatatgtagtggaaactatcattggattaaaaaatgaacgcctgagtaagattttactcatggttgactttgagaataatttttttacttttggtgatatggacaaatctcagacgtctatttttaagatccaacagtaatttctaagttttcactatatttgtggtttgcaatatatatttacccataattcaatacctttccctcgtaatttccactacatatatagtatttttacatgcagatgaccaatcaagtaaaacttggagactgtaagtgaggtacgagcagataagaagatcggagtcaaacatcttctcttaacggggaatgaatttccatcttatcggtaaaagtaccattccgtaaaaaactagttacatggttttcagctgttacaaatacaaataaatgaggtatatcttatcagttacactgaaaatattattatatttttaaacatatttgatatatgacctgaattgaattaaagcttatttgaacggatggttagaaaattatcatttccactgccacgaaaaatgttatgcagtagtaatactaatctactccaatggcatgctcagattagcaagatggtaatattgttaaaattttgacatgatttttatgtatttactaaatttgacgataaactaaatatatgtatttttataactttattagaaaatggtatgattgaaaatgacattaatcatatgccctaaatttactgacgtcttgtttggcaacttgagggaaggggattgggagtttacacggaattgatggtgagattaagatgtgaatttgatttttcatcctagtctcttgtttggtagaggtggtggaaattgatagggagtttagttaaagattagatcattaatgaaaacggatggctgagatttgcttagacgaagtaaaggaggaattccctcccaattatctgcccctacccaggtattgaaaaggagggagtttattcctcaattccccatcccatcccaccaaaattcccatatctcccaaccaaacaaaacagttaatagccttatccctctaaactaccaatcccttctgaaaactccctccaaccaaaaagaccgtaaaaagaaaaccaaccaaacagaccgtaaaaagaaaagaaaaggagagagagaaagaaaagggataacgcacggcgcacttcgaaacccctcctaaaccacgcgtgacccaatcgcaatggcgacgccgccggaatccctctcaccggctgcagcggcggtggaggatgattgggaggaggcgc

SEQ ID NO: 50693 - DNA, 1501 bp, Oryza sativa
ctaataaaatcaacattaaatgacttgagaggagaaggtaccttaggctcctttgccatgaggcaaatgggagcatcctcatcactttagtagtcgaagagtcttggtggtgatgaaggcttgacggcgaacgtggcgactccttctccatcacttgagcttgactcggagtcggagctgaaaatcatcccaaggtgagcttggccataatgttcccgcttgctatgcttatacttctccttcttctcatccttcttcttatcttccttgatgtgggaaccatccttgaggtgagggcaatccgcaatgaagtgcccgggctctttgcacacgtagcacactcttgcggaatgtcttccacttgacttgctggagtgatgcttggaagaatttcccttgaagaagccgcttcgcctcatgaacttgccgaacttcttgacgaagagaaccatttcttcatcatcgatctcctccttgctcttgctcttgtggctctcttcttcttcttcctttgccttcaatgccaagtcttccttcttgatgcttgtcgttgagctttggttgatgtattggatgacctccttggactcttgcacaagaatgtcatgggcaagaatgcgtccgagcaaatcatgaggtgtgagagtcttatagtccggacgctcacgaatgatggtaaccaaggtagagttccttggagtgattgctcgaaccatcttcttgaccacaacctcatcggtcatgtccttggagccaagtcccttgatctcattgacgatcttgctcaaccggtcatacatgtcacttgggctctcaccatccaacatcacaaatctctcaaattgccccttgaagatctccaccttggactcacgaacactatccgtgccttcatgcaagttccgaagcgtgtcccaaatcactttggcactctcaatgccatccacacggttgaactcacttccactcaaggcactaagtattgcattggcggcttgagcgttcttgtgcttattctcgtcgtcctccttggtgggatcttcgggattctgcaaaacatagcctttttcgactattctccaaatagatgggttaatagacttcaaatgcatcttcatcttatgcttccaagcggcatagtccgtaccattgaagtacggagctttgctgctataggtactcacataagatgtggatgtagttggatagtgataaggaaacttagctcccttatcaccatctttgccttcccccatttggcccgacatgatccctccaagcggttaagcctaatttggagattaggctctgataccaattgaaaaggtcaattaggcctagagggggggtgaataggctaatttaaaactttatgccgaagctaaaactgatagtctgatccacagtcagactatccgaaaatatcagatagtctgatgttggatcagactgtctgatccactaaaagaacactacaagtagatctagtgcacaaacaaga

SEQ ID NO: 50694 - DNA, 1501 bp, Oryza sativa
ccagcaatgtattcgtccgttccaaaaatataattatgtttacacctactttcatatctcaacaacgatatatctttactctaaggtcccttcgaattggaggattgctttacaaattttggaggattcagttttctaaggaatttttatatgttcgtaagaagggaatggaaatttttcataggattgcatttctatagccaatttcataggaaaaaagaagaagacgtccaacaattttggaaacctttttctttgtttgttttctgttattgaagggattatcttcatttttcatttgtttttcattcctgtaagataaaagaaacacaccccttcaattcctgcattttttctaatttctttttgtgtttattatatcctgcgtttcaaatgtggccatatataagaaatattccccattcaatcgccaaaatttgagaagcactcgacccttgttcgtgaatgaaaacttctctttaatttcccattgatttgatccagctaattaattaattcgatccatttctgcatagtttgcaattttgcatggtgatggcgccaaaaacccggagagagtggtgttcgtggacgtcaccccattttctcctcgcttcccgcgtaatcctcccttaacacaaactccccgcgctaataaaagattagccaacgagaggaacaaggagacgacgcatgcgtccatgccccggttgcttcttgttgggaaatagaaacggggtagattgcattttgaatttctctctctcttcatctgcctcactttctctctctacttcacttcttcttcttcttctcttctcccaagcaaagcaacagctcgagatcgatctagtactgtggctgctagctgcatatataagtaatggtgcatatttgatctcgctttcgcaaccgttcgattggtttgaggatcaattgatttggagatttttttgagtgtgttcaattcatcactcatcaggtcagtttcaatccaggatgttgttttgttgtactgtttcttggttgctaattatgctaggatgttcgtttcatttgtgcttaattttgttgaattttggcgcatgtttaactaatagatcaccttcttttgtataatgtaggtagtaataacccaaacaatctgatctgtaaacaggaattccattattgtttcttgtcattagcatttgcaacatttcagacagtgtctctgtccacataacataaacaaataaactgtctaaataagatactcagacagtttcttactggagtaataatatgctatattgatcagtgtgattagattgttactgatgtggaatttggatttcaaatcccagatcaatttacacataatttgttcactccaaaataagaggctaataagcctttcctgtgtgaatgtgcagagagtgtgaagtgcctactgcatgagctagctgtgagcctgtcacaagatgccgttgtttgatcgggatcggtaccagcggctgga

SEQ ID NO: 50695 - DNA, 1501 bp, Oryza sativa
aaatcatatactacctgatattgtgtgctctgttgtagtcaataagactttgttttattttgtgtttccacctatcatgaccatggccttcttgtctaattttttggtcttcggtcttatcttctaggatgcatggtgcctcccctgattcaggcttgcatacttgctatatggatttgagtggcctatatacatgcttgtcggggataacgattaatctgcactttatttgttgcagctatattgcagtcctgattcttgatcagcaatacctttgttgctgttagttctatctctgaagtctgaagaagaatattttctttgggatgctagatagcatgcttttcgttccatcaaattgatgtttcattcagtagtctatagaaataacaggaactgcacaggcaccttcaaatgcccattgtaatgctggtgattagtctccgtgtgcagtttttttttttcttttcatatacaattccatcacaatcctattacagggaaatgatggagtgttctttggtgtgcattttctttccttacaatgggtttatgtttgaataactaaaatcgagatgcatcatttatttttcttaattcatgctaagtgtaaacttttttttctgtagcattttcctggacttgttgcactatcaattgaagaaactagtggagactgcaaaattatgttgtattaaattcaagttggattggccatctgatttttcattctactgttcaaaaaacttggttattcttcaaatgatctccttggaccttggggtgacttgatgacttcccagtgagattgtagtattgcactacatgtaatcataaaaaatggtatgccgaaatctaaatcattcgtcccaggtgagttatcttccttaaaaataccccgatatacccagatctagattgttatataatgttttagagagtaactgaatgcaaaagtacaccaataataaaccatactaaactacttgcataattgtcaattcataaacaagaattaaggaaaaattaattggaacctgtgtcaaattagataaaccaaattatcactggcacccacttttttaatgatattattactattctcaatcaagaaaaacatatattttccagcattctgaggtaatcatgtgcttggcctaaatttataaatatataatagatttaagcaaacatatagtaagacctgaaatcttcaacttggtggactgccaaactgatcacgggtgacatctagtcatctatcataggatgaaaaaacagatgagagaaggaatatcatattggactgtattccaaggtaccccagttgattgaattattaatcttaattaggtacctaatcacttgccatgtgcttgttcatattgtttaattgcaattgtacagaactatggaactatgcatacatgcaactgattcctttcctcctcctgcatgatacagtagcagcattttttctccttggatcttgctctttgaa

SEQ ID NO: 50696 - DNA, 1501 bp, Oryza sativa
tatctctaagggactaacacagtagtaacactcacctgccacttgtgcaagcctatctaggctcgtgcattgtactccctccgttgtaggtaacgctgtaactattttatatatatgtttaactatttatcttatttgacaattttgtgtaaatagataagatacagattatgcttaaaacaacttacaacaaaataaataatactatatattatgtaaatcttttaataagacaaatcgttaaacatatatatatatccacaaatcaatgacgtcatctagtttatatttttattcccgttcaatctacggatatccaatacataaggtcagtaggctgccgctgcatgtaacctaaatcaataccagttcttacatgtgactattttaggttatgaccagaatatgtgactatttttaagagacagaagaattagcggaaatgagaacaatttttttggcatcactttcccctctttgaggacatgtttaacttatcaattaaacatcacaagataatagtagcaaacatcatataacgtatcaattcatcgagatagcattaattatagcaattacaaccttcaacttaaaattttggctagtgaaaaaacatgacaataatctgatcttagttcggttcagtttttttttggggcctcggtcttttttgccatttctacctgacgaagtgacgatgcactagccagctactagtagagacgaggctcgtgttccgtacagcctcgtagaataatcatcgtgcggttgtgttcacacaggcaagtggcaacatattcaggggcaaacaatccagagttccagtctcggccttcatttactcaagcagatgtgattatatgaaggaatggttggttgaccacgactaagcgtagcagtctaatgtagaatgccactccatttctggatttccaagagaaagcgtgaggggcatctttggcgtgcacccatttccagggtcgactagcagcttgcaattaccctgcataaatagactggcgagtgaaaaagatgcggcgggctatatatgctgtcatgtagtattcctgtgcagataaaccctgattaaaaccagacaaattgctggactcggcactaagtttttcgtcgtttgccaattatctaaccaggtaaagtcacataagttactgaaacagaacacgagcagccacaccaaccgaccacaaataagagtaaaaggcacacttgagattgccaggaacgatctgaatttttcttgggaaaaggctgctcttgcgtgctacgatggccgggctatgagaacgggataaaaaaaaaaaaagagaggtggaaaaacggcgacagtcatcgtcgagcgcgacgtctcggtgtgatgcacatacctaagaatacctgtttgtgacatcatgcgagcaagacacgcacgctcctccacctcccttttgtgatctgcacatcctactcacagtcgcagagccagctagccagctgcagctga

SEQ ID NO: 50697 - DNA, 362 bp, Oryza sativa
cacatgcattaagttataattatgtttaaattctcacatggcagtcctaccgatggcgacaccactgtagacacccacctcgcggttctaccaatggctgccccaccgtagagcccctgcctcacacatcaagaaaccactatgcatggattccactcagctatctactccgctaggtctatacccatacgagaagtgcggttgtacgggggtagtttcatgcttaacttcatggctcggtccttaattgaccggggacgatactagccttttccggataccacccaaatcctccgtccgccccagtcgaaaacagttgtttaattttatttctcctttcacaaatcatgtcatcaacatca

SEQ ID NO: 50698 - DNA, 1501 bp, Oryza sativa
aagaagagatgcgatgctacgaagccaccgaattttcagccagcacggccgtgaactgaccaccgctgctgtccggcgggcagcttgcttgctggctgagaaatgcacgtcttgaaggttgcagccggggctaaagtgccacactggcatgcataaacctctgaaattctgatggctacagccaactaacactgcctccccggcctatggccatgatctttggatgaagcctggctttagtggcttccatgcgatgcagagagagtgagataagccttctcgagataagtagggagttgagagtgactcatgtatatgtgctgtggtaggtctgcttgctactttatttttctccccctgatctaattaatggcttcctcctgtgcccggaaaatgacatggtcgtttgttgttatgtatactgagcatgagcagtgaacatctgaaggattttgacggttaaaaatgcgttcatgcgtcgtggagaaacaactgtagcagctcgttttttccccccaccacttgtctcgaattcactgtaccttgccaccaattcaactttgatttggggtcatgtagaattgaacaacttgagataagtcaacagtggtgactacctggaagcaaattccttggtctgaaatgtcccggggggagagaaacagaatccagtaatatcgtggccaaattttaaggttaggtgtgttccctgcctcttcctgatagcctttttcgattatcagaattcagaaaatgatcgaattggggtagataaacagagctacaattaaactggggcagtgaactgtccaagtttgttacctcgaatcaattttcaacgattaaataccatgattgcttttgacaaaacatgctactagaataaaaatggggcttttgatttgagtgtgtggggactatagaaaatagtgcatgatctgaagactttcagtatcgtgggtgcacaagctccacaaaaaaccttttggataggtcgtacagtgtatgacctaaaaattatctggttcactcctcaacaaaacgtggtctgaagcaacttgccaactcgccccttcagattagtcatgattgtgcagtgtcaactgttgatcacttgttctcgtgcccataaagaaaaaaaatgttgttcatggtcctatgctgtttagtggaccatatcccgaatgtttttcatttcacattttctatgcagagcatatactagtattagaataggctgaatagctatcgtaaggaaatagatgtgaaaatgatacagaaatatcatatggtgattctgtaaatggtattgtcctgtagacactccatgtctccatggcagcggagtacacaaacataaaagcaacggtagtacattacaagtaacaggtgaataaaatgagcatgtaaattagaaaaaaaaatccattttactcgcccaaactaattcaatagaccatttatcctctcaactattttttggctcattttatatatcccc

SEQ ID NO: 50699 - DNA, 1501 bp, Oryza sativa
tgaaacgttttcacttcctgtgtttggcgtaaagctaggtatatttataagtgacactctgagattacaaatgtgtgcactcaattctgaaactgcatgcttgttccaaccggatttcccagctcaattcaactttcaaccgtttgatctgaaatggatagttgcaaccgaactccataagattgacctgcagtcatctatgtaatccattcatccccagtttcaaagtcattgcaaagatcaggtaaaccttgtaacggaggaatcccaagatgaagatatcaaatctttgagatactctagcctatggttggatctttaggtaacaagaaatttacaggagaaatcacttgtacgactagcacgatctcttggcagattagtacgaagcatctgatgatatattataatggctttacgatcggtgataattcttaggatgcattttatatgtgcattagtcaacgtctggaatgattcttagcgatcatgagctgcgtttaaatagtcctttgataaattttttttcaaggatttgaaagccatctgcttgtgacgtacctactggctactgagatacgaatcgcattacagggtcaatgcgaacatgatctgagaggtatagtgcgttccatgtatacttatgcatcctcagatcagagagtttttctattggtgtattgcacgttagctcagcgtacacaattgtgcaaacaaaacataatcacctttctaattattttcgtctgcatcactgcaaagacgtttgagattttcagtacggaatccgttcttgaaaggaaatggtatcttgttcttgacttgtaaatgttaagaactttcggcgtttgacttgagcaagtggtggtatcttacttgtttactccgaggagcttagagcgcgcgcgtctcacttctaggacaggaaacatcgtcgtgcgaagcgctcaaccgcctgcaactaaaatcatatgaactgtaagcaaaagagttcaacaatatacagccttgcaagagaaaagcatgaaaatccttaaaaatcaacaccaataatcggaagatatctgccgtccacacccaaagtgtctgccgtctccatttaacaattcatgatatgcatatcacatttgtcattttcttatgttttttgttttaaattaataccatgcatattgcatagtctcctcctaactactccagtaaaatttaattagtggagatattaggattgcacttggtcatcatttgtcaagtatggccacaaacatttccaatttccatcagatttatggatgtggcatggcatacatatctcgaaaaatactacataatactatatactatgttttagaaaatggaaatgttttgcacgtcacttgaaaaagtccaatttacaggtcacatcaagcttccatgagaccatgaccttctcaccactaattgcaagcatctcttacctttgactattgacttgcacacttgccagcccatatgcccctac

SEQ ID NO: 50700 - DNA, 1501 bp, Oryza sativa
atggtgacggcggttcgactgaagctgcggaattgggtgaattgggtgggaacgagagaggagaggggagatggtaatatgcgctgtttgagatattgggtacaccggttttgcaagttgagagactcgttatatccagtattacgatttcaaggacgacatttcaaactcggagacaagataagggatttaaaatgaacttattccagctccaaatgtacagagcggccgggcgttagcccagatcaccacgagtccagcagtccaaatgacattggtactagttcgctaccagcaccgcttgcacagttggacaccggcatcacaagcctaaaaaaatactccagatacaggtaatagtcaagcatcacaaaattccaatttctaagtagtgctttgctgcccacttgagtcttgaccgacctacatagatgacaaaatttccggaaaaaagatacacacgacgataatagataagaaaaacatattctgtggcaagcaaccaaagagcttactaacatacaatcagagaccgtaaatgtttataactttactcactgaagatttaaaagacgacgcaggttgcacagggatcatcgaaataaaatggcgagtcactactcactaatgacttgtagccaggtgattctgccaaagcaaccagttccaaccattcaaaagtgcacacagaattttcaccgatttttttaattctgagcaaaataagaaatatatttttttatgtaagcaccacagccatctaattctattaataagcaggacgttctgattcaagaagcgtccatctgtttgatagggacgctgtcatttggcagcgactaatttggacgcaaggtttttactgcgttcctggacagaacttggacgccaaaacttaacagcggcctccgccgagcaactgcacgcccgcaacatagaaaagaaatacagatctacgcattggttagtgtctttctttctatccctaaccttcccttactgcagaagtcatgccctagtcttatatcagatgagattagagtttaagcagagatcacgagtaagattatttgcaaggtatgtttacttttcgttgtttggaattgattagacattagtactagtcaagtagcatatctctccgagttctggccagatggttcttgtaatctcatctcacattttgtgaatgaggctgtagctgagtaatatatcagttttttccccgtaaaaaaaactagcagatctgttgtatcattttattcttctatcatggaaaggttgcggcactgctaatcgaaagtatgagtaaattactgcatgaaatgattatatcatcattagctatgtgctccacgttagtagtgctctgtgccatgtatatactaaatattctgatcatgaataaatcgaatatggaaattgatatatatttttcttttctttattactattaggtcatcagaccatgataattgttcttgtatacactggaggtgaa

SEQ ID NO: 50701 - DNA, 401 bp, Oryza sativa
aggtaatgacactttatccctgtctatgtatgacattgcttctctccccccacaatacaacttctgtctccctctattaacaaattccccattgaaatggaacctaactgctagagtgccgaagggatccatgctgccagctctgaaaaattaaaaaaagaagcactttactactctactattaaaactacactacatccagatccctaatacctagttaacacctaacaccgattaaaaaaggaccaccccaacactaacccacccagattcacatgggtatacaaaagcattactacacctaaagcatatgggacaatatactacttgacctctacaccgaatcccaaacaaaaaacgaatctaccacattttaaatcttcccccaaaatcaacacagt

SEQ ID NO: 50702 - DNA, 383 bp, Oryza sativa
cggcgaagcccatcacgcggcgccggtccgacggctgcctctccgcgcgggacggcggctcctgtggaaagccaccccgccgtcgtcgccgtcggtgcgtcgtgttcgatccttgccggcccggcacgccggctgcgacgatgtctccctcgtcgagaagtttcgaaacgccatggctaaacgtgatctccccaccgccgccgtgcccccgacgacgccgccgccggcggcggcagcggttgcggcagcgccggtggataaaggccgcaccgacgacggcggcggcaaggaccgcgacgacgcgaccaagaaccaggagagcagcaaggaggtcgccgtcgtcgcggcgcccaaggatgccgcccccgcgtcgaacacccaga

SEQ ID NO: 50703 - DNA, 1501 bp, Oryza sativa
ccatataccaagtcttatatggaattatacttcgtatatagaaggagatctggataaggcatggcaaaaaagagttctacatggaaactataaagactactcggattgtatccatattggtctccttagttctacttgaatagggggacatatatgggtataaatacaagaccccctagggaggggaagacaagtccagacaaatcaagaagctcagttagaatagacacaaatacacaccgccagacatcgacatcaaagatcagcctaaacaaacccaatctggtgcgatcagtggccaacaaaagggatctagcgctatctccgatctcgtcgagtatgtattcgaggaggaagactaccccatcatcgactacgagttggtgttccatgccgccaagtcaacgatgactagataagttatcccaaatattgtacttgtttgattatgatgaataagagcaataccggctccggtcaataggagtagggttattaccttccggtgaaggagcccgaacttatataaaaatcatttgtctctatcacttttaccttaatctcgcatataccatggtaccaacaatccccataccatgcaaatactgtaattgtgatctaaaacgtcaacaacactgattgtatttagcttattttggattgtaagtactacttcagtgaaatccagaagcaagtaaaacacttgtttctcttagctagaagaacatctccggtccacctccaccatcaccggcaacagcttgcacctgcggcacaaggtgacaaagaagagacgccatggatggatggcgagctcagctcagctctgaatgggggaaatggcgaaagaatgtggtatgtagtgaccttttcttgagcttggagaaaaaatggtcggcgtggaggaggtcgtatgatctagggtaggtgctgaaggactcgcaccagtcatggtacatgccgaacagccctcgctcgtagatgatcggcagcgtgtccggcgagtccaccgacaccacgttcatcacccacacattcatgtccttcaacgctgccgcgaacctgatcaaggaagaagatgacaatgccattgatgcgatgcgagatgagatgtttggatgagagtggattttaaactgtcgagggaatgtccccttatttactttttttcttataaattcaatgcaaatagttgtaaaacattataaattttttttgataataatatagaatataacaacatctatcagtacataaaaatcaagttaaatgcaacctacagataaaaaattcgggtgtaatatctcgatgagtgagctgagtttggatttaaaattttgtgaagtgatatatctatatatcctgtatgggtgttgtcaaaaaaattttaagatttttttttataatcgtttgaatggttttttaaaataaactggagggatcaagatagtttccaatcgtgtagtggtgtcgtacccgccgtagacggctagcttgtcca

SEQ ID NO: 50704 - DNA, 216 bp, Oryza sativa
ataaggtcggactatccgatacgtcggactatctgaaatttctcagaacttcactctctgttttgaattgctttttattccttttgagtgagttttaaatcagactatccgatatgatcggagtatctaatgatccagagactaagaaattcaatggaacttgagtctctgtgagaggatgaaattcttggttcaaaaataacggaatatccgata

SEQ ID NO: 50705 - DNA, 1501 bp, Oryza sativa
aaggtaggatgcacaattttctatattaatactaagcattatagcagtaatagaacttatgcaagtctgcatacatattcaggaaatcaaagaacgccgagatgaggatcttctagttctccctactgatgctgtgctctttgaggactcatcattcaaggttagtgaagttgctcatcagctagtgttgtaaagaattgcaaatcaaaagtgatgctctaaatttttttctttttttgcttgcttgtcatgcctgaagatccatgctgaaaagtatgctgaggatcaggatgcatttttcgaagactatgctgaagctcatgccaaactgagcaatcttggggcaaagtttgatcctccaaaggtaaatgagattaaagacttcctcacttccattattggaatggagaaaatgtccagtcaacttgacttgcttattatcgctgaaatggcacagggtatttcacttgaatagctggcgtcagctgccgatgaactgcattttggcgagtgataaacaagataataccttgtttgttcttgctactatagagcatattctggttttactacccatccagaaatttaacttattgtaaatgtgatgctggtgctgtgtattgagctgtgttactgcttgccatcttatctattgtactatattataaagatagctcgaaaaagagcaaccaaatttgttcaggtcaacaattagatgcatcacaacctcagttagataatactaggtttttatataacgaagatagtaatgtgaattgtgagttcctacattatttctaacatacttatttagcattaagatcaaactatagttgcgagttgtgagttgtgacacccaacatgctagcacgggttccttcggtttctcatggaggaggaagatttgtattgtacgcgaaatgagaaagctcattagtatatgattaattatcttaaaaaaattaaatattaactattataaacttgaaaaaatagatttatttgttttttaaacaacttccatatatataattatttttttaaaagaaagtaacatttaaccgtttgaaaaacgtgctaataaaaacgagaaaattgaagtttgaacttaagaaaaagaagaggcctaaataactcaacctaaatactccctccttgacgccgttgacttttttaaatatgtttgaccattcgtcttattcaaaaacttctgtgaaatgtgtaaaactatatgtatacataaaaatatatttaacaataaatcaaatgacgggaaaagaattaataattacttaatttttttaaataagattaatggttaaatatttttaaaaaagtcaacggtgtcgaaaattttgggatggagggagtatgtgtcttccactcttctcccccccaatcaaacgaactagttaaagaattccaaaaaaaaaacacacacacacacacacacaaaaagagagtgaaattttgctattggtagattcctcccctgaccacg

SEQ ID NO: 50706 - DNA, 1501 bp, Oryza sativa
taaggaaagaaaatgcacaccaaagaacactccatcatttccctgtaataggattgtgatggaattgtatatgaaaagaaaaaaaaaaactgcacacggagactaatcaccagcattacaatgggcatttgaaggtgcctgtgcagttcctgttatttctatagactactgaatgaaacatcaatttgatggaacgaaaagcatgctatctagcatcccaaagaaaatattcttcttcagacttcagagatagaactaacagcaacaaaggtattgctgatcaagaatcaggactgcaatatagctgcaacaaataaagtgcagattaatcgttatccccgacaagcatgtatataggccactcaaatccatatagcaagtatgcaagcctgaatcaggggaggcaccatgcatcctagaagataagaccgaagaccaaaaaattagacaagaaggccatggtcatgataggtggaaacacaaaataaaacaaagtcttattgactacaacagagcacacaatatcaggtagtatatgatttaggtgtgtaactaacagattattttgtatcaagttggagttaaacaacacaaacccctggcacaagactaattaagaaagaattatactcttttcaaattatttggcattactataaactgtcttctcaataatatatgatatagttcactcatcaccgtcaacaactattttttgacttcaaagatgagaagttgtaggctttccacacatgcaatgtgtcaatcatcagctaaaggaaacacgagttttctctattggtttgtgggatcatgcaagtttaggggaacatcgtccacctctaacatactttattggcgatcttttttacctttttatggtcacttgataataccataaatatcaaggcaaagacaatatcttattagttatcagacacatcatggacatagattattcaaacaaatacaatccaagaaaaaaatcaaacaatttggagaaagttgaatggaataggttattttagccacttttgagaagatataaatcatgatatcatctcttcttgctagactttacacaaccttagggattccaacttttgaccaagataggtgatggaaactactgatgggtgacaaaaactgctggtaaaacaaagaacatggcttgacatgttcattagggcatagcttaaagtctgaaaggatagacacaagatcgaaacttatggtcatcgtgagagaataactataatcatatgaccagcatgaagaataactatcatagtgaaacagcattcttgtgttgaacatttagctttatctaacttcagaaacatgccaggaaaaaaggtttcggcttcaggaattcaactggccaccagcacgacaggatgaaaagaacatgtaccactactcaaaataacagctcaaaatgtaaatttataccaggcagattgtactaagatgagaaacattgcatcagacaagtgaggct

SEQ ID NO: 50707 - DNA, 1501 bp, Oryza sativa
caacagtttcatttttcttccacagttttgaagaactttaaaggtatgttaggatacatatcacccacacaattgcttggtttggtaatgcaaaatatcaaaaattgtataaattgattagtatgtgtagtgtacttataaattttgaagttttctgtagtaaagtggctcttgtcatgtaatccaattatatcaaagactatagttttatcatgtaaattataatcaataagtccagtatgatttatcatcataattaacaaaacttagttaaaaaatatgattacttaaaaacaatggtttgcttattttgtttttttctccttacttactggtgcctttgttattactcggaatcaaagaaaaagtgacacatcatgccatagcttatatatagctatacgctatttatcgttactctatgtccactcattgctcagtagtgtcctccacttaccaatcatctcgtgaaagtcatatagacaatatttgtctatttgtttagttaacataaagggcaacaccacaatgctcctttctcatccatggtcgtagagtacaaaatgatttgcccaaagcatgttcttcattaaccgtacatgtggctagaacattaactacatattatatacgtgcgggacatagggtaatttacgttctagtttcaccctgttatagaaaaagcgctttaagaacaaaatatatagaatttgttttcccgaaacgcatcatttagaaacttgggaaacgtgcaaatgaaaatccaaaatctagattgaaaggaaaaacaggaagactccactgtattataactacaattgggtaatcaaccctttgttttagcttacatagagttgcatgctgcaaaaacttaacccactggacttaattaatttccttctgcaacacacgtttaatttgttttcactttattaacaaacaatcattatccatcgataatttgatgtgtccccaccttgacaaactggtagcgttgtggtgatcgtaatcaccttatgaaatcacttagttgcctcgatctggtgcatcgcattatcgtgcgtgtagaaggcaagcgcacgcgtgtgttgtgtagaggatgagagagaggggtttttggaggctttatatatatatatatatatatgtcggtgacatgggaccgggagtatcatgactagaggcttgggcagccgcagtcacccacgtggcctgaccccctcggggggtcgagccgctcctgtttcggccccgagggctggggcgccacgaccccctgtggtattggcgccacgtgtgtgggttaggtgggcacagcggcgctcaccaaaccacatttattgcagaatggacaagcgcgccacgccgcatttaatgcagcacggcgcacacatatccggtccgttaccggtcgcagtgtgtgaccggtcacagatcggtctgatcgcgggttaggtggcagcaggcggcctgtcacacgcctcgccccgtcccgtcggaa

SEQ ID NO: 50708 - DNA, 1501 bp, Oryza sativa
tgagttgcccttaatttatacgacatatatcctatcttactataaaattatcccccactaactccttaagcttaacatgcaaagatgccacatcatcatccactaacaagataccacatcatcattcactaattaacaagatgccacatcatcatccactaacaaccatcacatttaaacatcatacaaacatgctatatctttatagtttttaatttaatttaagaacttttcaaatacaaacatgttaaattatcatccaacataattcacataatatttcaatgtatatctttattatgttttatgatatcctatatacttatatagttcatcctcacttagttagtgcttaaatgattaatctatggtccaaattatctttctcctttttttttctctaattaagtcatatcacatcaattgtttttagcctttagatgattaatctacggtccaaactatctccctacttttcttcttccataaagtcataccaccttactttttatgtttgaatcaccattctacatactatttaaatttaagttatcataaaccatattaatttacttaatctgatattatctagctattttacacgttatttttttattgttatcatactaaattcccgcagcaatgcgcggggtttcacctagttataaacaaaatataatcttacatttaaacaatattgatgcccgtgcatacacgcgggccaccttgctagttagtttaacaaagcagaagcgtaaataatatttttattatatgagcgagagaaggcccaacacactagggcgaagaacataggcatgagcggacttcaactagtaattaaataatacttagtgttctgctctgaccgattccagttaagccaatcaacacctaatcccattcggctagtttttttggaagggcgggtgatcgtggtgcgcaatcggtccacgcccgaagcgcacacgactcccgccatagctccgtcccctccgatagtgcaacttataacaaatacttcctccatcccataatatagtaacctaggactatatgggacatttcataggacaatgaatctagacatccttctatccagattcgttgtactatgaaaagtcttatccagtacaagattgctatattatagggcagatggagtatattttagattaattttaaaaaaatgtttaaaacaaaaaaaaaatcaaatgcgctaaaaatatacatgggtatagactttatacatcgaaatttatacattgtaaactttgcaagtacaaacctttttaataataaaaatatttaaattcatatatgaatttgaactggacatataaacttttgactgtaaactttaagtgtgtaaacttttggaatataaagtttggatgtggcttccctgttcctctttcctgttccttgccagatgactatcacttattggtttgtattttctagtagcctccacacccttgcgcctccttctcagccacgt

SEQ ID NO: 50709 - DNA, 1501 bp, Oryza sativa
tcggcagatgcttcttttaataatgtaagtattcaagatctctttgtggtatttaatttatttgcttgagtgagatatattctcatcgttgcgggtttgtcacttagttgaattattaagtgcttcaatactatgattttggataaagaagaaagctcttgcacgaggctagagtaataatcaataacttacgtgtggtgtctaggttagcgggtaccttcgtttgttgtgtactccacagaaaggcggcaggtggtgatagccatttatgtcctttgtatccctccacattcaggtacatcataaagccataggtcgaactcagcttggcagaccagggaaaagctaatgtccgaagcaatcgataggttttacctttaactcaagtctaaattaactcataggaatcttctttagtcttaacccaccattagttattgtccttggatagaattttgttcttagaatactctaaagtgaagtgccacggtgatatccatgcgcttaagaatttatctatgcgcttacgaatttatctatgactgtatcaaataccaacagtctcaaggaattagagaatgttgaaagcaaaaactatgcgttcatcgaaaacaaagaagactattgttgcaagaaccattgattcaacacttcggccggggaagggaaccttcctttttcttaccttctcttgaagtcctcttgatatgtttagctaagaaatgtttgttttgaaagaaataaaaaatgatttgactaaattattttttatggtttttcacttaagtatctatatctactatggtgcgacatttttgagaaaaaaaagtcaaatcttatactataagcccaacggacgggagtttgtttccttttttttattttttttgacagatgttacggaccgtttttttttcccgcacgcatagaatcggatctttttgtcgccctttccttttattttaacggactgactaatcggatcttttcttttcacggacgcatctcatctttttattttaacggacggactaatcggatcttttttttcatggacactgatgactgttttttttaccgcatcgtatataatcagattcaattttttcgccctttattttatttttacggacgacgaaagcacctctaactttttaagtagtagtagagatagagatgtgttttaatttttgaagcaatagttggctatattattaaacttcctctggagaagaaatgtggcaccacttgcctctccaacctgtgcacccccatcggcaagaaccaagctgattcacaaatcaaatcaacccatgcaaatcaatttaagttaatttggtattctgtgtttgacgaaaacaaaacaatgaacacacagaaaatagggaaaccttgtattttattaatcatgattcattaacatgaatgtttacaaaaacatgagggctcccgcaggagttagccttttgccttcgcgaggaatgcttaatagaaaactacc

SEQ ID NO: 50710 - DNA, 213 bp, Oryza sativa
ggcacgcgtcggcgtcggcgtcggccatggcaggatcggtgattcttggctgggcaggagtggagctagttttgtttctccgatatagtaggagtacaacatatatggggagtttggagcaagctaggtgtcctagaacgagtcggactcggtcggtcgattcggcagcagctcattctcccagcccgacttccatatacatctctgtctagt

SEQ ID NO: 50711 - DNA, 1501 bp, Oryza sativa
tggcacctattccatgaactctagtccccatgtgctttgaacgtacgttatcagcaatgtgaagagttctggtgtttccggggtctttagagaggattgattgtatgacactatgtcatcgcaatcagggtttaaataaaattttcccttgctcgcatagcgcgcaatatatttacccttgctcgataaatataacattttccctcctcggcataaacttgcctcatgctcgtggacttaaaaacaagaaccactatacagaggtaccactttgttaattaacataatagctaggtctgtaccaattcgagaactgcggtcatacacgttcgtttgtcacaagtacttggtaacatttatggcgactgagacagtactagccacccgaaaatcaacccattcttacgtactgtctcaatctaagtataaagcattttaatcagattgtaagcaaaataagcaaagctaaattatctgggtttctatggttgagttatgcatatataaaagagaatatttgaatagaagggctataaataaataatttataaaatataggcttaaatgagcaagaggtgaacaataacttgccttgctcgatgtcctaagattgactaatattatctagtgtgtcagaaaaatcctcaagacctagggttaaatatataaaattcaaattcaaaagggattcgaatgaagtccaaaaataggaaaaaataaaataaaatgagaaaatagtaaaaatagcctcaaaagatagagaaagattttagaagaattttggtccaagtttcactagaattggttttatatttcaaaagatatgggcttctaaagattaggatctgaattaaatctagaaattgtgaaatagtagtgtgctggggcccacctgtcagtaactttctttcccttttctttttctctccttctttccggaaatgcttatcatcatatgtccgggcaaggaaaaaaaatcggacaccccaacagagtggtaggtgcatgcagccagcatgcatgcaagtcggatagatctaaaatttaaaatttaaatgatcttttctgttgaactatttatccgaactatgaactaattataccattagatttgtgacaattaactctttataatgagatctcatatgactatgttccgatgatttttttattccaatgtttcaataagtatttattgttgtttcactgattcatttataatgttgcacgtggtctttttatatgtttcagtaaatatattttttattttttaaaaatttcaacaaaataaattattttcaaatatgttgtatcatattttttatgtttctctagttgggatctaatgtttcatgtaatggtggttattgttgcagtctgtaaattttatatagttattgttgcacgctatatttctatatgtttcagcaaataattttttatgttttaaaaattacaagtggacgtttcaatagtgatataaattttaacaaaatcaatg

SEQ ID NO: 50712 - DNA, 1501 bp, Oryza sativa
tagattttcgcattagcatagccaagctttatagtgatgttacgctccagctcattcttgaagcgaacggtctacaaatcacaaggaagacatcaggacaactatacaaatataaatatatgaattacatgtgaagaacataaatactaaatatgaaagatgttcatgaactgtacaccactacatatggaatatgtgaagcaactagtcatgaactacaatatacagaatgacattatgatggggcatattctcctctatactactttatcatatggatttccagatacaactcttctcaattctacaccctatggtgtaattttatcaatacattttaaagttctctgcaatttattcaagcatgtacaaaaaggcacacatctaagcatcatgtggtagaatatatggaaaactcacaggttaccaataaatgtgatacatagttgtcaggtatacgcagagttcagattcatcactcggaaagaagcatgataataaaatacattaataatacctgaactccagatatagccttcacaacagtggactttccatgggccacatgccctatggtacctgaaattttacagaatgaaaaagaatgtcatgccgctgcaggaagttcacaaatcagatatgcaaataatataacattacaatgtccctagttatacaacaaaaaaaccagagacaaacatctccattagttgttatcttttttttttcttttaaaaaaatcagaatgctccctcccatgcacagtatctggacaaaaaaagtaagtattgtactgaacaagtccacaagtacaaacagaagaaaggaaagttacatctacatgagcaaactaccaatagcatgcaaatgaaactccactgtggaggagttatggtactgatgaactgtaataacctaggaagcaaactactctgcaaaaagtactggaaatgtaaggttgtataaaagaacaaccatgtaggtcatttcatgatactagttaacacggccaaatgcttatgaaggggcaacctaagcattctttcagaatcatgaatcatgatatgtagtttgtacataagaaaacacacaaaataaaaaatgcagcgataagttctgtaatacttaaccatataacagtaagcattgctaaaagggttgcatcaataccgatattgatcgtcgcctggcgtgagataacttcaggtgataaagggtggagcttcgtcacgtcaagcttgcttaagtcctgcttcatcagtcctcggccagacatatttgaaactgcaaaagcaaggtcacctacggccttaataccaattgcagcaggtaaaacagaaaacacactatctccacccatgacatttgaactaactaaactacagtgtgcataattctacttgtatttcaatcggcatatacaggagctgctaaacttgccataagtttcagaaatcagaatacagacattttaaacagcaatctgtaaatccttcacaga

SEQ ID NO: 50713 - DNA, 304 bp, Oryza sativa
gacactatagaatactcaagcttgaatgatttgattggatagcaaaagccgaaaaagtgggaagaaattcgaaccgcggtgtcaacgcccttcctcactcgcttcgcacgtgcctccctcgccggcaacactccaagctcccccaccgccgccgccgtcgccgtcgccgcctcctccgccaccggcgccggcgacgatgcctcctcgcaaggccacctcctccgcaggtacgtgccccccctcctcgcctcgcacttccccctcgcggggacctcctcccgcgctgacgctggcggccaaaacc

SEQ ID NO: 50714 - DNA, 1501 bp, Oryza sativa
atgagctacgaagacgtcacgatcgctgctcgttggagaaaaagggagagaaaaaacgtaccccagcaagatcaagtcagcaaaagcgaccgagacggcatcatttgcagacaggagtgaccaaacagttgtgcaggccagaacgggggcagcgcctgcctacgctgcacacgtgctgcatcactacccccctccatcgtctcttctttcggaccatcatgtgctgtcccaaaatcctaacagcagtgcgtggatgcttgcctctgcaaatccaacctcattactatctaaaacgtccaaactcatgatcacgatactagtaccacgtttctggaccacagctgggcaaggagccaaggatggttaactggccaccctagacagatcggatgcccgtgaattttaaacaatgtaaggttgttacggtagtggagtaattctgttattcgatgcattctttgagaaatgctgatcatggtaatcagagatcggatgatccaattatgcaagattttcagcaaaactgaggtagtttaatgtaccgactgatgaagagatgctagggaaaaggaaggcagtgaccaggttttccggggcttgtggcatgcagttgtggcaaatcctgagatttgacatgaaatccaagatttctgaagcgcctactcacgctaacagaggaaagctaaatgccactgctgttcggtacactcgaagtcacaaactacagagagatgccgcactagcactacccaagagaaaatatacggaaagcgaggggcgcagaatcaaaagggagaacaggatttacctctgcaggttgtgtcgaacgaagactgactgcctgcctctctcatctttaaacccagcagttaataaaattgccaccgtttccttttccggggcccctgaattgcgcaggtcgccttcagtgacggtgctgcttcttctccctcctccgtccgtcctcaagctctgcccccgtccgtccgtcctctctcttgctttgcttctttccttgcgtggttctttctttctgtcactttgctgccatcttttgctttctcccactgttgatcaaaggaggtttgaacttgagctcagctcaggggcaaggcatcgctctccgtttcttttgctgcgtctttcctggctgcaatggctgggagctttgaggggaggagccctgcagctagaggagtcgagcaggtatgcaacatgaagcgtttttcttttgcatcttcttttaaagcattgtggtatattcatgcttatgccaatgattcttcttttgctctcctacaattccaacaatgcatctttgctaagttggatggatttgctcttcttgtttgtcttcaaggagccaataaacactgcattcttattgagaaagtattagacaccattatttcattttcaggatatagtaagctatatgcacgtcattttttttccaagatgttgagtgagcatgacatttgcttctgtggccgcccaaagt

SEQ ID NO: 50715 - DNA, 1501 bp, Oryza sativa
atatgcatgccagtgccatgaacagtgataggcgacagcttgttcaagatcaggtgtcgcagtcttcctctcccgataccaccgccgcccactacccacatgcaccatcaccagcgcgtgccaaaacatacatagagaaggtcaattgagaaggcgaagcatcaggaagaagacaacagcggattccctaactcgtaccaggcattcatttctgctaggtggatgaaggtggctggtatcctggtgatctaaatgagaaacgcccaggggttttccggctagcttcacaaggtggtgggctatacgatctgagtttaaagcctcactccttctaattatttgatattaggtcattccctaatacgtatgtcttttttttcacggcaatcagaactccgcctccttctcatgcacccgatgccttttctcctctcctcctaacccaggtctaaaacatgataaatatcaatcaagaattaagaaatcggatggagtagttatatacaaatcaatccgtaaagtgagaattatcgcgtgatccaattaaagctttcaccgagcaaccagggtgctcggcatgtacacgcacgaaccatacaagcaagtacagagaccacacaaacaaactccattttcttcaccacatgcacatgcgagggtccagccgccggtgacccacccaagtacccaaactctccatttacgggcgatgccgggccaggctgttgctgttccttcccggcaccacgggcgcggcttctgttcacgccccgtccggcacgcgtggccgtgcccgtgcccgggaaaccgcggccatcatccgtgtccctccttttccacctcattgtttgcctcctttcccatgcatgctgctgctcaaactactgtactctgcatgcaaccagggtttcccttattgttattggcgcggttatcacacccccatggtaaggtggttacgtaccgtggtaactgcgcggttaccgtgaaaactgtgtggtaaccgcgagacatatcatggttttaaaaactgaaaatgttaccatgcatagtaaccgcatgataatcgtgcggttttgtaaacccagcatgcaacccatctgaacttgtaggccttaataactcgaatgccattcgttaaaatgtggattctatgtaaagaatcaaagatgatgctaggcacagatcgagattatggttatatgaattactgatgatgcagagatcaaagatgtatcctagtagcttgttatctaataaaagaccatcaagattatgctggtgcgagttagtactaggctttgccggtagaccatggatcactactcattagaagggacccaacacgaacgcatacgcatcacgcatgcagtgcttcaaagagcgagagcgtgcagttctctgatcactccagcggtgcttcttttgacatagaattattaccgctaggacacactccaagcaaggacgcatgtcatgagctgggagaggtccctactcc

SEQ ID NO: 50716 - DNA, 1501 bp, Oryza sativa
ctaagctcctagtctgtgtgtggaaggttcgcgagaatggaaacacacaagacacgggcgatgtatacaggttcgggccgctgagaagcgtaatgccctactcctgtgttctggtggatctgtgtatgaagaagctacaaaagagctggagaaccagagagctcttactctctccctctctggtccttctggatccgaaaaatcaatcccccttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgtcggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaaagtcttgcttgtaatggttaggatgaagcctggtatatatctgaccgggaccaacgtgccatctccaggagctaacacgccggctccggctagggacgagtgattggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatgtggttaggtgagccccgctatgctcacctaccacatatacgcggcgcaaaacccacaaggggtcggggcgcctcgaccctcggggccgagacggatgcggtccgacccctcggggagacaaagagaagggcggccgtatcaccctcgggcccgacccccccccccccccgagggggttaggccacgtgggtgatcgtgtctgcctcaagtctctaagtcatgatactcccggtcccatgtcaccgacagtagcccccggcgttatgccagggcgatcgccctcctcgagggaagcggtcgggcgtgacgccacttcctaaggcctggtgacaggtggggccggtccaaaaatcgggacaagccggttcgtttttcctggagatatggtgatggcgcttcggtcggcgagcgtaattaacgcgcgcacgagatgttccatctcgactgccacggccgcatatccacctcatgcaccgcaaacgggcgaatgggattagtggaagcgtgggcgcgagaaacgagggggcaagatagtgggcgcgagaaacgaggagccgggcacagcgttggcaagggtataaagtcgccgaggaagagatttgcttccttcctctcgccattattccccttgtcttcgccgcttgcgccctaactccttgtttcctgtgccctaccttcgccacacgcgctcgctctcaaacatctcttcttccggcatca

SEQ ID NO: 50717 - DNA, 1501 bp, Oryza sativa
gcgcggcaatccgcgaggtcgtgaagggaggtgttgtggacgatgcaccacttgccggttgggcgctccctactgggagcgccggcctccttctttttgtcgctcgcaggcctcccctttcgggtggcccgcgaaacgccctcgacggcgaggacatgaccctcgtcgtcggaatgggctgacctcttcttcctcctcctgtcacgccgccctgtccgagcagcggatccgggggcggccgaagctgccacactggaaccggaggggttccaggtccatgcctcttccttacgagccactcggtccgcgtgctgaaaaagctccgcggtagtctggggctctttggaggcgatcttttcgagcatgcggttgtgccgcacacccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgatcctgtcgtcacccccggcggcctcgatcccggtcgtgtagacctggagaaactcgacggggttgacgctcccgtcatatttttcggcgatggtgggccggaaccttgggggccaatggacgttccgaaggctcgccacaaaggctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggcaccccacgcagatcttcctgggtcggaggcgttgacgaaggagtggcggccgaatggcgagcaaccgccgccgctcgccgcgcccttcgccttgacgacacggagccggtggtagcagcgccagaggttttggtggcggaggaccgcccaccagcacctaggcgctgccgtgccgtcatgaccaagttggccacgtcgtccagccaacgttgggctggagactccgggtcagggacaatgggcgggtgacgtaggagcgcgcccgcagcttggagcgcgccctggggcgtgctgccgtcgccgtagacgaggaggcgacgctccccatctcgccgcccttccccatcacccgtggatgtcgaagtcgcggatccttcgactctctcgagcgcctcctcccgcctaggactttggcgtggagggggcggtggagtacgagctcgacggcgtgggttcggctccccttcgtcaccgctaacactcggagagaggttgtgcgcctttgcttgttcagccattgggctgaacaggaaaagcttggcgcacacg

SEQ ID NO: 50718 - DNA, 1501 bp, Oryza sativa
tacaatagagaatataacaagagtgttgtacttcccatctacctatcatcgttctgaaacttctttctcatcttacctcagtcaccttcctagcctcaaccacatcttacgatttaactcaagggagatatagtcatttatcttccctactaatttatcttctgaatggtgcagtcgcctgcaaatttgtaatctatcagtcgatcccctgccgtcgattctgcattaagatatgttgcaactatcgggctggtgggaaagactttctggatatggacccaccgaaatgaaagctctcaattccttaactccttttccctcactcggctccaagttcgtcacagccagttcctaaagctcaacatgcagatgtgccacatcatcacccactaacaattattatctagagtatcttagatctcatgctaacatgacataccatttgtatttttgttgtatgtttagacctcagcatgcaaacaatgtcaaattaccatcttcacattatttttacattatttaaacatatacgtctatcacttttataatgtataacatgcatttatccatacatatcccacagcaaagcgcggggtatcaactagttttgaaaagacagtcgccgttgtttggcaactcgaggggaagggatggagagtttacacaagagaattgatgatgagattaagatgggaatttgatgtttaatatctcaatatcttgtttgcttgaggtggcggaaattgatagggagtttagttggagattaggtgattaatgaaaatgaatgggaatttgatgtttaatatctcaagatcttgtttgcttgaggtggcggaaattgatagggagtttagttggagattaggtgattaatgaaaatgaatggctaagatttgtttaggcaaagtaaaggaagaattccctcccaattaccaacccctactcatgtatcgaaaaggagagagttccttcctcaattccccattctcatccactggtggagaaactatctttcgtcggtcggccgaattccacaatagtcccggttgcaataaaaaccggggctaaagatgatctttagtcccggttaaaaagggtaacaggcatatttgatctttagtcccggttggtaacatcatctttagtcccggttcaaatgctgtcatggaagaaagaatatatagaaatttagtttatttgctaaagaaggttttataaaatagttgagaaggaaaatatagtgaaagttaatcttaaataatagaaaacaaactaaaatgaaaattaaaagaagtacaacacattaatattagtttaaaactttagaaatagtaaataagaattatttggtgtaatattttataatttttgtatgaataatgatatgtctttattgtatgactgttgaaagagtttgtaattattttataattattgtatgactgtcatttttgtacgaataattatttgtgtacgattttttttcatctcatgtaga

SEQ ID NO: 50719 - DNA, 1143 bp, Oryza sativa
tgtctttcccacgcctcgtcgcgtggtggtaaggatctctcctctcgctgccccgtcctcgtcctttcagtgtcgccccgtacccgttgtgcggttgtcaaccccggtacccgtgtaccggtgtcggtagtcgttcacgtgtgcgggtagtgaccgtgtagtgtccgtgttagtgtgcccgctcggtagccgcgtggtctccacgtgtgcagcccgtgtggtgtctagtggagtccgtttgtcggcctgtcgcctcagttgacacacggggtccgcttccgtcgacccgtggaccgtctctgtgtactcggtctaccgcggtcctttaggttgacatgtggggtccgcatgtcaacagcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcattccggaggttcccgaagcgtggttcgcggtcgtcgccgaaggtacggaaggccgttctctctgagcaaggcaagtcacatcatccttgaacatattgaatcccagtttataaaattattttgatttcaattattgcattatcgctttatttaaattcccgcgttatcactgttttatttagccatgcctatttacctttgttatgacattattattgctattgttattattaccttgttcaccctagaataaacaaaaccccaactagtggacactctattcatggttccactagtatgaatttaggtagatgcttcgctgattaattaggcaacattaggtggttttataactttagactttgggaattctcatatcatttggacactatggaatggttggctcatggtggaattggacatacccctctcttcctctttcaaagcccctaaaacctgtttttcggtggggtttgggtgcatgctagttgtgggaagtagcaccccggccctataaggattaa

SEQ ID NO: 50720 - DNA, 1315 bp, Oryza sativa
cctggtggggttcaccactatgataatacttgttccagatcagtctcaactaaggaaaggtccttcttatcgtaaaatttgtcacaatgcttcattagaagagcaatattttggtattccaaattgatgatgcctaaacctcctttgtttttgggtttgcataccatgtcccatgctgctaaggactgaggtcccacatttaaattagaagattaccttcataaattatgtctcacgcctctatcgatatgttcaataaccttttcgggtagcttaagtgagcacatatagtttgttggcatagaggagagtacatagctaaccaagcttaacctctgaccatggtttaagaacattgtaattaacgcaaggtagttttctttccactcgatcaataagaggggcaaactcagcaattctaggtttggttgttcccactgggagtcccaggtaagtgaaaggcatagaaccagttttacagccaaatgttcctgctaaaatttccttatcttccttaggaacattgatgggtatcatgtaagatttgtgatagtttattttaagacctgttgattgggcaaaagattgtaagatccctttctgacaaaagatttccttttggattgtctttttcatctacatattgaatcactggaaatttaccatctggttttgttatcggcatagtgaaaattcctttatgtgccttcttgatcattgattgaaggaggtcagcagctagcacaaacataagtggtgagatagggtccccctgcttaacccccctttggcgttgtcattgtcggagttctctcgatgatgatgatgactagccatcaccctaaactctggtaccatatgacacggatcaactgaatggagtgggatagcgggtggattggatagaactagaatctctcaaagatcactcaacaagatcaactagcaccaaaggttactctttggatttctcaactaggataattcaataacaatcatatttggtttcatttgtgtacaaacaattaaatattttcaacaaaatcttataggattatatatatgttaattgttgaaaatttgatgttttattatacgtgaaagcgaatattttgatccatggttaactgcaacattagattgttctttttttttttccatccaatcggtcgccctgattggagccctaaactctctacatgttttagtttgtcaaattttggttatcaacagttataaaaaaattccaattaagtttcaggtttatatttagggctgaatgaaaattccaaattaatttcaggtccgacagaaa

SEQ ID NO: 50721 - DNA, 1501 bp, Oryza sativa
tccaccgggagaaaagaaagcaacaaaaacacatggccagcgatttttcgtgaattttctggcgcgcgccccacacctttgtggccaggaggcgcccatttgtagcaacccgggaaaggcggccttggtttttactatcgttctatccgctccccgctcgcgcggcttccggaggcgcgacgcgcgtcggccccggacaccaccagttcggtggtggattgcggctcccctctcgggtcggtcgctagcagcggcgtggcctgacgtgtcaaaaaagcgcagcgaaagtcccaaagtcctcgcccccacccggcgatctttgcgaccggacccgtccacacgagcgcggtcggtcgttgcggccgcatgccgctccaaatctagaggctgagatatttcctcggattttcaaaaggatttttactaggaaaatactccaattcctcgatgatctgtatctgtactccgtgcaggataaggtaggagtagctagctagcaatcccgtattctgtgaggctcgataaaagagagtactgctgctcctgcttgtgttgccatacatgttgacgtggcatcacgataaggtggccctttttaatcttggggagataagatttagcccttggtgatttaggaatgttcacatgatgctcgtcatcgaaaacgaatactctttttcgtcgctactactactctactctgcaagttatcttcgcgtgtcaagtttagtgagcgggggcaattactaatggcgcattagcaacacatgacagcgaggttgccggaggagcatccccagccacaagaacgagcggcttcccgaattcccccaccggattatttatttttcttttcgcgcgaggaaggtatagggggaaaaaaataaagaaaaaggagaaaaagagacggggaaaaaacgcagccaaaagaaaagagaagagggaaaaaaaacgagggaaaaagtttggcggaaaaaatcgagtcctacgtggcgcgtctcgccatgctctttttctcccgtcccctcctccctcctcctagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccggtaaattgagtttgatctttccgtttcttttcttggcgagatcgtttttgaatgaactttgtttttcggattaaatgatgttactgggaactgaccgtgtgctgttttttcccctctttttgtggccgttctgtgctattcagggaaacgccatggcaaccgacgaaaacggtgccgacgatcgcgccggcggcgagagcaccgtggatcatctcaggagccatatgaactacg

SEQ ID NO: 50722 - DNA, 1501 bp, Oryza sativa
taattgcgtcaaatcggtcgctggtgattggcacaatggcacgtactaggagtacgtcttgctgagttcctgtcatgtgacagggttctgtgcaactcggtgttgttgtgatgccattagatggagaatttaggacgtaatgcctacgtgcattgcaccatttactttctgtaagtgcatgcacctcggcggaacctttatgagaggttctctctttggaacatgcaagagtgaattagtggacaataatgccaacattggttaatttagttagtccatgtagctcggacacatgccgcatccatggctgatggctccaccgctccatgtatcaaattggcttttcgtgcatgcgatgagttgctagtctcctcaactctctcgctcttagaaggattatattgcaattgtacgtttgtatccattggatgcatacacgcgcaggtgaaactttttttttttgaaattttgagcagatgaaagtgaagaacagcatgcaatgcaggggctgatccgtgatctttgtacggagttgtcaaaatgcgcctcaaagctgtccttggattatacacagatacacttactagctgtgtccacgcataaatacatacgatggcctacgcggctgtccatgtcctaccatcttaggttcacaatattgatctgttagccatgtaggagtaagactctgtttggtttccaggacttattccaagtctctgtcacatcggatgtttggatactaatttagagtattaaacatatactaattacaaaatccattccataagcttggactaattcgcgagacgaatcttttaagtctaattacgccatgattttgacaatgtgatgctacagtaaacttttgataattatggattaattaggcttaaaaaatcgtctcgcggattagctctcatttatgaaattagtttttttattagtctatgtttaatactctaaattagcgttcaaacatccgatgtgacatgggctaaaaagttttagtcccatctaaacacttcccgaggagtagggacctctcccagctcatgacatgcgtccttgcttggagtgtgtcctagcggtaataattctatgtcaaaagaagcaccgctggagtgatcagagaactgcacgctctcgctctttgaagcactgcatgcgtgatgcgtatgcgttcgtgttgggtcccttctaatgagtagtgatccatggtctaccggcaaagcctagtactaactcgcaccagcataatcttgatggtcttttattagataacaagctactaggatacatctttgatctctgcatcatcagtaattcatataaccataatctcgatctgtgcctagcatcatctttgattctttacatagaatccacattttaacgaatggcattcgagttattaaggcctacaagttcagatgggttgcatgctgggtttacaaaaccgcacgattatcatgcggttactatgcatggtaacattttc

SEQ ID NO: 50723 - DNA, 1501 bp, Oryza sativa
atcctctttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctctgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatatagttgtacacactggtacagtggtacgtgcctacactgcctgtgctacgtactggctgccgggggtcggtgcaaccgtgggcggcgcgccaacctgtttcgaaaaagtcaccactagctcgaagcagagggaatcgatcagggtgttttttttttttgaaccatcagggtgtatcacttgcacatactccatcgtttcttcttatattaaaaaatttaccctggctatgaatataaacaaattagttttttctgataatactccactcagaattattcatccagaaactcaagcacgaaaaagacaacatacataccggacattagctctttctaaaacatatataataaacttgccaaataaaaatcaatagtttgactatgtcgagtatgagtacagattaccccctctgtctaaaaaaaataaatcaaactctaaattaggtatgattacatattacccctccgtctaaaaaaatcggtttgatttattttttttagccggagggggtaatctgtactcatacctcgacatagtcaaacttagggtttgatttttttttgacaggcagtagatgataaaacgaagaggaaagggaaggcagaagcagagcatagaggactccaggttcactgtggcactgtgccatactgtacaactgttatgcatggatcatatagttgaagttcagaacaacacgtcaagcaagtactgtaaaggcgttcacagtgcaacaccaaattttggtgagcctcacgtgtcacctagactaagaacaatattagctacttgttttcacagtgcaagttgtctatagtgggtcctactagtactaactttatcactttaccaccttttcctctccccctctctctcctcttctcctttccccacagcaagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggcc

SEQ ID NO: 50724 - DNA, 1501 bp, Oryza sativa
accgcgcgcgtgcaccgcgtctccctccccgaaccctagcgcgcgccgcgtgctcgctccgcacggtgagccgagtcgccgacaagcgggtcccacccgggaccacgcgggatggacccggcccaccggctctctctcccctccccgcccgcgcgcgcgctttgggccgccttttgggccggccggcccatttagctcggccgagccgcctcttttctctcgggccgcgccctcgccgcccgagggaagtctaattttccccctccttcttttcttttcttttctttttcaaaaaggatttaaataaatcctttttcctttagaccaaaaatccaataatcttagaaattcaatatcttcccaaccgtaaatccgtttgactccgatcaacttccaaaattcctcaaatctcgagatctatctaatggcacgcttagaggtcattaatagggctttattttctccgtttgttgagttgtcccgttttgcgtgtagtttcggagcccgaagacccgcagtgcgaggatttcgaggatcaagctcaagatctcaagcaaggcaagccacctttgaacaccttgagcctatatttgaatttaattatgttgcttgaaaaatattatgcattgataggatcgcacttaatctctttgtcccgtctgcaaggcagattggcggacctactgtcacgccccgaactagtcccgaccggaactagcccgtgacgctctaaattaacctgttaatcgataccagtccctggaaacagtgctggtatcacagggagacggaatatcacagcaacagaggtctctttattatagagtagaggtacagtcatgttggactgcggacagatcccgagctcacaactgcattacaaaagggaaacggaagccaggacttggaccaaccaatacaggcgcgacttgggaactaggccgaaaccctaaaactcatcgtagccggcttgctcctggaagaactcctcatcagcaggttccgcttcaacttcttcagcaactgggggggattatttatatagagcaagggtgagtacgggagtactcagcaagccatgggaaataagtgtttaatgcaggcttcaaagaaaggctgttgtttttacaattgattttatttgaactcctttctgaaaacaactaagtgagtgcttctcaaacgacacggatgagacagtgcgtctcgtccagtcggagtttgtgcaatgtatcagtctttagaattgatcaagattggcacccggccaacaactctcaaacggccacccgggccaacaactttcaaacggccacccgggcctagctgatcccgtcagctgcagatttttcaaacatcgaacccctttccacaacagcaatttcacaagcagtagtcaaacaaaactacgctaggaatcacctcacatccgcccatgactgtgggcacggctgttcgaacagtttaataacctctgcagagggggtacactttacccaca

SEQ ID NO: 50725 - DNA, 220 bp, Oryza sativa
ccccggggtagatgggccgagagggattcggcccatcgaccccggggaggcaaaatagacttttgcggaggaatttgatttggaaggatttggattcgggattgaactcgacgatagatcggggatttgagatccgagatggcacggacactagacaacaagcaaggaaacaaatttcgcaaatagggtttttaagagatagttttcccgctaggcgcca

SEQ ID NO: 50726 - DNA, 1501 bp, Oryza sativa
cggggcccgcggtgatgagtagtagtagcctagagggtccacgcgtcagggtcgagaaggtgccgtgggccgtggggcgtcggtcgcgtcgggccatccgtattggaggttgaacggacggtttagatcgcctgtaatttgtttgtggcggtcaaatatcatggaaagcaggagagaaggatgtgctcggtgctcccatgttttacgacaattttaaatcggtttaagccattgataagttcatgattatgacgcaactcccatcaaaccccattccgtaatcccgcactgccgcagcaataaaacggatatgaagaaaagtccattttacctcccttaactatgggctgacaaaactatgtatatagcctttcagctaccaaaatcatctcattttaccacaagtgattttgaagatgttatgtgctacatgatgcttacgtcaaatcatagtccatagttttgtttgacgtgccacattgattcgattcatctgccaagtaatttagccatgacaaaattaaaagagactcgtatatcagtaaaaaaaaacattattgccatcttatccctttctccttaaaagacccgaggtcgtaggagacggtgattgtgatggctccatgcagacaacaaggcttggggatgtgttggagctcaggctcgaccacctcgacgggagtctgtttttctcaccaacgtgctagtgccggcaacagcacaagtcattggtgacagctggtaaacccacgaagccctactttgccgcatcatcctcgcgctaggcaagcccgaaaccatcgctaacgtcttctccttcattgttctcgaataccctccatctatggagctatgaaggctatcttggtggtagggtctaatggttggagttgagaaggaagccgagataggggccaacctccacgccgtctcatcgctcgtcgcttgctgcttgctccacccgacgaagtgtggcctgctctgcactccacaaataaccccctactcttcctcgagttcatgctagtgttgctactatcacgatccaaggaggcctaccactgtagatccctccactattgagagggaagagagcaaatagaggtgtgagatggcaacaatattatcgatatgtggaccactggaccctatgggttttttccggttgaattgctaattaagcaccatgttagagcaccatgttagaagaccaagtcaagtgctacgtcaaataaaaaccactcgtaaagataaagtgagctgattttgatagttgaaggagacaatatatacctgtttttacagtagaattagattcggtccattgtcgagggaggtaagtttttcgaatgtatacagacaaccaatattccattgagtatctgtcaatttggcccggtccagtagatttcttcctcccgtcttagacacatctctccccaacaaggaaaaagtacaccgaaggtccctcaacttgtcatcgaattacaaaatcgtcctt

SEQ ID NO: 50727 - DNA, 1501 bp, Oryza sativa
taagtgtttaatgcaggcttcaaagaaaggctgttgtttttacaattgattttatttgaactcctttctgaaaacaactaagtgagtgcttctcaaacgacacggatgagacagtgcgtctcgtccagtcggagtttgtgcaatgtatcagtctttagaattgatcaagattggcacccggccaacaactctcaaacggccacccgggccaacaactttcaaacggccacccgggcctagctgatcccgtcagctgcagatttttcaaacatcgaacccctttccacaacagcaatttcacaagcagtagtcaaacaaaactacgctaggaatcacctcacatccgcccatgactgtgggcacggctgttcgaacagtttaataacctctgcagagggggtacactttacccacacgacattactaacccggatcacccagcccgtgggaatcagccacgtcgggagacctccaagctttcatgacaaggcatttccaaagccgacacaggtttaccatatgccaacgagaggggtcccagaccaacaacaggttaggtcccagaccatactgtgccaggaagcccaagggtcctccccgacaccaccccggcgaatccacatgtctctcggcatcaaggcttccctgataagctagttactcagccaggggtgtcccattccacccatgtggtcgtacttgtcttatgttcggatgaaattccaaggaaacggtccttaagtgcgagagcgggaaaccgtacacccggtacgttccccggtccacggttttggaaattcatttagttcacaagcaccgacccaggtgtcgggttttccaagacttttgtaaaacccatgttttacccaagaagtttttcagattttaagtttgaaggcgtccgtcgatactcgcacagggtgcacgaatatcgagacgcaactagatggttacaaggggacatgatataacaattatcaaatgaaggatcaaatgcaacaaattaggtaggtccgccaatctgccttgcagacgggacaacagattaagtgcgatcctatcaatgcataatatttttcaagcaacataattaaatttcaatataggctcaagatgttcaaaggtggcttgccttgctcgagatctggagcttgatcctcgaaatcctcgcactgcgggtcttcgggctccgaagctacacgcgaaacgggacaactcaacaaacggcgaaaataaagccctattaatgacccctaagcgtgccattagatagatctcgagatttgagtaattttggtagttgaacggagtctaacggattgccggttgggaagatattgattttgtaagattattggatttttggtctacaggaaaaggatttgattaaatcctttttgaaaaagaaaagaaaagaaaagaaaagagggaggggaattagacttccctcgggcggctagggcgcggcccgagagaaaaggggcggctcggccgagctaaa

SEQ ID NO: 50728 - DNA, 1501 bp, Oryza sativa
ggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaaagaaggagggggaaaattagacttccctcgggcggcgagggcgcggcccgagagaaaagaggcggctcggccgagctaaa

SEQ ID NO: 50729 - DNA, 1501 bp, Oryza sativa
tcgtggaaagctcccccctctcctccttctcaactcgcttttcgtttaagctgtcggttgggttgtcacccgatggatggttgccggccgtatgggtcagggacgaagacatcatacactgtggattctgcagcaacgtacaatctgtcttgttaattggtgtaactatctactctctccgtttcagaattaaattgcttcaagtttgactatgtttatagaaaaaaaaagtgacattttcaacccaacacaaatatcttatgaatgcatattcaattatagatttaatgaaactaacttgatattgtaaatattactatatctatatacaaacttgattaaacttgaagtaatttaactttaaccaaagtcaaaacgacttgtaataaacaggagtagacacatatactacagtacagtacgtacgtaccacgggataattcagacctttcagatggttcttaaagcgtgcaagatcaaccggagtataccccatgttatttttcacatctagcagcacccgcctgtcaatcagtaggaagaagaagatcattatgtcacaaacatggacggcctgatgcagcgcggtgttgccgtttccatcctgcatgttcatgacggcggatcgtaacccaggtgagaaacgagccaacgcgaccactgacggacacaggttgtcgacggccacatggaggaaactccggcccgtgccgtctcgcaaacccgcggaatcggggcagaattcgatcatcaacctcacggcaaataatccggctacaccgcccaatgcagcagccacatgtatcgggtatgatccctcgtcgtcaggctgatacacacaggatctgtcgtgctccagtaggagcttaaccatagcccgcatcgataaacgattggtggatgcggcgaaatggagtggagtcctccccttttcgtccccttgtttggcgaggccactgttccatccgagtatcatttctgtcggacctgaaattaatttggaattttcattcagccctaaatataaacctgaaacttaattggaatttttttataactgttgataaccaaaatttgacaaactaaaacatgtagagagtttagggctccaatcagggcgaccgattggatggaaaaaaaaaaagaacaatctaatgttgcagttaaccatggatcaaaatattcgctttcacgtataataaaacatcaaattttcaacaattaacatatatataatcctataagattttgttgaaaatatttaattgtttgtacacaaatgaaaccaaatatgattgttattgaattatcctagttgagaaatccaaagagtaacctttggtgctagttgatcttgttgagtgatctttgagagattctagttctatccaatccacccgctatcccactccattcagttgatccgtgtcatatggtaccagagtttagggtgatggctagtcatcatcatcatcgagagaactccgacaatgacaacgcc

SEQ ID NO: 50730 - DNA, 1501 bp, Oryza sativa
ttgaatatttataatatttgtgattaaattaataagttaagacctatgttaactatattttaattatagaagtgatatgctatgcatcaagacagtgatgaatttttttttcaataaatacgatatcaaatgtgctattctgtattaatctagaaacatatatgtagctaaattagatccatgataacaatgataacgatgttctacgtattttcaatgtgtctatgacgtgttttgagtctattttttcaatgtgtcaaataaccaactacagtcatcaaatttaaaagacgaaaaatgtttatatactactaaaatttgatagtataatttaagtatacaaattacttaataaaaaatgtgtctccactaaataaaacatgcaatgataccctcacggttccaatatattcttttgttgatcgtccctatcttctctgtctccctgactcttctcattgtcctccctaatagtccccaatttatcccataataaactatcataatatatatgcaattaaaaaacaccttacttttacttgtgatgatatgttttctaaagataataagtctaccttcttttcaaatgatgaggaagaatataaaaagatgatagtccaatatacagctaataggttagaaaattatgaaacaattaatgccgatgaaaaaaatgtatggagaaatcgtggcagatgttctccagttaacatttagattttataactatttcaaacttagcatacgatgcatgcccacgcgaatgcgcggactaccttcctagttacaataaaaattgtaatttttgttccttcctgtcacccaacctctctatatattggcatgtcttcgaggtcacgccgcaataagttcaattttactcccgacctccaagtggtccttaatttgaagacagatatacgacttgtgtgagtgcgactttgttgttacaaattattgtgatgtgacttaatgacttatcaactatagctatcagttgaacggccctagtttaaacataactgaacgagtataagaacgatgcgttcctgttttttcagtattttatggtgaagaatgtagccatcgatgattgatgatatatacatatatataacaagtttacttttgtcccttgtcctaaaacaggatagttgtaaacaaatcacttgttggttatcacacttatagtaatcttggattagctaaagacaccgtcagttgtataagaaaagggactgtctaattcacagagaggcagcatagagagcgctaactagctagctcaaagatgaacgcaataccagctgcgccggccaccatgaatcctaagctgctcatggctgctcgacatggagacatcgagaccctaaaacgcctcctcgccgtgaacacagcacagccaccgccacaagtcgtcctccaagtcgaccggcctgcggcggcggcgccatctgcagctgcgaacacgctcctggagggagtcaccagcgaaggggac

SEQ ID NO: 50731 - DNA, 347 bp, Oryza sativa
caaaataaaagttatagatctttatgagttatacaactttgttgttgatgactttttcagttgaaatcatttactgcttcaaaatattaaaatgttttgaaattcaaatttttaattgataaacacaaagtcacaacaaaaagtgcccaaaataatagcattaagaacacaataacatgatagagcatgattttagaaacatttaggaaaaagaatcatccaatttggagttcatatgagagagatacactagtttcaaattttatttttgcttacggctccttaagacgcccgtatggaaaaatcgatttttctatgcgggcgcttaaatgagccgcgtgcaaaaa

SEQ ID NO: 50732 - DNA, 1501 bp, Oryza sativa
cgaagatcccttaggttcttcggaggccttgtcaagacggcgtaaagggacatgaggataggtttcaacgctaggtgtcatcagagtaagggatcatcgggcgggaacactttgattgtaatgtgggcctaagaataggctttattgatactgtaaggtgtcttacaggtacggatggtattgactcatacatagaatttacgtagttggtcaatgttccaagaatttgctaacttgcgaccctcgctgtctgcaattttgaatgcgcctagccgcaagacttgtgtgatcgtgtaaggtccttcccatttgggtgagagtttgtttcgccctgcttggctttgaacccgtcggaggacgtagtcgccgatcgaaagtatgtgtgctcggatgcgcttctcttggtaacggcggagggcctgttgatagctggctgctcgaatggcaactcgttcgcgatgttcctcgagtagatttacatcgatgtttcgctgctcttcctggtcctcgtcggaatgcttatgtactcgtgtactctgatgtcgtagctcgctggggagcatggcctcggagccgtacacgaggaagaagggtgtttccttgttagacgtcgtcgatgtggtgcgtacggcccatagtactgatgggagttcttcgacccattttttgtcatgtgacatgagcctgtcgtagacgcgggttttgatcccttgtagtactataccgtttgccctctcgacttgtccgttgctttgagggtgagagaccgaggcgaagcatatcttgactcctagcccgatgcagtaatcctggatatcagcgctgatgaactgggagccgttgtcggttatgatgcggtgcggtagttcgtatctgcaaaatatccccttgatgaatttgatggcgttgtcggccttgatttcccccgtgggtactacttcgatccatttggtgaatttgtcgatcgccacgaataggaacctgtagccgccctgtcttcgtgggaatggcccgagtatatctagcccccagcacgagaacagccaagtcagagggatagtctagagcgcttgcgcgggtagctttgtgtgtttactgtggaattgacaggcttcgcatcgctggaccatgtcgcatgcatctttaagggcggttggccagaaaaacccttgttgaaaagctttcccgactaatgtccgaccggcggcatgtgacccacaaatgccttcgtgtatatcaaggaggaggtgtctgctgtcgtcggatgagacgcatttgagaagtaccccgtttggcgctttcttgtatagatcgttgccgaccatacagtagatctttgctttacgggttattttctcggcctctgtatcgtcctcgggcagctcctcgctattgatgaatttgattagtgggatgcgccagtcgtctgtggtctcgatatcggcaacggcgcattctgcctttgtggcctccgagctaatgtcgggggtgtccgagctaa

SEQ ID NO: 50733 - DNA, 157 bp, Oryza sativa
gctctctctctccgccgtcgccgccgagctccggtccgccgccgtcgtcgccccggaccacctcccacctcggcgccgcctcttcggcttcgccgtatcctcgccgacctcgtccacccctctgtttcgctcgccgaccaccggaacgccgtcgacc

SEQ ID NO: 50734 - DNA, 832 bp, Oryza sativa
aggtaatagccctaatccagttgatgtggcattatatggtggaaaacacaggttacaaagggaacaatggaacttgacagatccggcgagatcgtggtcgagttggctcgactagatccccgacgattcggctgcttgcaggctctgacttcgtaggctgtgagggttgtgttggctctgagattcgatgcctcaggtcctcccggggggtcccttttatatcgcaggtcaggcggtttacaaatagaactcggagataacagaccctatacgatacattgatgacccagtcttgtccgagtaggactcttcccatccgtagactccgtgaaggatttccttagtgtacgcaggaaatatccgtatgcgcgtgggtatgccgtaccgatatgtaatatatatcgaagggtaaagggtatgcctaacctgtaaccctgacagtagccccccgacttctgcttaaatgaactcgtgtaaccattcgcgacttcttgtgtcgagactattgtcgttcccggtgtgaggactgtagagacaggacgtagtcgagaacaccgtgtgaagcccaacggtcatgagtgaatttaaactgaagtccaaaaaactgccgcgcgtaacggacccagaaatctccggcgggcatctctcccctttccttggaattcgtactgtcggaagtgcgtctatttaaaggaattttggggatccattttgaagtccgcctattgtgaagaaaacatcccgcctgtaagcgctctgcgtcttctccgctgccacaagaaaccctagttcatcgacctgagccctttcttcggcgatctccgatcaacga

SEQ ID NO: 50735 - DNA, 1501 bp, Oryza sativa
tttcagagacaccgccacctgatgttccgcgagcggcccgatgatgtcagtcagaggaagagcctacgcttaatcaagtcacaatgtgatctcagaaggaaaacgcagaatgcctatcgagtacacttacattgatggcagcatcacgttcggccgcccttttctcacaaaggggaacggggatggtactcgccgttgtcggaccactgatcatcacctggccaacacgatgttccacggcttcactgttcaggcctatgaatcgagaaccaaattttgataaatcaagaggaacgcgaacatgagtatgtcaggataaatgcgagaaagataccccgaggagaaacccgggtcgcgtcctccggtctggaatagtcaaaggctggatgggctcgatcctggagcagctggatccgcttaccaacgaagtctgcagcgacttcataccccgacaagcctcgtactcggagatcgtcgataatgtcgataaacgactggagagagcgggtcaaagggggctttgcggtccaagacgaaatcttgtccggttgttcctcgggaacaacgaagacagggttcgaatctttgatctgaaggtagaaccacctagtccgccatttgctgcgagaagaagggcactggaaggggatataacgcgacttcaggccatcccgaagttggaacccgacgcaaccagacatgttggactccatccaacgcagctcgtagtagaagcgaaagagatcaagaaagggctctaccccaatgtaggcctcacaaagatgagaaaagatgctaagaaaggcgatagaattggggttcaaatggagaagagaaagaccgtagaagttccaaaccaagagaagaaattcggaaggcggagggagaaaaccgcagagaatatagtcttcggtcacaaccatgcgacctaagacgggctggggattagtacctcctgcttccctttccatggttccgcgaccgggatgggcgccgtcttcctgaagcttcttcagcgacgcactggtggaggatgatttgccgaggtccatcgttgatcggagatcgccgaagaaagggctcaggtcgatgaactagggtttcttgtggcagcggagaagacgcagagcgcttacaggcgggatgttttcttcacaataggcggacttcaaaatggatccccaaaattcctttaaatagacgcacttccgacagtacgaattccaaggaaaggggagagatgcccgccggagatttctgggtccgttacgcgcggcagttttttggacttcagtttaaattcactcatgaccgttgggcttcacacggtgttctcgactacgtcctgtctctacagtcctcacaccgggaacgacaatagtctcgacacaagaagtcgcgaatggttacacgagttcatttaagcagaagtcggggggctactgtcagggttacaggttaggcataccctttacccttcgatatatattacatatcggta

SEQ ID NO: 50736 - DNA, 1501 bp, Oryza sativa
ttctgttagacatgatgtgaaaaaaaaaactctatattctctatactcactccgtcccataatacagcaacctgaacatgagtgtgttcagattcgttgtactataaaatatcctatccagtcctaggttgctatattataggacgggggtagacaataaatatctaaaccattatttatacatattattatagaagaaattcagtgtcattgcgttacttgtagtaggagtatataattggatgtgtctctagaaagaaaaggaataaattgtgctcaaactcttgctctagtactgccatgtcattatactacttatctccgttcaaaataacttcatttttaaacttggatatggaaaacaaggtaagagcatcaataatctgcatgtcaacaacgatccatacacacgagaccgacatacagattatttttgatcgattagtttgtttttcacggttttttcgcagatataacataaatcttgaacatgatagcaaactattaaaccactatgtatggacctacagttgagtgattaactgtacgattatagttttgttaacttcttcccttttcacttacgatggttgtttatggatgaaaatatatcgtcataaacatattttgtcttttttttcgagcaaatgtcgaataaggggccatttgatttgtagaaagaatatataaattttagaggatttcaattctatagaaaatattttctatgaaaacatttgaaacaatggagtgaatcctatcgtatcctttgaaatttctatagaatatacaatcctatcaaaattttgaagaaaacttagcaatagcttcaacctcatggaaaattttctttgaatctatctctttcatccgatttttatatttttcctataaataatcaaacgattatttatgtatttttcatacatcttgctgttgaatttctatcataatccctgtacttttcttgttcctcccttttttttcacttctacaattcagagggaaccttacagagtgggctcgtgcactcagcatttacacttttaatagcgccaaccaggatcgtatcaacagaaaatatacagtaacaccaccgagttaatgcttgctgaaactgctgccacgccgcgatatgcacacgcagcacacgcgccgccagcgatagcagcgtagggtggcgtagtgtcgtgttcccaaagcgcaaccatttgcatcctcccaagagtaataaaccagccgctccggagtaataaacgctctctcttcacgattaaaccaaaaccggatgcatgtgcggctccctttcacggcctccccccgtcttcacctccacctaatcaatcgatccccacgcccctaatccttcctaggcggcaagcgctttaagcagccagcaaggggggcagtggtgcagaaaggcgaatcgccccaatcccacaagaggcgaggggagagaggagagcgcgcagcgggagcagcagaagccgccagccagcca

SEQ ID NO: 50737 - DNA, 1395 bp, Oryza sativa
gttgcgctgtactttactcgtgctgtcgtgcaggctcttcctcggctcctccacctcttccctggcccacgtgccagcgagagacctgccgcgcgcggtctggttcgaggttgatctatcggccgtgcgagtccggttggtcggttgcaggttgtctgcccgtgcaccgtatgggtggcggctggcgtgggcccgggcttattttcccccggtaaatttagggtttattcggtttgaaagaaaaattaatgatttgaattccgaaggtttaatttttacaagtgtcatttgatttctgagagtgaggtatagtaaaaataaaattttgcgaattaaccatgatttgataggagtttgcattattggtatttacacgtgagcatgtcagcagcccagctactgacgtttcggacgagcaacagcaaccgcaagatggtgggccgcgcaaacgggttgcaagactccgtatcccaaatactagattcattgggccggattgggccatgtaatagctaatgcatagctggcagttgtgagctggcgttgttgccgaacgagagagatatataaacaaactcctctgtatgatgaaactcatatgagaaagatcaatatatcggcggcgaaggcggcggaggtgatgcgatcttgttgatccatcgatgaaacttgtgatcttgttcgttcttgtgaggaagagtagagtgctcacaacttggtatcagagcttcgtcaatcctctttttcccttgatttggccgtgaaattcttgggcaaggattggattaccctcgggtagatccgtgaaaaggtaacttgccttgctcgagttggccgaattcggggtgaggtgagacaagatctgaagccctggagaaaccacgttttgtgacgaagtagaccgctaaaatcatggagaacgaagcaaaacttgatctccttctaaagaagatggagaaaactgagcgcaagagggaggaaggggagaagaggcaggcgtaggagatgcggttgttcaaggaggcggtggaatcttggatcccagctgtggagaagaaggtggatgtactccaatccaccgtggatctgctgcaaatgcaagtaaatcaactggagagctcttcagccaacaaaacagagcaaacaactccagcgggaaccctggactcaccaggtgttcgaccaaatggctcaaccggtctagatggccaccgcgttcaaattttgaatcgtgaggaggctgagggttttaccccaaagccaatcccggccaatggtacgtatgcgtctcacaatgtctctccaattcctttccatttggatgcttctgccatgaattcgtttcagtctgctttgtcagttggtatgactggtggggtagcccccatgacttgc

SEQ ID NO: 50738 - DNA, 1501 bp, Oryza sativa
ttcgatgacaagttgagggaccttcggtgtactttttccttgttggggagagatgtgtctaagacgggaggaagaaatctactggaccgggccaaattgacagatactcaatggaatattggttgtctgtatacattcgaaaaacttacctccctcgacaatggaccgaatctaattctactgtaaaaacaggtatatattgtctccttcaactatcaaaatcagctcactttatctttacgagtggtttttatttgacgtagcacttgacttggtcttctaacatggtgctctaacatggtgcttaattagcaattcaaccggaaaaaacccatagggtccagtggtccacatatcgataatattgttgccatctcacacctctatttgctctcttccctctcaatagtggagggatctacagtggtaggcctccttggatcgtgatagtagcaacactagcatgaactcgaggaagagtagggggttatttgtggagtgcagagcaggccacacttcgtcgggtggagcaagcagcaagcgacgagcgatgagacggcgtggaggttggcccctatctcggcttccttctcaactccaaccattagaccctaccaccaagatagccttcatagctccatagatggagggtattcgagaacaatgaaggagaagacgttagcgatggtttcgggcttgcctagcgcgaggatgatgcggcaaagtagggcttcgtgggtttaccagctgtcaccaatgacttgtgctgttgccggcactagcacgttggtgagaaaaacagactcccgtcgaggtggtcgagcctgagctccaacacatccccaagccttgttgtctgcatggagccatcacaatcaccgtctcctacgacctcgggtcttttaaggagaaagggataagatggcaataatgtttttttttactgatatacgagtctcttttaattttgtcatggctaaattacttggcagatgaatcgaatcaatgtggcacgtcaaacaaaactatggactatgatttgacgtaagcatcatgtagcacataacatcttcaaaatcacttgtggtaaaatgagatgattttggtagctgaaaggctatatacatagttttgtcagcccatagttaagggaggtaaaatggacttttcttcatatccgttttattgctgcggcagtgcgggattacggaatggggtttgatgggagttgcgtcataatcatgaacttatcaatggcttaaaccgatttaaaattgtcgtaaaacatgggagcaccgagcacatccttctctcctgctttccatgatatttgaccgccacaaacaaattacaggcgatctaaaccgtccgttcaacctccaatacggatggcccgacgcgaccgacgccccacggcccacggcaccttctcgaccctgacgcgtggaccctctaggctactactactcatcaccgcgggccccgcgaaccagccccacac

SEQ ID NO: 50739 - DNA, 899 bp, Oryza sativa
cgggggagatgggccgagagggattcggcccatcgaccccggggaggcaaaatagacttttgcggaggaatttgatttggaaggatttggattcgggattgaactcgacgatagatcggggatttgagatccgagatggcacggacactagacaacaagcaaggaaacaaatttcgcaaatagggtttttaagagatagttttcccgctaggcgccacgacggaacgggcgctacacctacctagcttgttgcatttgatccttcctctgttaattgttataccatgttcccttgtaaccacccagttgcgcctcggaaatcgtgcactctgcacgagtatcaacggtcgtcttcaaacttaaaatctgaaaaacatcttgggtaaaacatgggttttacaaaagacttggaaaacccgacacctgggtcggtgcttgcgaactaaatgaattttccaaaaccgcggaccagggaacgtaccgggtgtacggtttcccgctcttgcacttaaggaccgtttccttggaatttcatccgaacataagacaagtacgaccacatgggtggaatgggacacccctggctgagtaactagcttatcaggggagccttgatgccgagagacatgtggattcgtcggggtggtgtcggggaggacccctgggcttcctagcacagtatggtctgggacctaacctgttgtcggtctgggacccctctcgtcggcatatggtaaacctgtgtcggctttcgaaatgccttgtcatgaaagcttggaggtctcccgacgtggctgatccccacgggttgggtgatccgggttagtaatgtcgtgtgggtaaagtgtaccccctctgcagaggttaacaaactgttcgaacagccgtgcccacggtca

SEQ ID NO: 50740 - DNA, 688 bp, Oryza sativa
cctcaaacgtcgacaatatcattttttttgtttcatgatatgtactgataaaccctcatgtttcattatttgtttttttttttactcctagctcgattgtcccaaaaaaatatatagaaaattacttaataattctcgcagcaaagcacgggaaatcacctaattttcttaataatcatgtctaacccaaaacttcttatattctgagacggaggtagtatttatttgctaataagctggtagcttatactcggcataggaccaaccgacgagggctaaactatggcatcatctctgtgacttgagaggtttagggttgatgatgacagaccctggtttcgcgcgaattggtgcagtttttgcatcttggtgtacatggagtgagtcgaatgcatcgattggttaacaaagatggtgaaaaccacgtgagatcaaaaggggatatataataaactcagtttccgttgttatttttctggtggatggaacttcagaactcgcgaaacacatcgctccatctgccggtcatgtgaaatctaatctaatatagaggaagtgacaagtgaggtgtttaatggaaaaaaaaaagataacccaacccttttcttctccatttttgaatgcaaaattattgccaaaatatttaaaaaaaagaaagaaagaaagaaaaggaagtcaagcaaaaagc

SEQ ID NO: 50741 - DNA, 911 bp, Oryza sativa
attcctgcaccccattaaataacttttagaagatcggacagcaagcagtgcaaatgcaactgtatctaaaaattgtattgaataacttttagaagatcggacagcaagcagtgaaaatgcaactgtatctgagaatgacttttacaactaaacagcaagtgaaattgtcaaatgacagcatagttctagttgaaaggtactttattaatgtacagcagcattcactgcaaaagggggaattatctaccttagggagttccccaaaggttggtcctgatttatctcacacttccaacattgtgaaatcacttccctgaagatttgccaagcagcatagcatcaatgttatgagaagaagataagctaaaacttgtacagaagacgttgcatggagtgaacaagtagtaacagcaagttaacaatgcaatatcttatctaaaaatgatgtaatgagttgattgaaattgacatggactaaactaatctccgttgaagcccaccagattacaattgattcaaatatttcattgacccaccatttgtttcacaacttatggagactggtatttaggaaaaaattgaattccatcagtcttgtaccaattatggcttgggaggccaacagtatgaaatctgaagatctcatggcttatcctgaatttgcatggttggcactaatactaagaaatcaatcgtctgttttcttcttccgtgactgcactctgcacaggcaaaggctaaaactatcgcataatctgaattctgaaacagtttgtacgagaaattccacagttacgtcgagagagatgaaacgcagaactctcagttcatgaactattaataaatcccatcaaagcagagaagggagcaaccaatcggcctcatccaccaactctaacaccacccacagc

SEQ ID NO: 50742 - DNA, 1474 bp, Oryza sativa
tgaaaacaaaaattttttttagttgatttaaaattttggtgaaattgttgtatgaatatcattaaattttatttttatatttattaaaaaaggttgaattttcagttttcaatttttcagacaaataatcttatcttcttttttttaaacaaatgaatctttgttcatgttgagaatcaagttttttttttttaaaaaaataagctagtgtataagcaagcgagtgggataatatagtcattttgaaaaaaaaaaatcaatgactagttcacattgaactatgtaagattgagatctttccccagttttcccaactcatcttccttgtttttcgtccgcatgctttttaaattgataaatggtacgtttttttaaaaaagtttatatacaaaaattgctttaaaaaaatcatattgatccatttttaaagaaaataattagctaatacttaattaatcacgcgttaatggatcgttccgttttccatgcgtaggagatgagtttctaacccaaatcaatgaacacagcctaagaggtcaaataaattgatggtaaactcagggatatataaagaatttcttcttttaaagaagcgtaaacctcatttagattgagtgcgtgtagaatctttttcctgagttcctacaagaaataatattgtactcctacgtatcgaagtcatgcgaaactcatgcatggccttttcacgtttttcttgttaagaaaccccaaacaacaagcttctaaattaaaacgagcatcgcatgggctgtgtaatttggtcgcatgattgttatgttgggcattaatattttcagcgtttaaagaaattaacttgacaagctaatcactttcaaaactaacgatatactaaatcagagaagtagagagcgtaccacaaatgaggataggcatgcatgattgaagatttgaagagcacatgagaattatacttcgcttatttcagcataactaaaacttattattattattattattattattattattattattattattattattattattattattattattattattattattatataaccaatatctttgtctcgctggcaatacgattccaagctgtgtgtatttttcacatcagtttttttacacatattgtaacaaacctaaaacctttgtgtatttttcacatcctaattcacgctgacaacaaatcgacaaccaaatttaatttatagtgtcattgtccaggttcatcagtagaaaacaaatctcgccaaaccttgcaaataaaaaaacaaaaaaaaaagaaacaaagtactcatccggatataattataattaactcggcaatttggttcgacgacgtgatgaaaaagccgcggcgggcgcgggcgtgcgcagctacgcggcgtgggtgcgggggttaaacaagggaaggggtttttggcgtcactcgcttctctctctcccctacgcgccgccggcgaga

SEQ ID NO: 50743 - DNA, 193 bp, Oryza sativa
ctgtccgatcttctaaaagttatttaatacattgttcctggaacatgtttttcagtctagtctgggacggagggagcagtaattaacttctgaagtcttgtgttatcatctgcattatgttctaggagtatatgataacgatatttcttcatcagttaatattccttttatcttgttactgtcttattcagga

SEQ ID NO: 50744 - DNA, 553 bp, Oryza sativa
aaagtcatatagaaaaatgaccaatacaaaagttgtagatcttgataagttatataacttggttgttgataacttttccatttgaaatcatttactatccgaaaaattatttgaatttaaaatttaaattttatatagttcaatcaaactcggatggagaaataaccaaaagaaaattggtagatctcaacgacttctacaactttgtttttaacaaccttttcatatgagttcatttaatatcatataatttgattcgaagttcttatatttttaaattaattttttaatgactattttcgcatgcggcccacttaaggaactgcatgcaaaaatctatttacgcatgcggctccttaggtggtctgcatgcaaaaatatcaccccaaccttttcatctccctccactctcttttccctcccaccacttcaaatattttctaactatctcccctctctctcccctctattcttttaccctgccctctctctctttttctcctatcctctcctctctttctttcttttctcctctccctctccctctccgaga

SEQ ID NO: 50745 - DNA, 1501 bp, Oryza sativa
taattcccccccccccccaaagatagattaaaatgcagttcatcagcgaactttgcaaaccagagtttttggctagtccattaataagtacaaatgtacaatacaattttcttgatctcgcaacgagttcacacaaatcttccttcggaacagagcatgtcaaccatgaattttcggtgagtcggtttagtgaaccaatggatgacacctgctagacatgcacaacagtgacactgtgacagtgatgccacaaacgcgcagtcatcacacccatgtagcagaggtagatgtgttcatccaccatggcatatctggatttttcacattttagtccttttaaaaaacttatcctccaaataaactcctaaaaaaacttattctataaatgattcttttcgcggcgccaatgtcgttggcgccgtgattcaacatgacgacgccaatgacgttggcgccgtcccccccccacccctggatgaaagttaagtcacaaagaagaccagtttgtaaatttttttaaaaggacttatttgtaataaaaaaggacccatttgtaaaaaaataaagtgaattgcatgttggtcttgttattatgaccaaagtttcaatttggaccatggcacatcccaacattttcagtttaaaccagagtcttttaccttggattgcagattagaccaccctatccatttccacatcccgttgtttccactcagccactgcttgctcctaaatcaagttgctgcctgctgccgatcgtctacttcggcactgacattgggtcaagccagcagatgagcacaacaccattaacctgaggtattgagagccgcggggaatggcgttgaagagatgagctctatctatgttgcccctaagcttgagctcgagctccatcagtggccacctttgccagctgcgtgcttgagctctacctccaccttccatgccccatgctcgagctccacttgcaccgctgtggcgcctcaacagccctgccctgaagctactcttttttctcccatgtgttgtgctcattgctcttgcaacaatagtggtagcaggatccggtctagtgcttgatctagtcatcaagctcctaatctagatgcttaagatcgagaaaaacaacagatgggcaactagactgcaaggcagactggaaacggaaagtggagggagcgatagtggggatgggaatgaccggtctggaggaggaagagagaaggggaagagggagagacaccaggtatagctgacatgtgggcctctagaccaaattgcatgctcaagtaactatgtctggttgaaagtgaaaatggttgataacacctagttcattgtgaaacatgggtaagaaaacatagtccaacatgcaattcactcaaaaaaatatttacaaatagatcctcggcgccagcgtcattggcactgaggacctatttgtaaatattttttatttataaataggtcccttttcaaaaaattacaatttagtcct

SEQ ID NO: 50746 - DNA, 1501 bp, Oryza sativa
gtactcagcaagccatgggaaataagtgtttaatgcaggcttcaaagaaaggctgttgtttttacaattgattttatttgaactcctttctgaaaacaactaagtgagtgcttctcaaacgacacggatgagacagtgcgtctcgtccagtcggagtttgtgcaatgtatcagtctttagaattgatcaagattggcacccggccaacaactctcaaacggccacccgggccaacaactttcaaacggccacccgggcctagctgatcccgtcagctgcagatttttcaaacatcgaacccctttccacaacagcaatttcacaagcagtagtcaaacaaaactacgctaggaatcacctcacatccgcccatgactgtgggcacggctgttcgaacagtttaataacctctgcagagggggtacactttacccacacgacattactaacccggatcacccagcccgtgggaatcagccacgtcgggagacctccaagctttcatgacaaggcatttccaaagccgacacaggtttaccatatgccaacgagaggggtcccagaccaacaacaggttaggtcccagaccatactgtgccaggaagcccaagggtcctccccgacaccaccccggcgaatccacatgtctctcggcatcaaggcttccctgataagctagttactcagccaggggtgtcccattccacccatgtggtcgtacttgtcttatgttcggatgaaattccaaggaaacggtccttaagtgcgagagcgggaaaccgtacacccggtacgttccccggtccacggttttggaaattcatttagttcacaagcaccgacccaggtgtcgggttttccaagacttttgtaaaacccatgttttacccaagaagtttttcagattttaagtttgaaggcgtccgtcgatactcgcacagggtgcacgaatatcgagacgcaactagatggttacaaggggacatgatataacaattatcaaatgaaggatcaaatgcaacaaattaggtaggtccgccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaagctacacgcgaaacgggacaactcaacaaacggcgaaaataaagccctattaatgacccctaagcgtgccattagatagatctcgagatttgaggagttttggaagttgaacggagtcaaacggatttaggttgggaagatattgaatttctaagattattggatttttggtctaaaggaaaaaggatttaattaaatcctttttgaaaaagaaaagaaaagaaaagaaaagagggagggaaaatagacttttctcgggcggctagggcgcggcccaagagaat

SEQ ID NO: 50747 - DNA, 1501 bp, Oryza sativa
ggctgttgtttttgcaattgattttatttgaactcttttctgaaaacaactaagtgagtgcttctcaaacgacacggttgagacagtgcgtctcgtccggtcggagtatgtgcaatgtatcagtctttaaaattgatcaagattggcacccggccaacagctttcaaacggccacccggaccaacaactttcaaacggccacccgggcctacaactttcaaacggccacccgggcctagctgatcccatcagctgcagattttccaaacatcgatcccctttccacaacagcaatttcacaaacagtaggcaaacaaaactacgctaggaatctcctcacatccacccatgaccgtgggcacggctgttcgaacagtttgttaacctctgcagagggggtacactttacccacacgacattactaacccggatcacccaacccgtggggatcagccacgtcgggagacctccaagctttcatgacaaggcatttcgaaagccgacacaggtttaccatatgccgacgagaggggtcccagaccgacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcgtactggtcttatgtttggatgaaattccaaggaaacggtccttaagtgcaagagcgggaaaccgtacacccggtacgtttcccggtccgcggttttggaaaattcatttagttcgcaagtaccgacccaggtgtcgggttttccaagtcttttgtaaaacccaagttttacccaagaagtttttcagattttaagtttgaaggcgaccgtcgatactctgcatagtgcacgatttccgaggcgcaactgggtggttacaagggaacatggtataacaattaacaaaggaaggatcaaatgcaacaaactaggtaggtccgccaatctgccttgcagacgggacaaacagattaagtgcgatcctatcaatgcataatatttttcaagcaacataattaaaatcaaatatagactcaagatgttcaaaggtggcttgccttgctcgagatctggagcttgatcctcgaaatcctcgcactgcgggtcttcgggctccgaaactacgcgcaaaacgggacaactcaacaaacggcaaaaataaagccctattaatgacctctaagcgtgccattagatagatctcgagatttgaggaattttggaagttgaacggagtcaaacggatttacggttgggaagatattgaatttctaagattattggatttttggtctacaggaaaaggatttaattaaatcctttttgaaaaagaaaagaaaagaaaagaaaagagggaggggaattagacttccctcgggcggctagggcgcggcccgagagaaaaggggcggctcggccgagctaaa

SEQ ID NO: 50748 - DNA, 1501 bp, Oryza sativa
tggtgtcggggaggacccttgggcttcctggcacagtatggtctgggacctaacctgttgttggtctgggacccctctcgttggcatatggtaaacctgtgtcggctttggaaatgccttgtcatgaaagcttggaggtctcccgacgtggctgattcccacgggctgggtgatccgggttagtaatgtcgtgtgggtaaagtgtaccccctctgcagaggttattaaactgttcgaacagccgtgcccacagtcatgggcggatgtgaggtgattcctagcgtagttttgtttgactactgcttgtgaaattgctgttgtggaaaggggttcgatgtttgaaaaatctgcagctgacgggatcagctaggcccgggtggccgtttgaaagttgttggcccgggtggccgtttgagagttgttggccgggtgccaatcttgatcaattctaaagactgatacattgcacaaactccgactggacgagacgcactgtctcatccgtgtcgtttgagaagcactcacttagttgttttcagaaaggagttcaaataaaatcaattgtaaaaacaacagcctttctttgaagcctgcattaaacacttatttcccatggcttgctgagtactcccgtactcacccttgctctatataaataatcccccccagttgctgaagaagttgaagcggaacctgctgatgaggagttcttccaggagcaagccggctacgatgagttttagggtttcggcctagttcccaagtcgcgcctgtattggttggtccaagtcctggcttccgtttcccttttgtaatgcagttgtgagctcgggatctgtccgcagtccaacatgactgtacctctactctataataaagagacctctgttgctgtgatattccgtctccctgtgataccagcactgtttccagggactggtatcgattaacaggttaatttagagcgtcacgggctagttccggtcgggactagttcggggcgtgacagtaggtccgccaatctgccttgcagacgggacaaagagattaagtgcgatcctatcaatgcataatatttttcaagcaacataattaaattcaaatataggctcaaggtgttcaaaggtggcttgccttgcttgagatcttgagcttgatcctcgaaatcctcgcactgcgggtcttcgggctccgaaactacacgcaaaacgggacaactcaacaaacggagaaaataaagccctattaatgacctctaagcgtgccattagatagatctcgagatttgaggaattttggaagttgatcggagtcaaacggatttacggttgggaagatattgaatttctaagattattggatttttggtctaaaggaaaaaggatttatttaaatcctttttgaaaaagaaaagaaaagaaagaaggagggggaaaattagacttccctcgggcggcgagggcgcggcccgagagaaaagaggcggctcggccgagctaaa

SEQ ID NO: 50749 - DNA, 1501 bp, Oryza sativa
ccgcaattcgccgccgtcgggcatcctccggcgaatccgagccgttggctcgtctccccttgtcctgtgcaaccacccggtgtgctcgctttcgcctgtatcgccgtggttcgctccaccgctcgccgctgtcgtccgccgtccgttccggccggcgtcgtcgtctacctcccgccggcccgcgtggcagccacgtaggcgccacgtcggcgtcagctcggccaaaaccgggtcgagtcgaccccggttagccgctccctccccgtgcgcgcggtccaccgcgagccatgaggctgcgcgtgggcccgccgcatccgcgtcctccgcgaaccgcgcgcatgcaccgcgtctctcccccatcctagcaccgcgccgcgtgctccctccgcacggtgagccgagccgctgacaagcgggtcccactcgggaccatgcgaggtgagcccggtccaccggctctctctctcctcccctcccgcgcgcgcgtgccttgggccgccttgggccggccggcccatttagctcggccgagccgccccttttctctcgggccgcgccctagccgcccgagggaagtctaattcccctccctcttttcttttcttttcttttctttttcaaaaaggatttaattaaatccttttcctgtagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgccgtttgttgagttgtcccgttttgcgcgtagtttcggagcccgaagacccgcagtgcgaggatttcgaggatcaagctccagatctcgagcaaggcaagccacctttgaacatcttgagtctatatttgattttaattatgttgcttgaaaaatattatgcattgataggatcgcacttaatctgtttgtcccgtctgcaaggcagattggcggacctacctagtttgttgcatttgatccttcctttgttaattgttataccatgttcccttgtaaccacccagttgcgcctcggaaatcgtgcactatgcagagtatcgacggtcgccttcaaacttaaaatctgaaaaacttcttgggtaaaacttgggttttacaaaagacttggaaaacccgacacctgggtcggtacttgcgaactaaatgaattttccaaaaccgcggaccgggaaacgtaccgggtgtacggtttcccgctcttgcacttaaggaccgtttccttggaatttcatccaaacataagaccagtacgaccacatgggtggaatgggacacccctggctgagtaactagcttatcaggggagccttgatgccgagagacatgtggattcaccggggtggtgtcggggaggacccctgggcttcctggcacagtatggtctgggacctaacctgttgtcggtctgggacccctctcgtcggcata

SEQ ID NO: 50750 - DNA, 1501 bp, Oryza sativa
caaccttctcgagccccaatgtatatcgagggttggagccactagggtccacggtggagacagacatcatgggaaggttgctggtggagataagctataggggattagtgactatcctacgttgacacacccaccatagtggctcagtggttgtagagcaagaaggaaatggcataagagcaatatactggaggttaagcaagatgaccattgcagtgggttgcaagtaggcatagagggcgagcgtgatgaggctcctcttgtttttgtcatcatcactagcaagtatatcgagttggaaaggaataggtcacgacaagagaagcctatggacaatttcatccgagttagcactctagcgtgtaaccgtcattcgaaagtgacaaattagtgaaacttgttttatggaatggtatctagacgatgtccacttttgacgttagcataatttcaattttaaggcaaggcgctaatacaactaaccgttgcaattagtatttgtatttaaacatattcctttttttcccgccttctttacatcgaatctatagttccattagcacaggaaaaagaattagtagagggacataaactcgtaaagtcgtaataggttttggttttgaacacgcaaaacacttacatatcaaatactatattagttgagctaagtaaacaattgaagtacacatcctgatttactcagtcaagtaaaaagtactcctatttattaaaaaacttttatagagattattctaaaacatattttcttttttttctcaaaatataaagaatcttgaatggatgggacgtatccaactaatacaaatatgaatgtgtagaatatgtcatatctattcaaaatctcttactccatccgtcccaaaatataagaacctagaatgagatggaatatttcctataactataaatctgaaaagagggggtctattttaggatgaaaaaagcattatttatgagcttaagagaaatgtgtctctaataataatttgtgacccgtaagaagagaagtaatagctggaaagctagtaaaacaaagttataaagaagttgcatgttttattttgccggagcccggaatggccgtctgatcaaaacaataaatagtcaaacggctaggcggccggcggagcagaagatcaacacctaccactttccccatacctccctcaaaacaaggacattttacagttttacgatcgcttcgccgaaaaatattagcacaagcggcccctaaaacggataaactatttgcaaaaatggccccacctcttgtgcttcctctataagacaatcccctctaaccttccactaggctcttcctctccgaccttgctccgcttcttcttttctcggtgtaagcgtgcgcgcgtttcactgtttcggtttcatctcccgctcttccattttgccgctccggcgaagtgctggaagcggagccgaggttaagccatgggaacggccgagctgaaggcctaggaga

SEQ ID NO: 50751 - DNA, 1501 bp, Oryza sativa
tctttattaactggatctccagattcagcacataacttatgattttgttcaattggtgtagaagctggccgacatccaagcatacctgtatcactgagcagatccaatacatactttcgctatgaaagaactattcctctaggagatcttgcaatttcaatacccaaaaaatattttaattggcccagatccttgacctcaaactccttgcttagattttctttcaacctagatatcttcaagcaatcatctccagtgataatcatgtcatcaacatacacaacaagaatagttttaagacctctattatggcgatagaaaactgtgtggtctccattgcactgtttataacccataccacacattgcacgtctaaaacgatcaaaccatgctcttggtgattgtttaaggccatataaagattttttcagtctcaacactttaccttcagtttgtgaggtagcaaatccaggtggaatttccatatacacctcctcttgaagatctccatgtaagaatgcattcttgacatctaactgatgcaatggccaatcaaaattagctgcacaagagataagagttcttaccgtgcttatctttgctactggtgcaaaagtttcatcataatcaattccatatgtttgactatatcccttagccacaagccttgccttgtatctttccacatttccatcaggattttgctttactgtataaacccatttacagttaaccactttcttccctttagggaatggtacaaggtcccatgttttgttcttttcaagagcctctagctcctctagcatagcttgatgccaccttgggtcttgctttgcttccctccaatcatttggaatttccactgaatttagtgatgtcacaaaggccttatatgtggatgacaaagaagcataagagacataattggctatgttattcttatcatcattcacaccttgagcttcaaaaccatacctttgtggaggtttacctgcattgcttcttaccccctttcttatagcaataggaagattagtttcttctccccctgtttcaaactcctctccttccgtatccgatgaaatctgtatagtatcacactgatcagatggtttatcccatccataggagactcatgttgccccattgtttgcgcctccaaagaccttgttttcctcctagtataaacttgtagattttcttcttcacgtggccttctccaattttgctcatgaatgggttcactaacaggatatgggattgagccaaccacaaatttcatgcttcttgattgtgtgtcttcttcagtacctgatgagccattctccccctcttgtccatcctcatcaataattggattgtcaagatcaacaaacaaggaactcaaatctgttctttctccatagaacggaacagactctctaaaagtaacatccatactaacaaaagttcgccgctcagatggactccaacatttatatcccttttgcccagaaga

SEQ ID NO: 50752 - DNA, 1501 bp, Oryza sativa
tataccgccaacatctgcataaaacccagataataaaacatccaacatagtgataggtgttaattctaacatattccacaagtgttggtgtttaattgatgcaggttataagccaccaaagttgggaggaaaatcagactaagcgaagaaggaacatatccataccagaaaggggctttagacttcattaaaatatcagagaacctgctcaaaacttgaagaaatggataaggtaggacaggaggagtccataggccaaaattgagggctagatgggccagccaaggttcggccgaaccctgatctccaagggtttggcgggacgctccagatgctctcctgatgatggttgcggggcaattcagataattcgcatcattccaaccatcatacctgccctataaaaggaactttactccttcacttcttcacacacttccaagtttgagctgaattataagaggctctattgtactattttgtatattagaattaggaagagagtagagtagaagaagtcggaggacttccagagttgtcggtaattctttcctgtttcttttattctgttaattactttgttttcaattgaaatattattctgcgtaatttagattttacttgtgagaatgacctcttgattagtttctaatcagcgtacgggattattgttcactataaccaactaaaagatggtgattactttagtgagttataaacattaaagtagatattaattgcttagacgtggtgtttaggtaattattatccagttattgttacatatcccacagtatgtttaaggtggatgtagaggtggtgacagccctcaaaagcacttaagtcctccctgtccgggtatgtagtagagcgacatctgggaacaacgggttgccagtgactgaagtatcttaggattaaaattaagatttccctagacgctgtttctcaccaggaaatcttctctgtcctttgcccaccttagcttagtgtccttgagtgaacctgacaaggaagcaattatccgttccctgtggaaatcgatacctaagaatacttccgggtgaagtgctacattagtattttccgtgtgcttgcagattctatctgtgacgttaagaaatactaacaagcatttctggcgccgttgccggggaacggttgctgattatttccgaatcttgttcatcctcgtattctttttacctttttctattctacctctacccctgctatcccagagaagtattcctattcaattcttctcgaccatggagcaacctctcttcgagctctctgcccctaggtgcgaattctatgagtcacctccttcatcggagccgatttttacagcttgctatgaaattcgccccgaactaatcagtatgattagggaaaaacctttttctggtctcgatctggaaaattcctaccatcatcagcggaacttcgagtaaatttgctcatggcatgaagcaagaaactatacggtggaagttgt

SEQ ID NO: 50753 - DNA, 450 bp, Oryza sativa
tgcgagaccatttgaagctacaagtaaccgcatcaatcatttgaagaatatatggtgaaacggtttcgacatgggcgtcccttaagaaaataaaagaaagatggaaataagacattcctattagtataattctcttcctatttatatttgagtttaggaatgccgtactattaagagggatcaacgccgaggtgtttgtgtaagtcttggtgctcaaagtgacctatcatagtgctaccttgagagaaacccaaactttaaccaatcctttgattggtttagaccttgtttttggttgaattgggtagtcctctgagtgagctttccatagagtccaagatcataaaaatgggactcccgagcgaaaagttgtgatcgttttactatgtgctttttggaaattccgaaaaaatatcggaaactccgaaaagattttggaaactccaaaaa

SEQ ID NO: 50754 - DNA, 228 bp, Oryza sativa
attcctgcagcccaatcaaacaagaattgtagtgtagccgaacaatataagataatcttaaagtacatgagggatgacgatacatgtggatgaatacataactaataattaattcaacattgggtagaagaacaactatgagttgaaataattttcaacaatttaaattagctaagaaagtgtataaatcaatttatactgctgagtaagcggccctaccggcccagc

SEQ ID NO: 50755 - DNA, 315 bp, Oryza sativa
gaccaggcgttgggaactcaagcaggcgcagtcgccctccaacttgatggcgtcattggggcctgcccggcggcagcctggaggcgaacgttgtgccgcttcactgcaccccggggccactccacctgcatcgcggagacgacgcgggagcaggagggcggcgacggcggcggagacgacgcgacatcgcgcgcctgccaactctgcgcctctaataaagccacaagccaccggaagcttgacataacaaagtcacagcaaactcagcgcaagcatagtataaccaaccaaaccaatcagccatggcgtgaaggc

SEQ ID NO: 50756 - DNA, 1501 bp, Oryza sativa
gggaaataagtgtttaatgcaggcctcaaagaaaggctggtgtttttgcaattgattttattcgaactcttttttgaaacaactaagtgagtgcttctcaaacgacacggatgagatagtgcgtctcgtccggtcggagtatgtgcaatgtatcagtcttttagaattgaaacaaggttggcacccggccaacagcttttcaacggccacccgggccaacaacttttcaaacggccacccgggcctagctgatcccatcagctacagatttttcaaacatcgaaccacttttctcaacagcaatttcacaaggcagtagtcaaacaaaactacgctaggaatcaccccacatccgcccatgaccgtgggcacggctgttcgaacagtttgttaacctctgcagagggggtacactttacccacacgacattactaacccggatcacccagcccgtggaaatcagccacgtcgggggacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctggtaaactagtttcttagccaggggtgtcccattccacccatgtggtcgtacttgtcttatgtttggatgaaattccaaggaaacggtccttaagtgcaagagcgggaaaccgtacacccggtacgttccccggtccgcggttttggaaatttcatttagttcacaagcaccgacccaggtgtcgggttttccaaatcttttgtaaaacccaagttttacccaagatgtttatcatattttaagtttgagggcgaccgtcgatactcgcacagagtgctcgagtatcgaggcgcaactggatggttacaaggggacatggtataacaattagcaatggagggatcagatgcaacaagttaggtaggtccgccaaactgtcatgcggacggaacaagcagattaagtgcgatcctatcaatgcataatatttttcaagcaacataattaaattcaaatataggctcaagatgttcaaaggtggcttgccttgctcgagatctggagcttgatcctcgaaatcctcgcactgcgggtcttcgggctccgaaactacacgcaaaacgggacaactcaacaaacggcgaaaataaagccctattaatgacctctaagcgtgccattagatagatctcgggatttgaggaattttgggagttgaacggagtcaatcggatttacggttgggaagatattgaatttctaagattattggatttttggtctaaaggaaaaggatttaattaaatcctttttggaaaagaaaagaaaagaaaagaaaggagggagggaaaacagacttttctcgggcggctagggcgcggcccgagagaaagagcggctcggc

SEQ ID NO: 50757 - DNA, 1501 bp, Oryza sativa
cgccgcactggcgcgcctggcgagcgtgtgcgtccatcgatttgttttcccctcggtgcctcggccgaagtaggggaccggccacattcgctgtagcggactagcgggggtgggatcaccacaccgtacagtggtcaatggaactacttttctctatcttaaaatattatatctaaaagataacaatattttaaaacagagagagtagcgctcaattaaacgcatttagatggaacagtaaaataaactcttattttaagactcagagcagtaaacttaggctgtctttagatggtggaaaagttaggaagttagtagaaagttgatagtttatgtgtgtaaaaaagttttcgatgtgacgtaatatgatggaaagttagaaatttgggaaactaaacacggcctcaaaatccaaatcaacgcacggaaaacacatcgcatgcgatatgcgatgtggtcgtcaagtggcttcatagcccggtcgttgcgccgttgcgctcaagtgacattgtgacaatgcaatgcaggatccaacgtctggaattggttttactcaggattgggcggcagagacgtgcggccgagggatcaagagctggtagctgaccgtaaaataaagagaccattccgacctgcagttttgttgtccacgcttttgaaaaccttgatgtacaaatgtacccataacaagtcatctgtgtctcctcttgtctgtcccaaaaataacatcattttgaacaaccattgaaattaaataaagtggggacaattccacttagttttggtaaagtgagagtattctatttttttttacttttatattgttatatgtgagattgattaaaaatgaacttattttggtacaactatactgagatataacttctacggtcttgaaaacataatacactgctataaataaataaagtaatacaatacacaaactaatgtttccgttaggaattgagcatggcttgttggaataaaagagcaacatattgccaccacactatggctgtgttcacatatgccggtttccatcccaaacaatacgtatgaaaaacggagcggttcattagcacgtaatcaattaagtattcgctattttttaaaaaatgattcaatataattttttgagcaaatttcgtgtagaaactttttttaaaaaaacgtaccggttaacagttttaaaagcgtgcgcgcgaaaaacgaagcaaatgaagttgggaacttggagttccaaacacacccatattcacatattcacatgagaacattgttggttaaataagtctctcaatattctaacttggatgtgaggttagatccaacacctaaacattgattgtgttcccctgttaatatggattttatggcaatgtgaaaatattcttaacgtcaaagtatatagtgtcgagatgttttgctttaacgctaataaaatttacgctaatgtcggattccttttacaaagtttttattcaatctttaaatagtcttc

SEQ ID NO: 50758 - DNA, 211 bp, Oryza sativa
attcctgcaccccttttagttttaagtcttctcgaagtggtaaaatatccccaagataacctactgtcattttattctttacatcgtagtggatgacattttatctaaacccagcgaatagagtggcatattatcctttttctcccacctcactgcctcccgtatcccgaatcctactaccatcctccttttcgtcctatcctctcccaga

SEQ ID NO: 50759 - DNA, 1501 bp, Oryza sativa
cgccacgataccccactcccggtcaaaggggaagagagagagagagaaagagatagatagataagggagcgaaagtgaggaggaagaagggttggagagagagagagaggggaggaaatctgcgactctacctctcagcccggcgccgctgtcgctagtggtggggatgagaggctccctgtggtcgtgtacttccatggcgagggttcgtgattgggtcggtcgcgtcatctgcgtacctccgcctcaacgatctcgtcgccacttgccccgtcatcgctgtctctatcgactatcgtcttgccccagagcactcggctaggtgctctccgctgtcgactcgtgactcggctggtcgcaacaccgctgagctactcctctacctccgctgtcgtccgaggctatcgtcgggggtggagaagggagaggggagaggggagaggtggcaccgccgagctctcgcccgcccgtcgccgtcactcttctcgtctctaacctcctcggctgcggccattgccgccagccatggggcgcgccaccactactccagcccccacccgccaccacctgcgaagcgctcgtaagtgttatggataagacatacctaatgattttgggttaggctctgcggggtccaccatataccaagtctatatggagtcatgcctcatatacggaaggtattcccaaataaggaagtagaaggagagtcctgcatggaaattataaggattactcggattgtatccataattgtctccctagttctatttggactaggggatatctgggggtataaatacaagaccccttaggaggagaggggaggctcagtcagaatagacaccaatacacaccgccagacatcgatatcagagataagcctagacatacccaatctggtgccacagaggccgacaagagggatctagcgctatgtctgatctcgccgagtttgtattcgaggatgaagactacctcgtcgttgactatgtgtggtgttccatgccgctaagtcgatgatgactagataggttatcagaaatattgtacttgtatgattttgatgaataagagtaacactggcttcgaccaactggagtagggctattatcttacggataaggggcccgaacatgtataaaatccttgtctccgtctcttttatctcaatctcgcatataccatggtaccaacgatccccatactctgtaaatatcgtggtcgcgatctactccgtcgacaacgccgccaccgtccgaggctatcgcctagggtggagaagggagaggggagagatggtgctgccgtcccgagctcttgcccgctcgccgccaccaccaccgccgatgagccttggttctgtcgaaaggagagacagaggggatagacagggaggaacaataagtgaagctgtgaagaatgattgtgggacccacatgtcagtgggtcccccaatatttttgaatgatatatggatcccacatttttttctagtttt

SEQ ID NO: 50760 - DNA, 1501 bp, Oryza sativa
atccatcagagcatcttctatgccatggttagttacctgagaacacaattgcagatatagaatataagccacgacatcatgttatttaaagaagccaaggcagttcaacaaaaatctatcaaaggtacactgactacttattaccatgaaaaggccccaagactccatcgcctgccggagtttcaccgcctcattggcatcaccatctggttgggacaggcgaccaaggtcaacaatggggaatgatgcagtggctgcaatggtcggttggtcttcttgttgcacaatgtactgtcttggcacagatttgcttctcatgccggcaagctcctgcacaagtagtgttgatctcacatcctccatgctcccttccatacggatgtagctcaggtactgtctcaggacttaggttgttcaatgctgttgagttgatacggagaagttactatatatgagtctgagaccatgtacgaaaaaagagtaaaaatactgccattgttgcacaagtggtcatgtaatgaaaacaatttatacctggtataaaaaaatgctgtaagttgcaaccaaattgctgaattaaccaaaaaaaaaaggcaatttgacatttatggagcagagttaggaactgcccaatagtggctgacaattaagatttaaattcaagctcaacatctgattccctaacttcaatataagcacctagagcgcagctgtgtactagcctggagttggcaggctgtttgttctatccttaggtagttgggctaatttctggtggcacagcaaccttgtttgtttatttattacttgtaacctctccttggtcttaatttgggcggcatacttttgccggacaatgaaaaatataagcacctagaagaataaagattcaatataccatgtgaatcagaaaaccactccatgtgttacacaacatacaacatgccaacttcaacttgagaggttgagcaaccgatgatgcacagcacaggcccttaaatttaagcttgtgataacgtcctttccagaataacttaacatcttgaaggagcatattaactgaacctggcaatatcgcttcttttttatttggaagtggcgtatttcacatcaaattctatgacatcttgtttctttttaatttgaaagtggtgtacttcatgacaatattgtttcttttttatttgaaagtggtatagttcatggcaatcttgttcatcttctactactttgaaagtggcatgcttcatatcaaattctatgcaaggaaccctaataccgtgtgctgttttttttttaaaaaaaaacgaacgattcttgttcctacgggatttttcttcctgttttttggattgcacaaaatcaatcctgaaaacattgcacattcgcacagtactaatcccaaataaatttcccccaaacttttcaaagaacaaaaaatttaaccgaagctgctttggcacaaacctatccgccccgattccctatctgcgtaagaaga

SEQ ID NO: 50761 - DNA, 1501 bp, Oryza sativa
atcagcaatagctattagaaaaaaaaatgaagctgcattccaaccaaatgttatcagggcgcacacattttatcgccgtaaactggaaactaaaagagcaagaacagcgaacctctcggcatccatgagccacggaaggtgttcctcttgagccgggaaccaaaaccagtgtaaactccaataacagcaaggagcttcttcttgtcagaactaccagtagcagttccattcccccacagatacccctcgctcttcgcctttgtaaggtccatttctgcctccgcaatcttcctcccaattccactgccaccaaacaacccatttcaaatcagcaactaaaattctgaattctgaattcctcttcagagagagagaggggggaattacatgcatcctagattcctcagcttgtcctccaccgacagcaccttcggaagctgcaatttaggcgataccatcacacgaactgacaaatcaagcggaaaaaaaaaacgagaagtgggtggagagggggagagatccgcacattgccggagctcttctcgaggagaccagacaggatcatccgcgtctgcgcgtcctgccacagcctgcaaaaaaaaaatccaatcaacgaaacaatcagaaaactccacggaaattccccccggatctgagcgcgcgggcgcgcgtacgtaccggccggcgacgtagagccacgcgaggcaggagaggaaggccatgacgagggggaccctccccgaggagagggcggcggaggcggaggcggaggaggaggaggggggcttgaagcggcggttctcccgccgcatggcgctcgccagcgtctccatggcgatctggtggcgatctcctcctccctaccagccgccgctgccgctggtagagaagaaaagcttcggacacactgcagctcgcctccaccactcgtaggccgacaagaagacgacgaattcggcccaaattcaactccatttttgcgaaggagataaaaacgggccgaattcagccccaaatcccacgccatacgcaaaattgggccgaaatcagagaaaattggagtaagtctaatttgtctccctgtcatgcttttgagtgaatcaccctcctcaaccgcaaaaccgggtataatgtctccgcttcaaaagccggtgcacatcaacataaaccacttcctaaacccccaaaatagtcaatttgcactggttttcgaagatgggagagacgttatcagacaaaaatagacttatccgcaaaagaatcgacttgcactggtttagatggaatagatgttatatccggttttgtagtcaaaaggacaaaatagacttattgtcaaaattctacgctgttcgctaatttgggccgaattaagccgaagcctgcgccgtttgggctagcccgttgaggcccaactcgccgaatgccctacgaaaccaaccacacgaagcccgcgagttttccgtcaccttctcagttcactcgacctcgccgccggcaa

SEQ ID NO: 50762 - DNA, 1501 bp, Oryza sativa
gttattaacatcagtattttctgagtgctggacttctggtagttttctgatgatttaatttatggtttttgtaatgtaggttggtgcagaaggttctgtctccatagaaggtatgaaatattgcaatttcccgttccctcaactaacagactctttggaaggcttcatatcttcttgtaccatctcatataaaatgtcaagaatgttagttaccttttacttttaattctgaattttctctccttcgatgtatgagcagaatgcccacagaaatgcgactaccgttgctcggcaacaaagcgccaggaaccatgcctcaagtactgcaatatctgctgccagaaatgcttgtgcgttccatccggcacgtccgggaacaaggaagagtgcccatgctacaacaatttgaagagcagccagggcaattccaagtgcccatgatgtagcagttaatcttagtttttaccacgtagagtgtacataatgacgtcccaggaatgaataaaattgctgaaatatgtggccattacaaagccaacatatcactattggactacagaagtgtgaaagagatttgtggtaacttcagtcgtcagatcaccttaattggctcatgagaggcttgaatgtctgtttaccgaagaaaattgtttttcagatgagatttgttccgtccaacaaaaattacctcgaggtaccagtacctcgaggtactttttattagaccggagcaaatctctattcagaatatgacaattaagctgaacaatcgttttctccgccaaagaatttgcggttgtctttcttgagaattttgtgctgtgtcccactcaatttctgatagatacttagccttcagattagatgaacaatcattgaactgtttggaccctccagcttaattgtcatattctgaataagtggttgtgtgtgattaccgttactcgccttcgtatttgtccaacattatgctctttactaacatgcatttccgatatttcagtggattagtctccagggtattttcatataggaatcgtatgagtcgctcaacatcatagaggaatatgtacttcaactaatgacttaatcattagccggtcccatttttatttttgctttttgattgcgagtttcaaataatgcatagttttgcaacatatttattcgtaagtaatacattcactttaccttctattttacaagcattgagtttattatgttcaactgaactagatattgggagctagccctctacaagggtccagccaatttacttacccagtacccacagaactcttcagatatatatctgaatttgtactcctgtgttacacaagtactgaacatatacacacacctacggcattattcatacacacacttactttccacagctaataacagtacatatgctcgatcacatggtgtcatatcaattttggcaaatgtgcttactcttgaatacttcactgaagtgtttcactacattttcttagcc

SEQ ID NO: 50763 - DNA, 1501 bp, Oryza sativa
atatagagtagggcaaatatcatgtaagcgccttgctcctgccattgcccatgtccgcccctcttccttgattttggcaaaaaggactgacaacatagcatcgttatgcttgaagattcattggttcctttccttctagatctcccaaacgacaagtaggatgagagtgcgtatcctcctttttggaacttctaccatgtttgttagagcctcccaccaggcttttacggtctgagtcgtctcccattgtctagtgtcaagctgttggtaagacacctagacagctatcaggcttcatattttttttcatgtacctgcagctgacaacaagatgcagagccgtttcgacttctctatggcagagggcgcaaagtccattattttgccatactctagtcgtgagctggtcggaggtccagaccctgttttagatgactagccatgtgtggaatttgcatttttccagcgcccaaactctccaaataagtgcatagtagaattttagaataagcgcccaaactctccaatagaatttgcattttagaagactgtttttagcgccccaaagcattaagtgcctggtaagccgctaagtattgatttgtaaatctcttcatcagcaggtaaattagacataaaaagttcacactaatcacactgtgggcaattaatttggaaatgatcaattattttatttagacaattactataatttaaatttgttgttcagatctaccgtttgttcagtttctgtatatatccattagcatttagcaggcctttaaggtggacaattactctgttgataatctgaggtggtgccaattaatttatttgtacaattactatcatcttaaatttgttttgaaaacccccgtttaaattttcggtttctttatccatccgttagcaggtccttctatggacgttccatatgccagagatcgctcagctagacagtatatatatgccggtaagaagacagagtttctcacaagaatcactctccacttctgcagtaagccagtaagtagtaagaagaagaaatggctcgttttttctccaccattttcctcttgctcgcgttagcttttgtggtaacctacatcctctcttttagcttctttgaagtgaaaaaccatttttttcccaatcccaagatatatattgacaatatagatgtgttcatatctttcaggctgaagtttcagggagcacgaatggaggcttttaccgaccagtaagttattaacatcagtattttctgagtgctggacttctggtagttttctgatgatttaatttatggtttttgtaatgtaggttggtgcagaaggttctgtctccatagaaggtatgaaatattgcaatttcccgttccctcaactaacagactctttggaaggcttcatatcttcttgtaccatctcatataaaatgtcaagaatgttagttaccttttacttttaattctgaattttctctccttcgatgtatgagc

SEQ ID NO: 50764 - DNA, 1501 bp, Oryza sativa
aggtctcttgtcgggctctgttttgaactattgaagtgtacaaagttcaagatcttatgagctacagttttttcgattcctacatggactacagcaaaatgagcccatgtattccagattacctgtactatgttgccgaagtcccccgtaccaatattttgcaagaaaccgtattgctgaagatcattgttccaaggctctgtgaaagcacaattctgatctcaaatcaaaaactgtttgttcttcatttcatggtgtagttctccccattgttgcctgtatgttggctgatatccctacgatttcactactgcgattcctctgtaattttaggcatgaatctttgggtcgtcttgaaggttttaacttgtgatgaccatcagttaaacagtttccatcgtctttcaggtccatttacccaacatcttaagatatgctatgttagtaatattagctccaagtgtgtatcaggctgctttgataggaatgaggtcatgtgagaatgtgatagatagcagctgcatgtgatcagttctaaacattgtgccaaacatatacagtagttccatcctgaacaattgaccaccaagagaagagactgcttacctgtatttatcaaatcgcttgcttgctctgcccatttgcatcgttctttatatgatttgtgattgacatgtgcgcgctgatgccacatggattgtacacctcagccatgacgtcccaatccatagtacgctgctcattgcaaacacgaaacatcgatcggtacagagaggagttaatcgatactaataactaataagcatgcaaattagattgatctgaacatactgaataacccaacgtctgataatgtgctgtgtgtttatcatcacgttgttaatcttttagagcagtactgaaaaccagcacagacagaacaatttagaaagaatcaaagcatgacagaaaacaataacactatagattatctagaaaaccagtcggaatcctgtgcaatactgctagaataatgacaactactgatatgtagcaatgccaataccactaggcccatatttcagtaattttcaatgcctatgtaatattgaataagtgcattgtcctttttttttctctcatcaattttaaccttttaaattgaattggatggcgcatacaacttaatagttagtaggggagaactgcaatatacgatcatcaacatatgcaatgttatccagggcacagcaatgtgtattggcatgtatgtactatgagtctatggtatagatgtcagttgcttgtagaacaattggggagcaggtgggtggatttgggggaagtcaaagatatatccgcaatttggcaaattctggcttgagattattttgaaatttgagttaaatgtgctgaaatctagatagtaaattgttgcttcagctcttgttgaaatttgatatatttattgtttttgttggagctctcaaattttagttcagtacatgctgaatgtgaatac

SEQ ID NO: 50765 - DNA, 1501 bp, Oryza sativa
tggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacgggaacgaacgtgagccaacggtgaggacgtagacgcccaacagcggcggcataataggccagccatgtagacggaggcaccaatcggcggcgacggaggcaggccggcggtgaagacgtagacgcccaacaacggtggtgtgaccaaccaaccatataggcgaagacaccagtcggcggcgacggaggcaagccggcggtgaagtcgtagacgcccaacagcggcggcataataggccagccgtgtagacggaggcaccaatcggcggcgacggaggcaggccggcggtgaagacgtagacgcccaacaacggtggtgtgaccaaccaaccatataggcgaagacaccagtcggtggcgacggaggcaggccggtcggtgaagacgtagacgcccaacaacggtggtgtgaccaaccaaccatataggcgaagacaccagtcggcggcggcggaggcaggccggcggtgaagtcgtagacgcccacagcggcggcataataggccagccgtgtagacggaggcaccaatcggcggcgacggaggcaggccggcggtgaagacgtagacgcccaacaacggtggtgtgaccaaccaaccatacaggcgaagacaccagtcggcggcgacggaggcaggccggcggtgaagtcgtagacgcccaacagcggcggcataataggccagccgtgtagacggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacgggaaggaagtgaaaactcccaaagcgaaaacgaagtcggcgactcatgaaattgattccatcgcgctcgttgataggaaactcgacgcaacccctacctggcgcgccaactatcgaaacatgatttcggcaataataaaagggggtagcgcacgagacctaaaagtggatggatgcagagacaaaggatttagacaggttcaggccctctcaatgagaggtaataccctactcctgtt

SEQ ID NO: 50766 - DNA, 1501 bp, Oryza sativa
atatggtaaataaaataaagttcatctctagtacatggctgtggattagagctaatctattgtacacgccgcgagcgaatctcgtgcaaccccatgctaagcctacgtaactagcaataatcctacttcttactgtttttactgattcttaatagtaaaataataataataatatacaaattgatttgaaaattctaaaatataggttgaaagtttttagtttggatttgaaagttttaaatttcaactgaaagatttacatgagttgaaagtttttaaaatggttgaaagtttttagtttggaataggatgtttcaaaatttgagttgagagttttcacatataagttgaaagttttaaatttgaaatagaaagttttaaaatttataagttgaatgttttaataaactagaaaaatgcccgtgcgctgcaatgggtgaatgctattttaatattattattgttattgggtttagttagggtaaaattcactgtgggaattcgcttggattttgtttttagaaaatcatgaggtggaattaggagtccgtcatctcaagttagcatgagagttttttaaaagtaatttcttatacgactcctttgtattttcaaaagcaaacgtgtttaaaatccaacttttatacgactcctgtatttccaaaagcaaaagagcttaaaatctaacttttatacgacttttttttatttccaaaagcaaacaagcttaaaatataactcaaacacggatatgtacttccaaaagcaatcaatcttaaaacctacttaaacacggacgacgtaccaaaataccggcaaaaacatatttaatatttataatagtagagaagagatgagttaaaagtttccaaaattatgataaagtgtaaaatttgaggggaaagttttaaattttgtgttaaaattttttaaatttgagttataaattttaaattaaaaatagaaacgtacacgtgcgccagcaacaagctagcgcatgcgcgaggtagcgatctcgaagaaacttgccgatgacatcatttcgtttgctgtgggcccaaggcgattgtgagccgaaagccaaaagcccaaaaacaaccgtgggcacaaaagccgagcccatataaatatggaaaaagtacaccggaggtccctcatcttgtcactgaattacaaaatcatccctcaacccaaaatccagatatataacatctcttaacttacaaaaccgagtcactttaggtctttaggtgattttgaacccggttttatcttacgtggcaactgagtcagcgtgggacccacatgggttccacatgtcaatgactactttctttcccctctctctacctctttcctctctctcttcttctctacctctcttcctctctctcttcttggcaaccggccatgcgggaggactgaggagcgcggctgacgacgggcggggagaggagcggaggtggagacggatgcggcggggcgccaccggcgatggcct

SEQ ID NO: 50767 - DNA, 1501 bp, Oryza sativa
gttgtggatgtgtcatgaaaaactgtacatactgtcatcgtaaacatgactatcagctaggacgaatgacacatgccaatcaccctctatttgaaaatataagtatatctagtatataaaatttatctccatgtgatattttcatcgcacgtaaaacgaaaaaactcattagcataggattaattaagtattaactattataaaattggaaaatagattatttatttgattttttaaaataacttctacatataaatttttttgtcaaaaacatatcatttaatcccttatccttatgcctatcatccaaaatttaaattttcaaccttaaatttggagttgattttaaattttttttcatcgaagtttatttttcaacttttgcttttagatcgttaagagcacatatataaaaatttttattcataaactattttttgtttgtaaatatgttatttgacttattttctgaataagcgaaacgattggaacaaattgaagtttatagttgagaaaaggaaccgcacctaagcaatacctggcccacacctttaataccttttcagtgtatatgttatgttgtaaaccgttggatcacagccactcgatggatatcaggcattcccaagcattctactccctccgtccaaaaaaaaaaaggcaaaccctgagttttcgtgtccaactttgattgtccgtcttatatgaagtttttttataattcgtattttcattgttgttagatgataaaatatgattaatattttatacgtgacttgcttttttaatttttttcataattttttcaaataagacgaacggtaaaacattaggcacggaaactagggtttttcttttttttggacggagggagtaaacatcttaccggccggtcttatcagaataatagcagtgtttgtatgcacttgtactactcacatgacataggcgataaattaattttgtttttcgcgaatgtcgtgcagataaaatctagtccataatactcatgcatgatataatctaaaaatctctagcatatgtgtttctcgaagaaaactgtagcagatgtgtttctctaagaataatctgttgtggctgtgtctaagagatgcagacaagtcatcaagaaaggcaaattaacgtgcaacgtgctggctagaccgccagagtactagtactacctctgttctaaaataagtgtagccgtaggtatccatattcaatgtttggtcgttgtcttacttaaaaaaaatgaaatttcttttttaaaaaataattacagataaaaaactattcatattttaccatctaataataaaaaaaatactaatcataaaataattgttaataaaataatttttaataagacgaacggttaaatgttggaaatgaataatataaaattgaacttatctgaaggtggagggagtattatatagcacagagtaccccgcacggacaagtcagctagcccgacgtatcgttttaatttgcacca

SEQ ID NO: 50768 - DNA, 1449 bp, Oryza sativa
atcaagaatgagacatgggtccatttaaatctttatctcttctatcttcttcatcatctcttcaacaaatcttcatatattctaataaatctgccaggatgaaaaagataatctgaaatttaagtaataaatataaaatagtgatacttcagcaatcaaatttgaaggacggccattgatactagcttaggtaaaaaaatgcatgcacatcaaccaacatattgcaattgtcagctacatcagcgtaaacaaactcttggtatcaaacaccctacatgcagatacacaccattatttttaaatcaaacgcatttgaagtccatgtttttgtattgatagttttccaacaatactctatttcaagtccatatttgaaagtaagttgagcatgcaattcaaattgaatcctggcaagaggaagaatgcaagagcacaattatgaattatcattatggacatgataaggaaaaaaagtagtagtagtagttgttgttttaattaatcagtactactaggtcactttgtttggccagtgtattgtgcagcgagtgagagagaggagattgaaacatctgtgtgtgcgtgtctttgtatataggttgctgccaaagcttgtgttttttgaatgcacaatgccaccttgctcattttctgctggtgatacatgacatgaaactaaagtttggactaatgtataagtatagagcataaaagactttattttgtagtaagtatgagttcctatcaaaaatatgattgttaccatttatttagtcccaacatgcatgctaaattgaccactaattctacagttccctgacagagactacaagaatggatcagactaaaaaatacctccagaaaaaacaaaaaacttgatgctagcagctcaaccagtactgagatctacctctaggttaacagagctgacagcatctaactaaaagaactgcatctctaattaactagaaaaaaactgttactggtttgcagactaaaatttctcatatacctcactagttgaatgatcctcactgcatgtgtgataattcctcatttcttgggactggcacattgatctcacatatttagactgcactaagcatgataattacactgcagaaaaaaccagagcacaacctactccatcaaattagaacatcatcttaccaaaactcattcatgatctaaaacaagagcaccacacgcccacccatatccccttctgaatcgcttccataacaaaatgaaatgctactgcagggtacaatactacaatgtattagaaagaataggagaacagattataactctcccaaaccaaatcaagaaacatgccatacatacaccaagaaaactgaagtactgaacgaacccccaagaatcaagcagcagctacaagggcacgcacaaacctagccgggcaaccaccggcgggcgtcgcgcagc

SEQ ID NO: 50769 - DNA, 441 bp, Oryza sativa
attatctaaaaaaaaacacttttggagtttttcacgggatcaaggaaacatgtgaaattaaatgggggatgattgtgctttgttgagatgaggaattagatagagaaattaaatgtgaggtagctatgattttgaacaatacaagttgctatattagatagagaaattatcttcgagatagggctgctgatacattttgttcatgtgttgtttattattattcttgtagaaatgctttcgctatacattttcatttgtaaatacaggaaaaagtatgatactattagatcacttactagtcaaatcaataggctgaatttagattcatactaacttatttcaggagtacttagaactgtactgtgcgcaaaactgatattttctggaaattccaggcatttgactgacactgacagcacattcgtttaaaatgttgacagg

SEQ ID NO: 50770 - DNA, 482 bp, Oryza sativa
gggcctatacaacagggtatgttgtatagcgttggattaatattgtttaattacttaactgttttattaaattctcaaatgtttgctaaatgctgcttttgcaaatgaaaccctattatgccatcctttgttatcttgtgcacttgcatatttgctgcgtggcttgctgagtatgtcatatactcaccttgcaatcattcatcagaggaagagttctacaatgaggctgatggagtggaggaataggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattc

SEQ ID NO: 50771 - DNA, 1501 bp, Oryza sativa
tgaggaactcgtctcccaactaaggagcgagggactacgcagggacgcggtgctgcgcgacacgtcggcatttttcctagttggcaccagaaagcaacgctccacctcatcgcactgtaagaggcctaaatttattcctttcagcgtgactgacaaaactcacgcccaagtgcgcgtgtcattaggctgcgcgtgtgtccgccaataatttttggctgatctgggaggcacaggtctgatcggacggatgcagatcaccaaagggtgtcggagttttaaactccgacgttggtaacaagaacgcctttgcatgcgagaatgctaatgggcgatcaggcgcatcgtgcattcgtgcccgtgcctgatccctgctcctttgttcatggaggccttcctgcggcacggccacagcacaagacacatcctgcatcaatatgacactatcgctccttcaacgacgccatcagcgacgaggctgtactattgacagcaagaagaggccaccgcctcattcgtgcctcgcctgcgctggcgacgacgaggaattgctagaagtccgggacaccaacttcctacgaatggccggcagaaattaagtagggagtcggagccccgcaaaaaggggaaaaaaaacgctctttggaaagagcctatagctagcacctcggcagaagtagatgtttcagagtgattgtacacttaggccgtgtttagttcctcctaaatttctaactttccatcacatcacatcgaaaactttcctacacacataaactaccaactttttcttcaaactatcaactttctcctaacttcttaacttttccaccatctaaacacatccttaggttcaaagcaaaatagcccataatgcaagtcacctgaccaggccatggttcaaagcaaaatagcccataatgcaagtcacctgaccaggccattgatgaatgagtcaacacgatgttgtcagacgatgatctactaagggtgtgtttagttcacaccaaaattgaaagtttggttgaaattgaaataatgtgatggaaaagttaaaagtttgtgtgtgttggaaagttttgatattatggaaaagttgaaagtttgaagaaaaattttggaactaaactcggcctaaggccttgtttagatcccaaaaaattttggcaaaaaacgtcacattaaatgtttgaacacatgcgtggagcattaaatgtgggggaaaaaaccaattacacagtttgcttgtaaattgagattctaatcttttgagcctaattacatttgctaataacagattaattaggcttaataaattcgtttcgcagtttacaggcggaatctgtaatttgttttgttattagtctacgtttaatattttaaatgtgcgtccatatactttaaaaattttacacccaaagaactaaacacaccctaactaggtcacaaagtcgcaagttccctcagaacactggtgattcgaatttgtacaatggtcaacaag

SEQ ID NO: 50772 - DNA, 973 bp, Oryza sativa
ggggatgtggggaaatcaatattcaaagtaaaaaacaataaaagaaaaaagaaaatactaaccggatctggcttcatttttactccggttagtaataccaaccggggttaaaaatggctccatctttaatcccggttggtgttactaaccgggaccaaagatcgatttccgggactaaagatagcgatctttagtcccggattcgtagtcccggttggaaaaccgggactaagggggttgcaaaccgggagtaaaaatcgtttctccaccggtgtttgaaagtttagccatgtgtatctctgtctttaggtggtattttaaagtagacttcttatttttaatcaagccatgattttatatttcattgttgtttacactgcaacctctatatgtaataattgcattttaagcaaatattagaataaagtttattactaaaaaaatatctacatcacaaaaggtgagtatgctcactaaaaagagtcaatgaagaagaagatagtactaccatgtacttcctccgtcctaaaataagtgcagccgtggatatccgtgtccaacgtttgaccgtctatcttatttgaaaaatttgtgaaaaaaataaaaatatttagtcgcacataaagtactattcatgttttatcatctaatagcaataaaaatactaatcataaaaaaaaatttaaataagacgaacgcttaaacgttaaatgtgaatcatgcaaaactacatttattcattttagaatggagggagtaccaactaggcaactactactagttctaaaaaaagtactaccaactactaccaagcgatggatggatcatggatgcatggatggtggatggctgtcgctctggctcatcctcggacgaatcactttgcagtcaacattaattccagctagtagtactaatattcagttaattgacctgatcaagtgacttctccctgccggtggtttcaattaga

SEQ ID NO: 50773 - DNA, 206 bp, Oryza sativa
aggcggttatttggttctaagggtcatgtccgtctgcgaaaaaaagacccctatatttagaaaaatgctttttctagtagtgacttttcctctcgttgaaatcatcataggcgggagaggttcattagatcgatggatatattgtagctcaaaacgttattagcctcgatatatatctcgcatatcttagcattgacactactaga

SEQ ID NO: 50774 - DNA, 1333 bp, Oryza sativa
cttacattgtgaaacggatggagtatcttgtttgtcactttatcatgctataaacagaaaacaagaaaccattacaagcagtcttaattcttaaaccctcaatctccaaaatggaactgaaaacctcctgtttaaataatgaaaccgagcagaaagatgaatattccttgctcattagtcattattaaaagggcacctactcctcaatttctattctttgttatccatataaaacttatctgtaacaaacccgagaacgacaagggctgatgcatcgtcacgtacacaaattgggctctacaaatttcttggctccgtcaccgtgtccgtatcattagaaatcttacataaatactcgctccattttaaaaatatattacatcattgatttttttataacatatgattgttcatcttactaaaagaattatataaatattatttattttgttgtgacttgttttatcataaaataaaatataatcttaacttatacttgtacatatttataataaatttttgaataacacgaatgatacgaaaagtcaacgatgtacgagggaggtcctagtatgtgtgtgtatcattcttttaaaaaaaaactcactcatgtctgagagacgctcaatgattatgatcatccggatatatgatcgaaccttccgattactgcttgtttaggatatcatcatggactcgtcggatcaaacctcccctgaacaaattcggccggccggcggctaatgccggtcaaaaaattattatttcttcttaccactattcgactcgccgccggcaatcaccgtcatttttttttggttcttgcgacgtcagccattagctacttgggccttcgcaagttcataccgatccagatatatggctgcgtttagttcccttcgaacttccaaaaattccaccacatcaaatattttgacatatatatgaagcattaactgtggacgaaaaaaaattaattactcagtttgcatgtaaattgcgagacgaatcttttgagcctaattacgtcatgatttgacaatatggtgctacagtaaacatttgctaatgacagattaattaggcttaatagattcatctcacagtttattttgttattagtctacgtttaatatttcaaatgtgtgtacgtatatttaatttttatttttgaaaagtaactaaacaaggctataaataaacccacccctcgcggcttcgcttttaatttgctcgggttcttttcgcggctaaataatttgttcaaaccttttcgatcacgcgcgcgcgaatctcaaagcggcggaggcggaggcggtgatggcggcggcgg

SEQ ID NO: 50775 - DNA, 1501 bp, Oryza sativa
gagggatttattagtagtagtgagtaggctgaagtatagcgcatctggtggctcaagcccaaatctgcccagcaaataccgccattaatgggcgtatcatgatgcttagagagtggtactggtactagtagtagctctccgcttttactccggctcacgcgcgcgtcctcgatacgacgactcctactgctagcagatgggacggaatgactgatgatgaggagcagcagtgcagcacagtaagaaaccaatggatccttcttccttgacacggggcaaggcgagcagcagtaggtgtccggtcatctcggcggaggcttccgttccgtccggcctaaccctccggatgggcttaaataaacattcgctgtcccacgccggcgatttactctcgcgggcgtcttaggtggcagccttaactgactctctcttcgccgagcgacagtggcgcgcgattgccgtatcgcgtcaagctctacagcctggtgatgctgcatgctgcggccatgcgcgcggtgatggtccacggcgtggatagagagatactggccgccttaattaagccgctctgtgcgtgtgtgtgtcatgagtgcgagaagtacatggcacggcgattacttcccgcgttcgacgttctggcatgacggtgatcggatccggtccggtggtctgcgctgtgcgccgccaacttggtcgctcgtgggggccgccgccgccgcgtgtgctgactgtagtattagtaccctttgttcttgcttcaaaggttggatttcttatgacggaattagtagtggcctgggcttgtcctatcctatactactgttctaggtctattgtaacagaaacctctgcttctggatcatcgggtgtgtgtacacgtcgccagtggatggaatgtatgactatggagccgtgaggtacgcgtggtttatgtaccttgcactttgatgagtgataaaggggtggttgattatattattgtactactcaccatatatggtggaattattgtgcactgaagtgtgtattatacttgcccaaccactcgtctttcactgttcctatgactttttactatatgcaatttgggttctttccagcagtatcaattatagaagttgtatggggtgcgcaggaaaatgtttacttattttggtggttagttcttttgtctggagctatatgttggttgcatgatatatctttcttttattttcaaaacacacatcgcctcgtgtcttcttttcagaactgttaatcctgaaacttttcattggtgtacaagaaaaacgtttattttgatgtgggttacttcatttttctaaaacattacatctgatgacatgtctatctactgttttacctttgtattgttgtcagagttggtgacaatataattagcttcagataatttgtccacctttatgctggatatagatacttactcgtcacaattggcttatcttgatatttaccttatcgttagatacattgtgcctga

SEQ ID NO: 50776 - DNA, 1238 bp, Oryza sativa
tccgtggccgcgcccgacacgccacccgcgcagcggccggagacgaaggaggaggaggaggaggacgcgaactacatgagcatggatgaggcgtacgcgctggtgatggcggcgcggcagcggccgccgccgacggaggaggaggtgaggaggtcggaggtggacgccaaggcggaggagctcgtcgccgagttccaggacgacgagcagaggcggcagcgtctcgactccatcttcaactacacgcagatgctcaagcggccatcgccgacggaggagggggcgaggaggtcggaggtggacgcggaggcggaggagctcgtcgccgagctcccggacgagcagaggcggcgccgcctcgactccatcttcaactacacgcagatgctcaagcagcgcgcggcggccggccgccggccgcaaccagcaccggcggcggctcagctttgactcacgtggttcatatggtttaacttcatttgattctttgatcaaatcaggaattcaggattcatttgcaggagaagaattcggatcagatttgagtttgctcttgtgttttgtatatagtatttggtttacatgtgtgcttggcttgtcaagttttgtgcagattacttgcagtgttgttgctgcaggaaaatttccctttttcagttttgggcttgtgtgtatatacggtactgttctgttgtataattttgtacacacattttacatgtgattttggacatatataaattctttgatttatttatgaattcattcatgttttacgtaaattgatcaatattgtgtagcatcatatatgtattattttacggatggggattctctgttacatcctctggtcactaagactgtgttctctctccggcacacaaaacgatgttcgtattaatacgtaattaattaagaattagctatttttttaaaaaatagatcaatatgattttttaagcaactttcgtatataattttttttaaaaaaatacaccgtttagtagtttgaaaaacgtgcacgcagaaaatgagagtagggagttcggaactcccagcaaagaacgcagcctaagtgaagattgtggtatataggacaccaacgcagtgtccctaatgtaatttttttttgccaattgttgaatatttacagaacaaaacaaaaattcgagaaaaatctacatgttctgtattttctatgtatccaatctaattagttaagaagacattggtattca

SEQ ID NO: 50777 - DNA, 1501 bp, Oryza sativa
gaatgtgagtatagcttcgttgcaacttgcaaaacagcaagcggcacaatcagcaagttcacaaccggtctggtgcattgaagttacaacaaaattcatggttccacttccatcctccgaatatcgatggctcgattttttgctgtttatgccaaaaaaaaaaagtaacacatgcatgtaaatactttttttttggaacatgtaaatactattgaaataatattaaaattttctactacgtacttcctccgtttcatattataaaactttctagcattgtccatattcatatatatgctaataaatttagacatatatatgtacctagattcattaacatctatatgaatatggccaatggccaatactaaaaagttttatgatttgaaacggaggtagtaagatatttgatcttatactgataacttattgaattatagacatatataaaaaaaatgtattcttgtatggttacaaattatgcaacttctttaaatataattgattaaactatacttcatgagaataatttgcatgtacattggaatagaacagagcaaatatgtagagaagttaattcttattgtagactaactattaaaattgttcaaaagctcactctttatgaacacattgggatcacttcaaacaccaccatgaccatgaggcaacatgatgctacaacagtagaaaattaacttaaataaagagataaacaacatgcggattgttttgcgttagtgttttcttactgagaatattatatagggacaaatgattacgagtacataatgagaaacgcccaggggtcttcgggctagctccacaaggtggtgggctagataacctgggttcgaagcctcatccattataattatttgatattaggtcattttctaatagtcgtgtttttgtagttacaaaatgggtaatcggcacatattggctttcttcaattgatctagttgcattaattctacttgtaagttatggttgatcgtactttgagcggaatatggttttactctatttttttagaacaagttttactctagctcaagtcgaaaaaaataaacaatgctccgctttaacggactaattggcatgtagctacgattatgtactccatactagtctactagctatattttgagacgaaggaaatagataatagtgaacccgcaacacgacaatgtatttgttagctatgcatggttctaagtagacagatacaaccacaaccttctatattagctttatatggaactagggatgttatatccaaccttgtcgacgagggcacgtaatctgctcgatcacgacacacaaagatcttagaaatttggagcacttgctagtgaaaagctcactaggcacaattgttatagtgttgtgtcgctttggtcgttgccttcaaagtctagccctgcctattcgacttcgtctagtcgttcgggcttggctagcccttgcgtcaagaggctgcgacctacaagagtga

SEQ ID NO: 50778 - DNA, 1501 bp, Oryza sativa
tgattaaaatttaattattaaaaacttgacaaattaatttatttgataattttaatgtaacttttatatagaaagtttgaaaagtgtaataacggaaactgagttaaaatctgtacgtgttaaatatattattcccctttttaaatttatagaagaagttaaatatgaacgttggaaaacgctgaacaagtgaacatatcccgcgatccgcatttgttgcgactcgtttcgatcaactgattctccttcccggccggacatccacatcatcctgcgatcgttcgtttccctagtcgttccaggctttttcagctctactcccctccacccaggcgcaaatcatccgccatggctcccgcctgggtcttgctcgatcgcgtcgtcaagcccgccgtcttcgacgaagaagagagcaaaggtaagggagaatcgaccggcgccccagtgaagtacctgccagccagattaaggcaggaagtccccgccggcatgcgggacgtgaagccctacccagaggttgcggatcctcccattatatctcgcttctccatgctgatttcgcggaaggcgatcagggtagtgaaatccgtccgtgtccggtgcgccgacaagagccttgtcttgttctacgccggcaccggcttccccggcttctcgtcccacggctgccacctgatctacgacgccatcgacggctctctcactgcggtgcacacattcccctttcctgtgtccggagtcgtctgggtcggcagagccgctgtcctgcgccatgccggcggcggaggaggaggaggagacggtactaccgcctcctatgtcatcgccgagctgctcaggccgtttcatggctcccttcccgatgccacgctcgtgatgtggttgtcgaattcccccgcgtcgacctccggcagcaacggccaatgggtgaaggaggacgttcgccttcccggcgaggtgtgcacgggcaccgaccccttcaccaccgacttggtgttctcgttcggtgaatcgtgcctgtgctgggccgatctgttcatgggcatcctgttctgcgaccttgcgacgctgcgtgcacctcggttccgtttcatcccattgcccaaggcttgctccttcgaccccgtcggcaagtatggccggcctcacatgcccgagttccgttccatgggccgcgtcaacggtgtcatcaggttgatcgacatggagggttttaccaacgagtacctggccgtggatgaggtgaagctgaccatctggaccctgtcagccgacctcagcgagtgggagaaaggcccggtgtgtactgtaggagacatttgggccagtgaggaattcgtcgccatggggttgccgcagcttagaccgatgtgccctgtcctgagcatggttgacgaagatgtcgtctgtgtagtcatgactgaagtcgagattgaggagagcgatgtcacagatttcgacgatgagggcaacaagctcaagttcaaggcccagtacgttc

SEQ ID NO: 50779 - DNA, 1501 bp, Oryza sativa
ttttagcacatgtttgaccattcgtcttattcaaaaacttttgtgaaatatgtaaaattatatgcctacataaaaatatatttaacaatgaatcaaatgataggaaaataattaataattacttaaattttttgaataagacgaacggtcaaacatgtgctaaaaagtcaacggcgtcaaatatgtgtagtagatgtcctaagactatctaggtttctcaatgatgaattttcatttatatatatttggccacatattaatttcctgtctagctctgttaattgtaactttggtatgcactgagggaattattgaagtggattaagaaccattaggccattttaaatttgtctagtttgacatacattaatttgtttctgctaggcaatggtggaaggaaatgagggtgaggaaagcacaaagcggatgaaggttaaatgatctctgcatcatgtggaacttcgatggtttttgcaacatatcaagtaggattaacattgaagattggtgtttgattagcacccatctatgtggaaggatgaatgtgatgtaatcattctctagaagttatgatgttattatcagatggtagtaaaactgaattgctagtgtgttttgttaacgctgatggttttaacattacttcatagctacctttgaattgtctggtcatgccgggctggttgatggctgactccgataagtgatacaagtggtacctgatgatatcttttgtcaaactctagcactccagtcattaactagttgtaaatggaatagtattagtacttatcttaaggcaaaatctcaaaatcgtacagtcttgttcttttatttaaaagaaagaatattctgtgcacaatcttggaactctgtgcggcacaatcttaaaactgtgtgctgtagttttttttttttaaaaaaaagaaaactatgtgctgtaggacgttttgtgtttatatcagactaccaagaaaaagagaagtgaaattttacgcatttccgtgccaatatacccaagttgctacagagtacagaggatactctgactcatactctctacgtccatttgatattttacttagtcaatttttttaacatgtaatcaaatttatagaaaaatatattaatattttcaatataaaacaaacatattatcaaattatatttaatgttaaatttaatgaaactaatttagtgttgtagatgttactaattttttctataaatttagttaaactaaaaaaattttaattaagaaaaaagttagacgttatacagtatgaaatggagagtatctcccaaagttagcacgggaggaagtcaactccaactctccagtgagagccaaaggaggcattttttgaaggcacgatcgactgactggttcgaaacaatgacactactttaggatatttttgttggatcagaggaagtgaaagtttataaaaaaatttcatttgaccatttccaagttgctattgtttggagtgcaccagtt

SEQ ID NO: 50780 - DNA, 1501 bp, Oryza sativa
taatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatccggtggtgaagacgcgcagttgtgaagataaaagcaccagtcggcggcggcataaccagtcggcgacggaagacgatgatgtccatcagtagtggtagctgtataaccagacgtagaggtaagggcactagtcagcagcagacgagacgaccggcgatgaagatgtaggtgcccaacaacagcggcataataggccagccgtgtaggcggtgacaccagtcggcggcggatgaggcggccggtcggtgaagacgcagacgcccatcaacggtggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggccggtcggtgaagacgtagatgcccaacaacagcggcataaaggccagccgtgcaggcgaaaacaccagtcggcggcggatgaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaat

SEQ ID NO: 50781 - DNA, 1501 bp, Oryza sativa
tgcaacttttaatccaacatcgcgaagcagaacacacgaggcaaatagcaactattccatcagcctcaccaaattcgaaatcataatttccatcgacgatggggccgacataggaatagcagtgaaatcaaacaaaaaaagaagggaaacggtaaacgtcattagaaagcaaaagcgaggtaaaagaatttgggaaaaaaatgacagaagacgattcgcctaacacaaccacccaaagaaacatctagattcgtgagaggaagccagctcaaccaaagagaagaacagagtagaggggaattggtaacaccgaacccaaaattaacaatgagacttggggaaattggaccaaccaaaacaaatcttgaaagctggatgatggggagaaacagctggaaggctcacctgctgcgcgtgatcgccgtcggtgtcgaacgtgccgtggtacaccacgtaatccaagtccgtcaaggtgcagaccacgtcgaagagcagcttcggcctgtcgcggcagctcacggtcaccaccgagtaccctctctccccccaatcctgcaccgccaccgccgtcatcggcgcggcgccgcggctgtcggcctccccgtcctctttcagcagctggtggagcctccggtccaggtttccggccgccgacggatcagccaggaccgtcctcgcgcagcgcgcgccgccgcggaggacgtgcctgaggcgggactcgatgcgcctgacccgggccgcgtcgtcgatcggcgcgcccgtctcctcgtcgcggacgaacaccagcgctgcgacgcggccgccgtgcgtccacgccctggcctcgacggtgttacaccggaggtcgtgcagcacggcgaacacctccgaaaggaggcccgggcggtcggcgccgacgagctcgagcagggtgagcccctccgcggcggggccgcccgccgccgcccgcggcaatgcttccgcggacagcgacgactcgaggcgcgccagtagcgcgtccgcgtcggccaccttcctccccgcggcgtccgtgacgtggaacacgtccatgaaccaccgcccgtcgtcggacgagatgtaccccttgcggacgcacaccccgtgctccgacagcgccgccaccgcctccagcagcatcccgtgcttccgcgcgctgtgcacctgcaccagcgtcgccgtcgcgcacaccccgctgtccaccaccaccctgtaccacaccgcgcccgcgcgcaacaacaacagcaccctcaccacccgttcgatcgatgatcccaaaccggaacacaccacaacagcaacagcaacgagaacccttacctcggggtgttcatgtgccgcacgaagagctcatacacctcggagggatggtaccgctccatcgcctctgccgctgccgctgccgcttcagtttgcccgcctcccgcaacggtttcttcccaataaatttccttcgagacggcgaagaagttttttttttccgctcggcggagtggaacaggtt

SEQ ID NO: 50782 - DNA, 1501 bp, Oryza sativa
taggatgtaggactttggccaacaagtaatatttatataacacgaaaaatataattataaaaaagtatttttgaatacgaatcgagtggtatcattttttttcaaaaggatacatttaatgaagtaactgttggtcaagactttaaaaaacaaaatacatcctgtaacttaaaacgaagcgagtacaatattaaattgttaaccatacatatcgaatcttatatagtttggtcaccaatacttgatgctccacgaatttaaataaattttgatgcataatactccctccatctcataattattttgacacaattaactttaccaataaagttggaccagtcatcttattaaaataatcgtgtaaatgctatttattttgtcatcatttgttttgttatcaatgatattttaagtgtgacttatatatttttcatatttgcatataatttttaaataaaacgagcgatcaaactacatcagtcgcgtcaaatatttatgatgagagggagctagtgcttttctattttgccgttgtttctttttgaaatattttgccgagatatttttatttgctgttcttaatataagatcgatgtcatcttttatgggccacgtggaacataattgctccctcaaagtgaaggtgtgtcacactgtcactctacattaatcacccaatattttcgattttcatactgaaacgcagcacgtgccttgaacagcttaaacacggggcccagggtgatcaggatattataaaatgatatccaaattctgtagcgcatattttgtttgttcttgagctgctctcatgcgcatgtctgtgaatggatcataaacaaatgagcatgtgcactgcgttggttcattttttttttctattttaacacatgggagcatatccaattattgtcgctgatgtttgagagaaatataatcgaaaaaggatcacatgatgaagtaatgataattcgattgaaagcataatttttattaattcaaatcagcttcataatgaatggtgccactttatgaaaaatgggaatggcaacggcaccgacaagcgcaataatgcaaaagggcgtttcagttattatcgtatcctattatcattaatgagtttttttaaagatgccttgatcgagcaattatatgcagctccaacatatatgacaaattcctatcgataagcgtcacgcactattctactatgggcgaataagcttgttaattagagttgattcaggggattaatcaggatgaagaagctttgttgtcggttgtcacattacgaatccactgcactttgaacagcagacgaaattggaattagagcagagtgggtgcagtagactaacttagtggactataaaatatgctatgtcattctaatttctatatatgtggagaaagaactaaaggaaaataaagtgggcgactcatcgtcagttgatagcacaatctatcgcactccgtaacagacgtgcagtcggtgctgatc

SEQ ID NO: 50783 - DNA, 812 bp, Oryza sativa
cactaatcttatagctatctggtaagttttttttttccaaatgttagctagtcagtccttataaaaatttcgctcaatttgaacgaaattgtgaagtctatagctctggagcctagatagaattcaaagtaaatttcaataaccttacttcctgacattaggactgcaatacgtcaatatatagatttgaaaacttttccatacaccactaaatctaagtcatctctaacataaacccaccactactcactactagaaaaccaattttcccaggcggccaaaactaattttcgcaggcgggagggaggtccgcctgcaccacagcgactgcgaaaatcatcgattttcacagtcggggcaacggcccgcctgcgaaaatgcaaaaaaaaaaacgaacaaaaaaaatcgccgcacgcggctcaccgccgccaccctcccccggccggatctgagaggggaggggaggggagccgccgccgccgtcgtcaccgccaccgccgccgtcgtcgtcgccgccgccgctccacgccatcgttgctgccggcggcctcccccctctctccttcggccagatctgcgagggagggagggaggggagacgccgccggccgccccgcgcgcatcgtagccgccgtcgcccccaccggctttcccccttcctcctccggccagatgtaggagggagggggcgaggggagccgccgccgtcgcccccgctggcctccccctccctcctccggccagatctgtgaggaagggagggaggggagacgccgccggccgcgctgccacgccgccacagtagccgtcca

SEQ ID NO: 50784 - DNA, 1501 bp, Oryza sativa
attgtatcgatttctttttgaatttctatgtgtaattacttcggaacttgagcctgagtccattttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctatttttttaccgggaatcaaatcttagatggatctaaagattatttcgatttctttactatatttagtacaattgttatatgacacatggtttttttttatgggagaactacgtcctcgagcccgaggtctgaatttattcataatagtactactgacttcggctttagtgatgaataaatttgctttgtcgaaatccctataatgagtagcatttgctgctaccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagatgatcggttggtacttttcttgcgagtttccttagcccactcttcttcttctttatcccaggggtatactttaccagtttgaaacttgttataaataaggttattccccgcttacctatttctttttttttattttgaatctttctattctgaattcagttaacgacgagatttagtatcctttcttgcactttcataactcgtgaaatgccgagttggtacgaattcccccaatttgcgacctaccataggatttgttatgtaaattggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcattttttttcgtgtcacagctgattactccttttttttccattttaaagagtggcattcgatgtccaatatcttgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggttttttctaccaa

SEQ ID NO: 50785 - DNA, 1501 bp, Oryza sativa
cgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgagtttcttatagaggttagtaaatcagcaatagtgtccttgcccataagactctaattctaggttcctcctaatttttctataatcaacacgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactacgtctttgattacagcaacaataacatcaccaatacgagcatatcgctgactactagcagctcctatgactcgaatacacattaattttcgagctccagtgttatctgctacatttaaaagggtctgaggttgaatcatattattttgatttcaatttattatttcaatgcaaaaggatgaaagaaatattgtctttccagaaagaagaacctggttttttattttcaatactacttttttggcgggggttatatttctaaccgaagaaattgacttcgtatgggcattttgctagcagctatggaaatagctgctctagctacagtttcggatactccgcccattttataaagtattcgacctggtttaacaacggctacccaatattcgggggatccctttcccgaacccatatgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcaatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattcttttttt

SEQ ID NO: 50786 - DNA, 1501 bp, Oryza sativa
attttttatgcggagtgaccgaaatgaccttgcgccttttggtcatattgacctggtcattgacgcggaagacgtcgtggaagctccttcatgccacgtcggcaaagctccagcccggcctccacttcacccccaccgacgcctctatggagaacttgcctacatcccctaagctccctgaaccatttctcgtcttccacgttcatgtctcagcagttgaaaccaagacagaaagcttccaaggtctcctccttccgatctgtcggcggccgcgaaggagacgatggtacaatcctccactgaatagcttcttctcgatctctttccattttgtcttttacgtgccatgcctgacaacttttattttggtcctaatccattttgaatagtggatcaacgggaacgtgaccaaacccagggttggaaatttcggaccgaaatttccgaaatttttgaaattttggtcatttcggtcacctccgatacgatattacttcggcggccgaaatttttaaatttttcaatattttcatgaatttggataatatttgttcaaattcaactaaattttgctcaaaatttcggaaatttcgggatttcggtgaccccaatacaaagtcctcaaacgataagagtgaaccctgaccacacctaaggagcttgcgggcgcgcttcagacgctaccgccgacgtcgaccctgtgttccggtcgcctcagtgcagatccggctgaacccttgcgccatcaccatcctgaaaaccgccctctacaacgcccctatcttccttggttggggatgcagcgatgaggagatcggggttttcttctccaactccggccactggcttccaacgtcgatcccccgctctccggtgagttgcatctcgattccacgcaaccatagaatccccaggaattcactgatcacctagatatgttggctttccagatcgtttgccgaagcacgccgtcgccattcgctcggtgtccacaatgtcgccaagccgttccggatgcccttgctattgttcagactgcgaccaaccttgttggaccttggtaagcaccttagggcagtcccaacccatagtgcccataagtagtgtctatagtgtcatgtcaataagggcagtcccaaccctccacctaggatggtgtctatggcattaactatattgccatgtagaacttttagcttatgtggcactatattaattaagagagagagtgaagagatgaagaaactgggtctcatgcaagacgcagcttcaacacgagaatctatgcactagacgctatcaagttttgcattgggagagaatagtgtcttcataatagatgaagaataaatatgattggtagagaagagagataatgtatttattaatggcccactttaagaaatcatgggttgtagagtgtaatttctattgtgatgtcttattgacatagcatcatagacactacttttttttctcctatttttctttttttattttc

SEQ ID NO: 50787 - DNA, 986 bp, Oryza sativa
tcttacccctgaaacggaggaagtattagttttcagttatatttatcattttcagaaatgaaaatcttcactgatttattagtgtatttcagaaacctgcaacttatatggttacaatatctgtttcctacatctttaagtcaggttttcagttagcaacaacttcaacaatcagtttccaggccttctggcaaagtgggtccacttatcatgcgcatggtcaagttgaccattacaatttaccatgtgtacaaactggacatgcacatatggctccctattggggctagggagaggagataacaatatgggtcctaggatcaaggtttaactaaaatagagttagttatgcacttacttgatggtggctttaccctgcgtggcgcactctcttccaagaccacgtcataagagcaactccagtgtggggcttaaaatgattttaatgcaaaaagatcgaactgtgtacactgtggcagtcgacgcatgcatgtcagagcaaaaatcaaactccaaagtatattcaaactcaaccgagtaaatagttcgttgccctgggccattggcacatgcaggcagggcagaatgtagtgattggaggaacttttttcaacatgggtcccacgattcgattcaacactacagctatcgaaccaaacctttattcaacttcggtggattgtagcagtcgaatcagcagtggagctgctctaaggccactttgcattgtaaatgccctagcagtcctgagttggccgtttgagaaatacaactgaacctgccttgtcaaatggtttagatggtagcagaattgcagttctgtgaacaaaatttgtgcactgattttgtggtagcagaattgctgaaatcatcccctgaagttgtagataactgatagttatgttaaatttctgttatcacatttactcttgatttgttgctattattcttaattgtctactcattattgcatattctttttcaga

SEQ ID NO: 50788 - DNA, 1501 bp, Oryza sativa
acagtgagcgagttaacatgacttggctcattaataagctggtgatgatgatacgcaagcaagcaggcatcatcctggaaatttaatgcatccaaaaatccaggtcctaacgcaaacaccattgaagtacacatttttaatttaagttgtagcgtagtaccaattgtaatattatatccatcctagaagcatccgaacacaataagaaacaaacaaattaagagttgtcacgcgctaggattttgagcggccaagttagagccgtcacttagtgagtaaccttggcctaatcaactttctcgacacctaattaattcaaagagccatcatcttttgttaggctgcttgcgtaatcgagctagtcagcccaggaaatgttactgagttactctaacaaatgtaataccccaacaattttactctttctattctcaaataattaattactctcccctttttaatggataatgtcacgttttactattctccctatttaaaaaaattatttaaataccatttatttcgttgtgatatattttagtattatagaaactttaagtatgacttatactttaacatatttatactattttttaataaaacaaatggtcaaacattattttaaaagtcaacggcgtcatctatttaaaaaagaagatacgattatcattttactcttacaaaggtaacttctaatagttagattgtgatgaaattacaattatatgatcatatttcagatgcaacacacgtcgataatataatattttttttaattatatggtagacgcatacgcacacacctctacgcatgcaacaccactctcactctgtaaatgcgccccctaacgcatgttgtaagagacggaaaccggtgataaattcccaatctcactaaaatttctgttcaaagcgtgttttgagtatatgtaaacttattgcctaaagagaaatggttaaagtgtggatagtattcactaacacatttgtataaaaaatggagacagacaaatctttgcgaactctgcatgtacatttttactttatttgatgaatatatgaatacctttgcctttacaatccttggtttttcaatatttatccctttgaattcattttgtaagcctaatttcctgcacaatttattacagcagtctcccagtctcctctgtcaagccaccgccatactaaaccaaaacgtccaagccaaaccaaaaatagtgaaaatacacacatgcatagtagtaaaaaagtggattaacaacggaccaatttgcaggggaacaaaccggcgtacgaagctacgagcatggcaagctggcaatctggcaggcccggtcaaagtttgactattttgcccacaactcagacgcgccgaaatgagccatcgatttcttcgttataatttaatcttacttttcaacttaaaaaaacatagctaattacgtgcacttataaatatctatcttccgatcctcgcaaccatagcattatccagcag

SEQ ID NO: 50789 - DNA, 1501 bp, Oryza sativa
taactaattcatcttagctccgatttagttggttcaagtctctaaatttttctaagattgagatttacactttaaaaatatccacatgtactgttcatgcttgtttatgtgctgttttggtgattttgctcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacttgattaccttattccttgataccttgggttattacaatttgactagttgagctttatttatattggttcaactagatattagatataattgcttagccctgtttagaaacattagtacacattcgggataactaatgactcactattatttaatgatggtttcatgatagttcacgatggtcaatcgtgattagttaattaattaatgtgccaactaaaacctggtaatggtgggttgtgagcacatggttttgttggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctgatcagagtaaaactattcgaatagccgtgccagcggttatgggcgggtctaacaatgtctttcgtgattagtttcacacttctcaccatagtaaatgatgattaaattggtaataatttgattagctcctggtttggaatggaatattcctggtttggagatagaactgtgcagacggggtggttgttcagaatggttgggcctatacaacagggtatgttgtatagcgttggattaatattgtttaattacttaactgttttattaaattctcaaatgtttgctaaatgctgcttttgcaaatgaaaccctattatgccatcctttgttatcttgtgcacttgcatatttgctgcgtggcttgctgagtatgtcatatactcaccttgcaatcattcatcagaggaagagttctacaatgaggctgatggagtggaggaataggtgtagccttggtcaagctgcctgtggagtggagccgtctgcgccgtttatttattttccgctgcttagatctttattgattgagaggaactatctacctctgtaatgacatt

SEQ ID NO: 50790 - DNA, 1501 bp, Oryza sativa
aattttaaatacactcttatgttttagattttaaagtacaaacaaaggtgggattctgtgaaactttacaatcatggtattactatctaggattatatcctacaagccataacacttgtggttttctacagttttgacataaaacattaggttttctaaagcttactatatgattttttagagatgtatcggtgaaaagttggtttcaatctatcaaaaattagaatcctcttgctcttcttcttggtttctactggtggggttgagcactgccaactctcagtcgagagagatcccgcacgaaaggaggggataacgatggggtggtctacccttttttattttagggagtattatctcctgtataaaaagtacatcttttaatacttaaatcctcgataggggtttccaaaacaagatttacaatagagtttttggttggtgtgttttaaaggcattctcaatgtatgatgcttatatcacctttaagttgggcctctcgtaggtagttgctctgtccataaaaacaagttctaatgtttattaccagttgtcgacggggataaccgtagaccggatatagagggtattggggtacgctggtacgaggatctacgtaatacgacatcaagcaggcagaaaacaaagattatactggttcaggccccttgataggtaatagccctaatccagttgatatgggattatatgatgtaagccacagattacaaagggaaaagcggaactcgatgatatcgacgagatcgtagtcaagttgattcgactagatcacccggcgacttggctcctgtaggctccggcttcgtaggctgtggtggttgtcttggctatgagattcgatgccttaggtcctcccagggagtcccttttatatcgcaagtcagctagtctccaagtaggactcggagacatcggacccggcatgatacaatgacgacccagttctgtctaagtatgactccttccatccgtgaactccatgatgaattcccttaacgtatgccgaaaacgtccgtatgcgcgcaagtataccatatcgatatgtgacgtatgttgaagggtagagggtataccttacccgtaaccctgacaatggcccccgacttctgcttaaatgaactcatgtagccgatcatgacttctgatgtcgaggctgtcgttgttctcagtgtaaggaccgagagacaaggagtgatcgacagcgcccgatgaagctcaacggtcacgagtgaatttaaaccgaagtccaaaaaactgccgcgcgtaacggatccagaaatttccggcggcaatctctctcctttccttggaattcgcaccgtcggaagtacagctacttaaatgagttttggggatcccttttgaagtccgcctattgtgaaaaaactctccagcctccaagcgttcctcatcttctccgctcccgcaaaaaccctagctagcgcatctcggtcccttctccggtgatcttcggcggcaa

SEQ ID NO: 50791 - DNA, 1501 bp, Oryza sativa
gttggtctattcgaggaagagggaagtgatccttgggacacgccttgttgaggtcggtgaaatcgacacacattctccatttcccgttggccttccgcaccatgactgggttggctagccactctagatggagtacctctctgatgaaaccagctttgagaagcttgtcgagctcttcttgtatggcttgttttcgatctggtgcaaatctccgcagtttttgctttactggcttggcatcaagtcgcaccatgagtttgtgctcaatcacctccctgggtacccccggcatgtcggatggctgccaagcgaacacgtcagcattgtcgcggaggaaggtgatgagcgcgagttcctatttctcacctagtgatgccccgatcttgacggtcttgtcggggttggcactggagagtggaacaatcttgattgcgccgtccgatttcggcgtcttgtttgttttgctcactttcttgggtggctcagctgtggcgggtgggctgggcgtgtgctcgaccatgtcgaggctccgcttgtcgcattgcactgccagcttagcattcccttgaatagtgattgttcccttcagtcccggcatcttaagcacttgatatgcgtagtgagatgcggccatgaacttcgggagtgcagttctcccaatgatagcattgtatgttgtatcgaattcagcgacatcaatggtgatctgctctgttcggaagttatttgcttggccgaaagtcacaggcaacataattttgcccaatggtttggacgatgactgaggagtgattccatgaaagggttgatcggtgggtgtcaactcgcttcttgggatccccaccgcgtccaaggtgctggcgaagagaaggttgattgagctgccgccgtcgatcagaacttgcgcaaccttgatattccgaatagtgggttcgaccacgatcggatatcgccctgggatgacagcagtcttggggtggtcctcttctgagaattctatcttctgctcagaccacttcattttgggcacagctccttgccacgtcgaacaaacttcccgttccactttcttgtattctcgctttgaggagtatgccgtggaacctccaaagatgtacgagacatggagatcagagtctgggtatgctgagtccgattcctgagcagttgcctcagcgtccttctcgaccacgcgtactcgcttgcctttttccaatgccatgtgttttgcgagcgactttttgaagacgaggcaatcttctagagagtgtatgtccgacttgtgtatagggcaccatgttttctttgtgtcgctgccttatgggtctgggcgcttgggagggtccgcgtattctgttgcgagaacttccgcttgagctttccttttcccactcttgcgatttttcttcttgcttgactcaggtgcgtccttggctggtttcttatctcctccggtcttcggtttgtcgttcttgtgcctcagtgcgtcgtccgcatgagc

SEQ ID NO: 50792 - DNA, 1501 bp, Oryza sativa
atagtgggttcgaccacgatcggatatcgccctgggatgacagcagtcttggggtggtcctcttctgagaattctatcttctgctcagaccacttcattttgggcacagctccttgccacgtcgaacaaacttcccgttccactttcttgtattctcgctttgaggagtatgccgtggaacctccaaagatgtacgagacatggagatcagagtctgggtatgctgagtccgattcctgagcagttgcctcagcgtccttctcgaccacgcgtactcgcttgcctttttccaatgccatgtgttttgcgagcgactttttgaagacgaggcaatcttctagagagtgtatgtccgacttgtgtatagggcaccatgttttctttgtgtcgctgccttatgggtctgggcgcttgggagggtccgcgtattctgttgcgagaacttccgcttgagctttccttttcccactcttgcgatttttcttcttgcttgactcaggtgcgtccttggctggtttcttatctcctccggtcttcggtttgtcgttcttgtgcctcagtgcgtcgtccgcatgagcacattgtcgaaactagatttcggcaataataaaagggggtggctatcaagctaggaaagtgtatgggtttggagacaaaggatttatacaggttcaggccttcttataaaagaagtaataccctactcctgtccggggatgaatccgccgggtgtattattgattgtatgattcaggagaaatcagcatatgcccctagaggcgcccggaccccccttatatatggaaaggagtccgggttacaaaagataatctatatccctaacggaatatgaaaatataggtaagatacagtcgtaaccgactaagtttcagggtgtttccttgatacacaagttaagaaacaaacccaagatacaaataagatattctatctacattaggtatcctgtacctagttcgaataccatcgccgtgtagatatgggatacccatgatctccacagtagcccccgagtcctttgcagtcgaccatcgtagccttctcaaagatgataatccgagtacttcaaactcttcaagccaaaacctgccgagtggactgtaaagggcgaaaagataaagaatatggtgcatcgaatagatgcacctaattaggtgtagcccccaactatgtgattagttaacaaactaaacatatagttgaaagacaaaataataacacaattgtgcattatatgacaaaagcatacgcggcgcctaaataggcatgctagccgactgctttttagccacaataaaagaaatccgagtggtttacactctaaaaggttcacgaatgaacacactcgacaggcatccgaatataaaaactctaaagattacccatcaagtattataaagattatggtaataaataagtcgaatagcctaggccatgactatttaccatgaaaacaggcatataacacgccaaggaaatg

SEQ ID NO: 50793 - DNA, 1501 bp, Oryza sativa
ggcataatagggtttcatttgcaaaagcagcatttagcaaacatttgagaatttaataaaacagttaagtaattaaacaatattaatccaacgctatacaacataccctgttgtataggcccaaccattctgaacaaccaccccgtctgcacagttctatctccaaaccaggaatattccattccaaaccaggagctaatcaaattattaccaatttaatcatcatttactatggtgagaagtgtgaaactaatcacgaaagacattgttagacccgcccataaccgctggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaaacagggctaagcaattatatctaatatctagttgaaccaatataaataaagctcaactagtcaaattgtaataacccaaggtatcaaggaataaggtaatcaagtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaaagtgtaaatctcaatcttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagagggtttattgcgtcagcgggctagggtttggtgaaccgggcgcacgggcggcggttcacacgaacggacggccgagatcgaaccaatccaaaacggacggccgagatcgatcgggtccacggcggctcacggcggacgaccccga

SEQ ID NO: 50794 - DNA, 1501 bp, Oryza sativa
aaaatcaatacttaatctaaaactggacacactttttattttaaaaaaggacttgtcacattggactaaaaaaccggttaaaatatcgcaaaacaatataagttggttttgataaattttcacatttaacaaataatatgttaagttactttttacatacgttctctatcctaaaacaaactaagattatggaatgtgaataaaccaatttagtatgggatataatattttgaaacgtaaaggtatatcgttgagacgaatgcgaagtcacattagcataggcttgagagcacaagatctaggtagagggctatgaaagaattgtacaggatatagccatataggtagtggtgacaatagtggatgggagactttgactggagtgaggaattgttacagaatataatctcttctcacctttgaaccttttgtcagttcctcgacggttagttgatctaagtgaaagtttaagaaaagtataggtgaaagaaattcaataaagagaggaaaaatggggatagacagagaaagtgtcaaatgtactagataccgcactcaaatatgtggcaaacttaccattacaatcaactactcctatatgacaaacacattgtattatataatagcaactttactataccaaattttgtagtttcccaaactttgtactaccaattttttttagaaacaaaacacaaacgctctagactggaagactagaccgacatactgagattaatgaattcaccatgaacaccttactgttgacgggtacatcgtttatcaataaaaaataattagccataaataaaagtaccagtgtgaaatctagaacttgaactcggttggattggttacaccataagaaaactaattagttaaactacactcacttcgcttcgcttgtactactaaaatttgatagagcatgaaaccaaatggctaaattccacatcatccatccgctgatttcacattttaagtttgtaatgatttgtcacgttttctatgtcacgatcagctcagctggataagcctgattaaacgcaaataatgggacttccactaacgtcaccaaacagatcaattcataatatatgagagggccttccctaggcccaagatctggaacacaaattatactacaatctctccgtgaatgaatgaaataatgatacgagtgtctcctagtgcctctccaacccaactagccaagtgacccagcagcgtcgcgcagatgttctgagctcaccgatgtacgatcggatcgagccagcagcagtgccggatcaatggccaggggaaaaaagatcagctgattattggttcgtacatattcacacttattcagtctttactgatggatttgattcaactaaatttatggtataaatctgatatttatttttaattctagccactgcattctttcttcctatattttctttttatttttgcatcagaggacagcaacaatcaaacattattgatcctgtatgta

SEQ ID NO: 50795 - DNA, 1302 bp, Oryza sativa
cgtagacgcccaacagcggtggtgtgactaaaccagccgtgtaggcgaaggcaccactcgccggcgacggaggcaggccggcggcgaagtcgtagacgcccaacagcggcggcataatagaccagccgtgtaggcggaggacaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtggtagacgcccaacagcggcggcataataggccagccgtgtaggcgaggacaccagtcggcggcaacggaggcaggccggcggtgaagtcgtagacgcccaacagcggcggcataataggccagccgtgtaggcggaggcaccaatcggcggcgacggaggcaggccggcggtgaagacgtagacgcccaacaacggtggtgtgaccaaccaaccatataggcgaagacaccagtcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccatgtagacggaggcaccaatcggcggcgacggaggcaggccggcggtgaagacgtagacgcccaacaacggtggtgtgaccaaccaaccatacaggcgaagacaccagtcggcggcgacggaggcaggccggcggtgaagtcgtagacgcccaacagcggcggcataataggccagccgtgtagacggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaaca

SEQ ID NO: 50796 - DNA, 1501 bp, Oryza sativa
gttcgacacataacttttgttttatgttgctgtatgacaagtagattaatggtgtttttgtcgttggtagatgatttctctataaaaatgtaaagataacctttcatgtgtatcagcgcaggggcggaatcaggcatggggcagctagggcttgggccccatgcctagctccataatccctattataatcttgaaaaatgctatgtaatttatgaaaatatttgagatcccattagctcagccctaggcgtggaaattttctggcaacgccactgtatcagcgtgatattttagttgttgccttgatatgcccgaatagcaaatcatgtccattttgttaaaccttgacatcaagtgtactttggatcatagtcttttaggtcttttttgggctggagttatgtcttctttaactattgaatgaatgaatttacctgcagatgtcacgaccagagtacaactcgatctttgtcaagaagcctgatctagatgggagatggccaggactcatgtaatgtttgtgtagtgtgatcaatgttgttctttttcctcttgcccaaagtacacttttgaggtgcttctttgacttcagttcttatgactactaatgttatctttcaagatgatgaatatagtttttgatgaattgccttctttggttttctgaaagaatcatttgcttaatgctattggcatggtttcttggtatgggtcttgattcttcttgtttgcaagcttaccgctggaattttgttaagtgtcatgctgaagttactgccaacagcccttgtttgcaccatgttgctgtccaattttatgggtgaattgtgatagccatacccatcagtcctgagagaagcttggtgtttgatgttttgataaccttgcttcttttgttaaggccctgtttaaatcccaccccaaaatttttcaccctttcacatcgaatgtttgaagacatgcatggagtattaaatgtggacagaaaaaaaaaccaattacactgtttgcgtgtaaattgcgagacgaatcttttaaggctaattgcgccatgatttgacaatgtgttgctacagtaaacatttgctaatgacggattaattaggcttaataaatttgtctcgcagtttacaggcggattatgtaatttgttttgttattagactatgtttaatacttcaaatgtgtctccgtatatccgatgtgacacgccaaaactttacaccctgaatctaaacaccccctaagtcagtcattttggttctgagactaattttgtcatgaaacctgtcctgttaggcttatagttgttgggtcagctattcaatgttgcctatttcaatctttgcacctcctctcaagttataactgtactgtaagtttatatggttcactgtaaatcttgccttctcgaccacctcttaagaatggtaaatttctatatgtatgtaattcctgtgaaaagaacagaaattttcatcttagtcataggctcatattg

SEQ ID NO: 50797 - DNA, 1501 bp, Oryza sativa
tttcttcccttgttttctagatggacattatgtaacacctaatgatctccaattctccattgatgatgagagacatgtgctgtgttagcaaaaaatattttctccctaacaggccccatatgggtagaggaaagaacaaaaaaaaaagggggtccattttatatgttccattcatatttctcaatcgaaaatcagatatcaattgtcgttaaactgttaaaactagtataagtctaaaccagtgtaagtcaagttgcaaaatcacgatgtggcccgatttaattctgcctgggatgctagagatagagtagaggaaacggatcatgatgctaggggaaggggagacaaggagctcgagctaacgtggctgcttaagccaatcgctattcatctgcgtccaccaagggtagaggaggaggaagagatgttaatgacatattggtcccactattttctttctaattgtattcatccaatagacgtcacgtaggagatgacaaccggttcaatacaccatgtgggtgtcacgttaatcatcaaaaagcaccatccgaaactatctatggattttaagggtgtgtttggttgtaggcaagttatggtagtcacaaaagtgtggtgaataaattgctagccacagagtatggtaaaattggtaagaaaattaagtctatgacatatatgacatgctgttgaaaaagtgtggcgagtcacaactgtgacagtgaactaaacacatatctaacaaactgtggcaataaaaaatgtagtgtggcaaaatgtggccatgaacctaacacccctgcatcagctttaatttgctgtggttgaattatcggtggggagaaggcccagttaatgctacttgtcgtctcctttaatttgctatagtccagtaggacatcctaggtactcactactcagtccttcactcctttgtcgtcgattcgttcgtggtgctcttaaatatcttcgaaatatagggcctgttcactttggtgtcattttcaaccttactaaattttagtaaagttgccaaaaaagtggctacatttagtttgctgctaaattttggtaactatataagaaatcttgccaaaattttggcaagttaccatgccaaaatgccaaaatttgataaggtttttttttggcagcaaagtgaacatgcccatatatatcacgggttaaggagatggacggtttggatttcgctatcttttgcaaatcatgcaatagtttgtttttgttttttgttttttgtttttttttcggggataattgtgccatagttagtggcctctctgcctcactcgacatgaacaagaacagcagcagcaggaggagacgagggcaataacagcagcagcattttctgattcttctcaattggagagagtgctcagtgctctcctataaatcctactagcactagcacacccaaagcgaccaacgagtgatccgatccgatggacagtcgccgtcccttgcttattccgaa

SEQ ID NO: 50798 - DNA, 1501 bp, Oryza sativa
aagacagtagtaattagggatgaaaactactatgaatctaaatataccttagatttgtagcattaggataagtctaagagccattttgggttgctaccaaaacttagccctaccaatattttgttagtttaaatagtacatgtgtttagtttggactaaaaccaatttattggtaatgcccatgctagatttgacatcaatatctagaacaatcttaactagaattcataagttggctttatatgatagcaaaccaaatataatcttaccctaaaaaaattagtagtgtcaaaatttaactaagttttagcactgacaaaaaaaaatgcaatggtagcaatccaaatacagcgagagtacaatgagtgcacatgcagtctgaaatgaccgaatcgtgtatgcactgatgcagcagaaatcaagataggaatataggatgaggagttgtagatgcatgaacacaagcaagatgagcactcaatggatcagagaaaagggtgtgtgataagaggatgggtcggcaaaagtgaacgggcccggcacggccgtctatcatgtgccgagatggtgaaaattccttcttcgttttcttcttctaaagttgtgttggacccccttcactggagtgcaggaaaagggcgatcgacagctgagtgcgctcctagctactcctaccaagatgtgaggagcgtgcacactgcacatgggctgtaacattggcacagtctgattcaattatacaaaccaaatttaggatttatagtttggtgactcatgccgtttaaaatggatgttgttcaaagtgaaacaacaatggcaaaattatacttttccacctaacatttggcttgtcttatccagacgcttttgccgaaaatttgataagaatccttccaaatctacggaccacaccctactaaattctcctcggtctactgaattctgcaaatcagaaaaatccaaacgggaacagacaagctgcttggacatcacgaatctccgtatagtttgggccagaatttcctggcccatctaagtggccgggtgggatgaggcccatcaaacgagcccagaagcagctttatccgagcagaaccagcccagttcagatcatatgggcctaaccacgcacgtggcccatttatcccagcaaatccagcccagtttggaatgccaggacggcccacccatacaacttgatccggccgtccgcttccatctcacgagatcctagccgtcgattcgaccaaggccacgagcccgctagggtttctccccccgtataagaacccttcgccatcctccccaccgccaccgccgccgcgtcttcttcccccaaattcgtcgctccgcttccctctccgatccgaaggtacagcgtcagttcttgcccaggaatcaagatttttcttcacgcagctggttggatttgttgcttgctgcatcgtcgatctcgtctcttaagttttttttgtttttgttgtttttggtggagcagaga

SEQ ID NO: 50799 - DNA, 1313 bp, Oryza sativa
catgtcattgtcttaaagtaaattgagtttaagtatcatggtttgacttgcttgatcacaggtgttggtgctgagagatacagacaactacttatgcttatttatttggtagtctccaaaaaaccgtcacatgattattaaaaaactttcaaatgtaattgtactataattagttgtaacataatttatatataacttaaatatatatgagtgcttagcgacttaaaaacaaatgcaaaaaaactatattaaaagaacatcaagatcaacttcaaacacaaattttaaaatttaaatttcaacaacggcttataaaccatagtgcaaacgataagaccctatatcaaatcagtactaccaaataatacctctgttttatcactcaatttactttaagcatgatttatatcttatacatttacataaaattttagaattagatgaatgttcaaacatatatttaaaagtcaactgtgttgtatattaaaaaaccgagtgagtactcgagtatacaagtactccttccgtcccatttcaagtataaccatggtttttcacgtctaactttgatcgtctatcttatttgaaatttttttaaaaaatttaaaaacataagttatgagtaaagtactattcatattgtatcaactcatagcaacaaaaatactaagatcaaagttgagcgtggaaacccatggttacacctaaaatgaggcagatgtagtataataccatttgtcactaactcggttccaaaatacggtcttgtttagttcccaaaataaaaacctttcacccatcacatcaaatgtttgaacacatgcatggagtattaaatgtggacaaaataaaaaatcaattatacggtttacgtgtaaattgcgagacgaatcttttaagcctaattgcgccatgatttgacaatatggtgctacagtaaatatatgctaattatagtttaattaggcttaataaatttacagttttctggcgaaatctgtaatttgttttgttattagactatgtgtttatgtgataaataaatccaaaatttttcatcaactaaacaaggcctacattgacctgtcacagaatcttcagagaaggaaaaacaaaaatcgcagcaaaatcggcctccatttggaaagggaaaccccgttgctttcagagcagcaaccaaaaaaccagccggcctgagctcagctgccatttccgacatcgcggcgggcgaggagcagcagctgtgcggttcacactgcctccgtggtcccggtccacgacgcatccacccatttaaaccccacctcccctct

SEQ ID NO: 50800 - DNA, 1501 bp, Oryza sativa
ctaacatacacatacctcaaagtacttcaagatgtgatttgtgtattacataaaataagaaatagaattttttttagataataaaataagaaatagaatggaaatgaagaagaatggtgttgtaaaacaccggcagtcttatccctcaagcacactgcagacatccaagttaattgtattatgcacaagctacatgcccctacaagtactttcataaaggatgagccaaatctatgcttttccttccgttttgtatttattagttattgcagatctgaagtgaaatgcaaaatgcagggtctatttgtatatgagaaaattaggtattgtatgccaaatttgtacatgcacgataataggcactaggcaatagtcatttatgcatccttataggcactaaaatactagaccacagaatatagcatcagcttaattgtctaccattacttctgaacaacagaaaattgatggtttttggcaaacctattgcctaattgtttagccaaaagtagcatttagaaaaggaccatcgatttctttagaattcaatggctcacatccgtttcaggtttatcctcgtggataattagatctgcctaacatttcaccatcttcttatcagttccttgttttcattaaagagatctgcattttcgtgcatgcattatgttgagattcagagagctgccaatattactcctattatcaggaatagaaagcccatgtaggcttttcttttaaagaaactacatctaggcgcacacgcatgacgcatccatactcaaatattatcggaggcatcagataccaccccgcaaagcacagtcatgcaacacactaaagtctacatcgatacaattggtgaacgccaacattaaccgctgaagcggcatatttgcaaacgaaaaataatttatgaataaagcttgtatataggtgttcttagcgatctaaaagtaaaggctagaaaataaacttcgatgaaaagaccccaaaatcaacttcaaatttaaagttaaaaatttaaattttggctgataagcataagtataagcgaaaagatgaagccataaatctagaatctgaattgtaatgagtttgtaacacaattgtactacttagctagcagaccacgggttaaccccatgaagattcaatctcacggctcccatgactccataagctaagaaaatagtacaacaaatgagatagattatgttttcaaaaaaaaaatgagacagactattgattagattaatatcgtggattatctacttcatcgtacaaatatattaaatattttgagaaataaacttaacaaataatttagaataaatagtctcagcaatatatgagagattttgtttttaagaaaacatattttagaagagttggtcaaataattcacgataataattcggtgaagtcattatctttttaaaaaaaaaatcggtgaagtagctggtatgaacatggtcctctcacacaattacttgaaact

SEQ ID NO: 50801 - DNA, 1501 bp, Oryza sativa
ccctgattctcagttacaccgaaaatccatactactttaacaagactctaataatgataacagtgaatctgtcactccaactgcttccatcgtaaattttacaaaccattcgatgaacttctttatgttaaaaaccaatcaatctaaatggatagcgacgtatagaatcaaattgagacaaatattttccatagcagaacgacgggtagaacatttcaccaaaaatgcattttatccgtagtaaaacacgggctttagctagtctaccaaaattctctactaaagcatgtacatgtgtgtgtggaaatatatttaccactgcctttatcttaaaatatgctccaataactttgtctcggttcatagttgctatattagctattaataatttggataagtcagtatctagattaataattaaaagttaatacttccttttggaaagaaagttgaattcttggctatgaacttagacatggcacatgtctatattcctagtcaagattcatttgttttggaattgagggcgtgtatatctaataggacatactctctccgatctttccgtttcaggttataaaacgctttgactttaatcaaagtcaaattactttaagtttgaaaaatataataacattttcaacccaaacaaaatttattataaaaatatattcaattattgatttattaaaactaatttggtattaaaaatattactatatttgtctataaatttagtcaaacttagtttgactttgaccaaagtcaaaacatggagtaaatctgaacatagctatatccatatttatagctgaaaagtgagtactattttgggaaaaaaatacatagtactacctccgtttcaggttataggactttctagcattgtccatatttatatagatgttaataaatcgagtcacatatatatgtttagatttatttatatatatatatatatatatatatatatatatatatatatgaatgtataaaatgctagaaagacttgtaatatgaaacggatgaagtattattagtatatcttgttaattgctattgcacggacgtattactgcaaaggattaatcctcagtaaaagctggcatttacactccctcccaacggtctccagctagctgggctggtgaatagcgtaaacaaatgcaagctcacatgcacactctgttcagacattcatagttgcacagtccttgtacctactgcagtcactgttgccaacctcactgacaagaaatacaagacaaattcatgggtaattaccccccggcaacacataattatatcgcaaatacataatcaaatccagataacgcaactgcacagtgcacactcttccctgccaacgcacaggatgttaaaacactgtaccacactgatccggagatccgaaattaaataaccccaaattaccaccagatcaatggcatgtacaacaatagtaaaatcactgtactaatctagtgccgaattaacaaca

SEQ ID NO: 50802 - DNA, 1501 bp, Oryza sativa
tgatgaattacgttcatggggtgccagcaaaaggaaacgaataaatggaagggcgcatttaataaacacatagcaaaaccagatttaccaaactagatcaaagtcaaatgaataaaaacaaattagggattccgtaccaataacagacatcagttttcggtatctcttcacactgatctcgcttaggagaggaggagagtagtttgagaaggcagattgttatggtataaggcaggcatgcactgctgtgaacattgatgattcaggcagcagtgttgaatttgagggaggggatatgatggaagagatataagaacatgttggggatcaccagatgaggttgattgaattcttgcttatttcctcctctgcattggaactggatcaatttacaagggaattttgtttatccttgatttcttaccatgtataggaaatgatttctctttatgaggcccctaacaatggaaaattaaaggattgtctaaatgctcccaacagatatgcttggatgcaactacacaacatagtcctttagcaatcatctacgctgctggccctgccatttatgcaccacctcatgggccatagcatgacattctgctactgactttttgtatagtcactgcatatgaagttttccttagtgcataaatttctatatattaatcaccacttaagaactgtggatcatgtaagctttattcaactacctccgtcccaaatataacaacttccggctatgaatctagacaagcacatgtccagattcatagctaaaaatgcttaaatttggggatggagggtaatacttaagcatggtacctggattttggattagtgggctcttacggtctaccatgatgatgtactgattactatgtctctgtttatccattaaagtttggttacttcatttcattttttttgtttcaaatacttgtatgtgctgataaggctttacttcaatttattatgtcattttttagcaacaaccagattttcatcttttgtctgtattagttcagtttaagtggtgactgttaattacagagcgagttgcttctcttggttatgtgtatttgaacgaaaaatttagctagtataatctttttctgagggagcagttttgggttgaaattggtcattgagaaaacattgcaactgtttgaaactttgaattcaattttactttctcctttctgatgacaccaaatgctgtagagctcttccgtactgaaggtgttgctagtgattcatatctctgacccatttggttcgaccaaacttccaaactgtcttttgcatggagtgaagacaggcattatgtaaatttgatgtgatgtttattagagagtatatgattcttataagaaattaatgtttgctcttaattttattttcaacttcccaagtgtacacatattattctgattctttactcacttgagtttttttttttcaaaccaggataggcaacagagtgctttgctaattgcta

SEQ ID NO: 50803 - DNA, 339 bp, Oryza sativa
atccgtaatcgatagtgtactaatccattttggtaagcattcgttccgtatttttgcccgacattatccgagtttgtatctgtatttggcactatccatgcccgacccgattccgattataaaatgtgggttaggatatgggaagggtaagatccgaaccgtacccgaccgatttttacccctaccaacaagtcgttctctcgcctactgccatcatgcaattaccactaagataagagtctgactatatttttatcctaagacctatcaactccatgtcctaatttattatcgataatatatatatatatatatatatatatatatatatattcaata

SEQ ID NO: 50804 - DNA, 1501 bp, Oryza sativa
attttgacaagggaatgttgctctttattacttatccattttgaaatatagcaccctacatgtaacattatactacctccatttttaaatgcataatgtttttaaatatcaccacttattttattaaatatatatatgtaaatataatttattatgttatgacttgttttatcattaaatactttaaaaatggcttatattttcttatgcacactaaaattttaaataagatatatagtcaattgtgaagcatgaaagtcaacatcgtacgtgacaaaggaaaaaaatatgtgttgttaatacattttctaatcaaatattactgtaatgtacgcctccctaaaaaaacaaaacactttcaggctcatcctcgtaagttatattttttcgggacgatggaatataaaatacgagtattttattatctacaaagataatatggccttatccgtaaaaaaaaaatcaatctaggagtgaatataccccatataacgaatctggagtcccgtcctatcagattggcacagctccatctcccatataacgaatctggagtcccatcctatcatattagccaaacagtttcgattttgctatatctcactcgaaagattttttcttatctctcactcgattttctcactcaaatttacagtgcattttcttgtaagttacagtgtaatttataaaacttacactgtaacttttgtaagttacactgtaatttttgaatcttcacatgtaaattttaaattttgtattggatttggtctttttcttgaggatatggtaatttaatattcattatggtgtttcttaattgctttttgctttttattatatctatcggattttaatataaagattaaaaatctgtgtgatacgattataaaaatctttcgaaagatgtataggtactcccaacagttttgtggagctctatcacaaaataaactatagagttgtggagctgggtttatgcagcttcacaactccactccagaccctgaagctaaatttaaaagttggagttgtaccaaacaggccctaagtttttttacggaggaagtaaccacaaagttatgcaacaaatcacctataaacatcctgtcatatcaagataaatcatatggcatcatcagccgcccaacaataggcataagccacaacgctgtggatctcaaagaaaagtcatgacaatgtgcatcaccacaccatcagctgcccagcatcaattcttccaaacgatccaataatcccttccccctccccatccaaatcaccttttaattattctgcgtccgcgatttcgcaatcacccgaattcatttcgtgttatccccaaatctcgcgtcatctctcttgacctgggccaagcaatcgatcatcccgatccactcgggctttaaacaaatcgctgcaaatttgttgttttccccttaaatttttatgccaagatcgcttaaattcaaccggccaggtggggatttcctaggagagg

SEQ ID NO: 50805 - DNA, 1501 bp, Oryza sativa
gttcatgatgatacaagaatactacgagaggccccgtcttgttcagattgtgttttgttttgatttggcctccactctttcctcggcacttttttgtgttgattcctttgtaacctattcttttctctcaaccacctatgagaagaacacgattgattattaaaaatcggtctttgtggcaatgcccataatggataataatacaatatataagtgggcatcatccatgtaccattgaagctccatggtgcataccaaggctaataccatgaagaaggagaagtaggttgtcgtcggtggtacgctctcgcttgtctcctaccttgcttggtaaataacttgatttccttggttgctcatcttttggaatcttcgacttgtcatattgccccccctgagttttgaagtcttcaatgtggtcttgtcctttagcaatccaatggtgcgtataggaaaaggtagctcatccacttgcatttttgtaaaagtcaatcatccttcatcaatggccaattgaatttgtctacggaatacattgcaatgatttgtggcatgagaataagagttgcgccacatacaatatactcaccgcttcaattcctcaagtgttggtatgacacggccttgtgacaatttaatttgattcttttctaataagtagtaaaaaatcctatcgcatttggccatataaaatgtgaactttacctcctcttgccaattcttgcgaccaccgacttaagagaggaccaaacgaatggtttagatttggagttccaagcccatttggttgtggatacaacaattgtctcatcatccgaagatttttgttgatcaactatattaacatgagggtgatcagacctgacattctatgcgattttggcttctctaacgcggctttctttagctagagcttttcgaagtaattggcttatatctaagaaactatgaccatataacttttcttttaaatattcaagtaaaccagaataagacaaatctatcagaaagtgttaaactataacatcgttttcttctgtttctaaatcttctaatgtattcaggctcattatatttttgtttaaccgattttaagtgcgtcaaatttaattcgaactcaccattaaagtagtcatgaaaattttgttctagctgagaacaatcatgaatagagttgggtgcaagtgaaataaaccaagtaaatgcagcacgagataaaggcaatgaaaaaaaggcaaagtttcaaaatactactagcactagttttaatatttgtttattgcttattgcctagtagtagtgctactatcaaatgatgctactacccactttactacatgttgacatagaatctagttgccacactttgagcacgttatgtgcaaccctcggcggctcccaaagatgcgctgccgtagggagtgggtagatgcttccgaacgaacacccgggaggtacctcatcagggttgtcggtgacatggagccgggagtatcatgac

SEQ ID NO: 50806 - DNA, 1501 bp, Oryza sativa
gctgaatttatgtttcagtaagaatcttttctgcatatcatgtgaattgcatcctaaagtaatagggacaatccacatgccagaatcagaggatccatctaataaaaactggtcctgcaacaaaaaaaaaagggtcagcaattcatcatagcaaaatttatcattttgttgctgaattttgcatgtatggataatgttgagttatgtatgtgttggcccatgaggcccatatactactcatatgtacatgtatatagcagagttagagaaatgaaaaaagtagtgaagcttctagagaaaaattcccaaaacttcatggtatcagagccaatcggctggtggctggcgacgggcgacggctaaaccctagcctcgccggagcttgtcgaggcgtgcagagaggtgctgagggagctgcgctggcagagctgcgcgtgtacgcggcgcaggagcgtgtggagctccaggtgaggaaggaaacgctggtgctggagctcccggcgaggacgcagcggcgtcaacggcggcaggcagagccaacggcggccgcgcgcggagggagctgctggttgtgaggacggcactgctggtgctggtgtgaggatttggtgagctgctattgctgttctgttgctgaggcagagaagatcgagctgaggatttggtagtgtgctgttgctgctgaaaggaaaaggggaacacaaatttggtaagtgtgttgttgctgttgctgttgagcgagcagaggaattgtttgccggttgtgctattggtgtggcttgtgtgtgctgcggcaaggaggtgagcttgtgagtattgtactgctgtgtgtggttgagaaaggaagaaaaagaagggagtattgctgctggatctgttggtggtgtcgtgtgtgctgaagattacaggtgcagagagcaatagcaggtgaggaaagctgtagctagcttcatctagaagggaagaagcggctttggtgttggaaattaattattgtcaagaagtaaggcaacaggttgtgcaaggtgaatgtgaagttagtgcttcagattggcaggcaaccaaccaaaattcgtgtatgcgagaacacagtccaagcctcggcagtcacagagagggagaggggtgctgctgtgtcgagttccctgatcaggaggaaagaaaaccaggggacgttgtcttcaaggtgttagaatagagtgagtttgtaaaaaaaaaaaaaaaaaaaaggaatggagggaagtcaaggaattgaacaactgcttgcgaaaatggctgtagaaatacaagaaataagggaaagaatacggaaggagagggagaaaacaacagttcttggcaaccttgtcaacctcgcgcatcccatgcagatgcaggtacctcactcaacctggatattagactctggagcatctagacatgtaacaggtatgccaagtgagtttgtgtcatttactccatatccacccacatataaagaaactgttcagactgccgatgg

SEQ ID NO: 50807 - DNA, 1501 bp, Oryza sativa
actggctcggcgggccgctgagctcgaggcgcgggctaaggagctggacgcgagagcgcgcagcggtggggcggccgcgggcgacagcgacttagccgcccgcctcgcagctgccgaacacaccatcgccgagctgcagggcgcgctggactcgtccgccggggaggtcgaggccctccgcttggcgggcgaggtagggcccggcatgcttcgggacgccgtctcccgtttagaccacgccggggggcaggcgggcctctggggcgagcggaccgcgaagtacgccgccaaccaggggggcctcgcccagcgcctctcagagatggctgggaccctccagcggctcctcgaggagctcgagaagacgatcaagtcatcctcgagagacctcgcccggggggcagtggagctcgtactggcaagctaccaggccagggaccccgacttctccccgtgggcagcgctggacgagttccctcccggaaccgaggacggcgcgcgcgcgcaggtccgggacgccgccgactacatcgtccacagcttcgagggtacggcccctcggctcgcgttcgccctcgactccgacgaggagggcggtgacggtggtgcggatgacagcgacgacgaggctggcgacccgggtgcgtcgaagtgagcccctagggcccccgccaatcttaatagctttttcctttttcttctgaggccttcgggctcccttcttgtatagactaatttaatctgcaatcaaataaagatgaaatttctgtgtcaattctatttgttgcgtgtatgagacgaggatggtctgtgccgcggtccttctgcatcttggcttgaacaagggctcgtgcccaggtcccagcctcaaatggcgcgggtcggggctagtgcctgggaagatccacgtgtcgagactggccaggccgggaacgtggtgaccgagggttatgggtgacccgattgtgggcctttgccgattcccccccggagttcaccacgccccggggcacggctcggttctgggccccttttggcgattttagccggcccgggccaccgagggcaggatcgagcacgagcgtgctaattcaagccaagattcttcaaaaggaaacaatggcacagacacattccttaggaaatcgaaaatgcttttattgaaatatggaagagaaaaaaggtaagtatatatgcatgtggtagcccccggccaaccctgcacgtccgggggagtgcggggttggcccgagcccgagacctgacacccgactccgactaggggtagaagcgtcgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgatgcagagtgatcgggcccggacgtggcgctgatggtag

SEQ ID NO: 50808 - DNA, 1501 bp, Oryza sativa
cgtggcgcgcggtggcgctggtggccacggtggcgtcgtgggtgtaccgcacgggcgtgttcctcctggtgtgcgtgctgttccgcctcacgtgcgagctccagatcctccgcttcgaggggatctaccacatgttcgacgtcgaggcgcgcgccgccgccgccgagatcttcgccgagcaccgccgcatccgcacgcagcttctcgccaccagccaccgctacagggcattcatcctctcctgcctcgtcaccatcaccgtcagccagctcggcgccctcgtcgtcgccctctcctccaaggacggcaagagcttcgccaactccggcgacctcctggtaacaccacacagccactccgccgccgccgcaggcgtagcaatcacgacacgatgcttataccctcgccgtctcgcaggtcggctcgtcggtgcagctcagcggcttcttcatgtgcctcttcggcgcggcgaggatcacgcacagagcgcaaaggatcgtgtccatcgcgagccagtggcacatgagcatggaggccgtggcgcaccacgccaagtcggcgccattgccggcggcgcccagctcgtcggccagcgacgtggacgcgccgcaccaaccggagctcgggacgacgacgacggcggcgtgcgcctacagaagcagacacgccctcggtaacaccagatgaacccccactcgcgccattttttttctgagatttaaattcactcgctcgcgccattttttgtcgttgcagtgacgtacctgtgccacaacagcggcgggatcacactgttcgggttcacgctggacaggggattgctccacaccatcttcgccttcgagatgactctcgtgctatggattctaagcaaagtcctctcttaattaattattagctcgtgttaattgttaaaatttcctcaccagtttgcaagaacgcaattatgcaatgtgtcagtaaatgtttatgagtgtggtatgtttcagcaattggacgatgtacatataatcgtctactccctccgtttcatattataggtcgtttgacttcggtcaaaatcaaattatttcaaatttgatcaagtttgtatagaaaaagtaataatatttttaatccaagataaatatattatgaaaatatgttccattatcatttaattgatctaatttggtgttgtaaatattaatatatttatctataaatttaaattagtttgattttaaccaaagtcaaaacgacttataatctaaaacggagggagtatcattctgaacttctggtgtataaatgtaaaaaaaaagattcagatcatgtggttggattagtaatgtggcaattctgaaattgacaggttgaatttgctaattgaggtagtaagtccaggttagtcgtagctgagagagagagatggttgaatttgctatagttaggcagcaacagcaacggccacagccatggccatggccatgcggccagctagctcgacgccccatctctc

SEQ ID NO: 50809 - DNA, 1501 bp, Oryza sativa
atgaaggatggtggtcctatcttgtcagattgtaccatcgatgtttttattttaaagaagtatagatatagtgtttttatgttgtataaataaggtcttgtctagatcccacttcaaaattttttaccctgtcactcgaacgtttgaacacttgcatgaaggctgtgtttagttcagcgcaaagtttggattttggttgaaattggagatgatgtgactgaaaagttatgtgtatatgacaggttgatatgatggaaaaggactgaagtttggatccaaactttagatctaaacacatccgaagtattaaatataggttaaaaaaataactaattatacagcttgcggccagacgaatcttttaagcctaattgctccatgatttaacaatgtggtgctacagtaaacatttgctaatgacagattaattaggcttaataaattcgtttcacggtttactaaccaattctataattagttttttattagtgcccaccctatacgatattctatataatatctgatgtgacacgttaaaattttaaaccctggatatacacccccttaacgcgaggggagtatagcaccgagggcggcgagggacggatgcacggagcgtacgtacgtgcgtgcgtgtgtcacacgcgcgcgcggcgacggtgcggacgtgagcgatcgaggctgggccgcgaccgctctatacctgcacaaaagtacaaattagcatccatctgactttgcaagagtccatgccagtgtgtaggtagacactgatcaggccggcttaattaattaagtaaaacccacaaatacgacacactataatctctaattatattactctctccggttccattgctcttaatgttttgaataaggttgtattcaaacttttaaaatttcgactgaaagcactagaataacatatatatagtccctcttagtctttactattagagtaaatacttatttgtatttatttattgtatatgtcataatagacaatatagttaaagatatacttcaaaaattatgtcgttctccaaaaaattaagaatatcgaatcggatgaagggagtagtactgtctttgctcgcgtttgaagatatgaggattaattatgtgcttgcagatatgtagtatacacgtacgtataaccccaacgctccgtattgacgcctactaccgcgtcactcccatcgatcggcgcagtttgactcttgtaccagagtatgtatatcgatttccattattatcgttggtttatcatcatacttgttagatgataagaatagttagctagatagattggttcttatcttcagtttgttgtaactaacagagagataggataagatctctcatcctttgtatgtaccacgctaggggttattcctagcctatataacatgcaggcgtacctggaggaagggtatcgcttccatcacatggtatcagagccttccaccctccaccaatcaatctttcaatctaatctccc

SEQ ID NO: 50810 - DNA, 1048 bp, Oryza sativa
ccgaccccctatggtgttggcgccacgtgtgtgggttaggtgagcacagcggcgctcacctaaccgcacttattgcgggttggacgagcgcgccacgccgcatttaatgcaagcgcagcgcgctcgcttatccggtccgtgaccggtcgcagtatgtgaccggtcacagaccggtcagatcgcgggttaggtggcaacaggcggcctgacactcgtctcgccccgtcccgtcggaatgatgagagcctccaggcactcgtccctagccggagccggcgtggtaactcctggagttggcacgtcagtcccggccagattcatgccaggcttcatcgcaaccattgcaaggaagtcattgtatgaagaaggacagatgtgcggcatgctaaactgacgcgtggtggacaagaatgaccggtctgtgactggtctgacgccggtcacgtcatcggcagacaaaccgtgctcccatgttgtatttgcttccagcgaagtggaggtaggtatgacccatcccatcggagggtcattcggagcagccattgtaaatcctcacccaaaagaaggggaggtagaagtggtgcatgtggtatccccttgagatataaaaggaggaccttacccaccgaagaaagggatccgggatccgggatccgggaggaggagaacttagagaatacctgagctgatagaggagagaaagagaaagaggggttctagagcctgtactctcttgctttccagttctctgtaaccccttcacacacagatccaccagaacacaggagtagggtattacgcttctcagcggcccgaacctgtctacatcgcccgtgtctcgtgcattttctctctcgcgtacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgccccaagcttctcctgttcagcccaa

SEQ ID NO: 50811 - DNA, 1501 bp, Oryza sativa
aatgattataaaatttaaatataagtttatttgatttttaaaataaacttctatataaaagattttgcaaaaaaaacacacgcacaccatttaacagattgaaaaaaaacgtgttaatggaaaataaagaagttacagtttggagttagggcaaaagtaagtatttgttattgaaaatctcacaatatatatgtataagcaggcaatacggtgggttccatgaaaatataagaatctagcagaagaactattttatttctctatttcctggttttaaagaaaagaatacagccttagttacatttaagctgcaatggaaataaaaacccacacacggtattatgtatttattatccattggccatttggaccattggatcaagatatgtatatatcatggacctttgtcgcattttcaatattttccattataccgatatgcactctgtatacaattgcaatgcattcgtgatttggaacataagaacatatgaatctagctagacaagattttgatcaaaagtttagacacaatatcaaaaggactatttgattatacatcgctcaatcatgtacatcttgttgaatagagaatatatgccttagaatccttacattcaatcacatggtttggaaaagaataaacccgtttgatgctctagctctcaagtctcagcaggctagacagccacatctccagcctgtgtattcagctactctgaaaaaatgaaaatgctatggggcacaacaaaagcaacacataattatagctgcacaaccaggttattagttgacataggctttgaccttttgagttataactgacaagtcgtgacaaaataaacgaaacaattataataaattttgaaaaaagttttatatctatattatgttgggtgtaaaagacagtgctgaaaattagattgtgatgaaaacacatcaaaattaagttttaaaatattgtagctgataagttaacaagtagatgataagaggcatacaatatactttcaattgtgaattatgaaaatgtgaaatttagattcaatgaaatagtatttacatttatttgcaataaatggttaaaatattattgaactaacccattctgcacctgatatcatcacaaatttataaaccatttgaattttgaacaacaaaaaaaaatccgataccaagatgataccaaaggacgggttagatacttgagacatctagagataacaacgtcatttgaactcaagatataacagaagcaaaggataaaataaagaaaaaaaccgaagaaaaaaaaagataaaaccagaaacgaaataaaaatctagggtttatcagggcccacacgcagcctcgccgcgccgtgttttttttttcctccgcctttattttctcctctcctctcctctcccgcaacctccacctcctatccgccgccgccttcttcttcctcctcccacccgcgcaagctatccgccgccgcatcgcgtcgtcgacgaggaga

SEQ ID NO: 50812 - DNA, 1501 bp, Oryza sativa
tcacttgacagcccttttgtagattgtctatactgtctctttgttatttgatctcataaatcttgatgaaattcatcaggtcaatctttgggctggcctgtcttaagaaaaaaattttgtgctgctgtgtgcaattagaaattcagaaacctttctgaaactagcaatacaggcatctattttccattcttgaacagaagttacacaacggtgtagttgtccttgcatttggtttattggtttatggaaaacagttggggaagaatattctggtattgttgtattgctaactggcatctgaatgctttccaaaccattttcctacatggtgaattcgcaccattgtatcagcttctagccaattgtagttagtgtattgctgactgagaatttgcactagggctagcccagtgtgttggaggttggcaacccagcctgaagatagcccatttgtagcaaaattcaatgttcttgatgagttttgtttcttatagtactaagttatcagaataacgtgaatattcatgttttggggattgagcgcatcaattttctgaaatctgacaaaagagtgatcatgttgtggtattcatcataacatatttgtctgagtatttcccaggatttcttcaatttaacataaatcatgcctcccatcaccattgtttcacttgtgacaggcctctgggtaaattatgttcctcctatgaatatgatgcttgtttttcgctaaacgaatctatggatgttccatgtttttattacttgcaggaacatctggaagacaagaatctcaggcaaatcctattggaatcagaaacatctgcctactatgcccagtttgatgctgattcttcttctcgaaaaggtggcacctcgacgaagtgacaacctagggctaaccacatatgatcaagtttcgcttgactcaacctggattaggagaccctcatagatgaacgaaaaaggtgtttgtattttacatattagatgcatgttcatgctgttgcatcgcgctgcagttcagcagctgagatgtaagcttttccaagatcatattgaactcaaacctacaactttgatgtaccctgaaatttgcagcagtttctcttcctgaatctgggagaacagcttcagctatatgtaaacttaaaaaatattctccaacccaccaattttgtgctgcatcgatgcaaattttcaatacctcctatatgccatcttccaaagtcctttgagcatagttctggtagcgtgacagtgacttgcagtcttggaggctcttgtgttgtccgaatcagatgccttgactttgttgtctattatgatggattcattcaacaaagcttattgtttgtcacataggcctgatcctctctgatgtggtggcaaacaagcagtgaaagctaccagtctaccactcactcagggaagcttcgtagcaaagcaaagcatcagccttcaccttgtccagagcccagagaaaagggatccccttcaa

SEQ ID NO: 50813 - DNA, 1501 bp, Oryza sativa
caataatattcttgcaactaggaacaaaacaaactatgtcagtatcatactaaaaaaaatcagtcagtgtaaaactcaacttgcctccagcttcttctttatgctgtcccgtactatagtaaattcattatcctctttgctactgcaagaaagttttatattaggacctccttttattttcttcacggacggtgttgatatcgccttaaatcatctggagataggttcattatatgtttatgaatcgaagaagggaaaggtaccttagtagcaaatcttgaccaatttgaaagtcatcagcccttgttttcccccttgctcgtgtaccagctaaagcctcgctggaaatgtttaagtatttccgatgaaataattgctctggctattcagaatatttgcataaaatgaacattagttagaacttaggtcattgttatttaacatgagaaggccaaaataagaaaaaacatccaagttcatgtaaatatagtaagagatattctaataaatcatttggagtaaaatcgatacaagagatcacacagaagatgtgatgaaggaatttgtttttcagaatagaattgacatacactatttccaacaaatgcaggagcatcaggtggctgtatacagaactgataagcattttggccctcaacctgtatattcagtgtcagaaagatctaattgttttaacagcaatacaagagatgcaatatacctttaaacatgccaacagttcaacagggtcaatgcaagtatcagtaatatatctgctacaccttgccagtacgacctgcagaaaatatcgatgcaagcttatttcaaaataatgatcacaacatgacttgtctagatttttttttcttttggggaataaacttgtctagattttttctttagcaaacagtaaatgaaatgaataatttacctttactaattctctttgcttccctttaatcatctggagagctttagtaacggcaagatcccaggatgcctttgtggggacatgattaagatttagtatggttgtttgcagggtggaattgttcactttaattggactggatgatatctgcagaaagcacaacaaggttactatcttccacagttccacatgactgacagaattggaagaaagagaaatgcataccttctgcaaagttgattggagctccttcacagcattttgccatgtccaagaaagtgaatcatcccatgcaatcgtcgttgcgagaaccgagctctcttcaagctcattgtactcaacctacaccaagtatcagaaacacttcaaaggagtcagtatcacattccatctattccaatccataactggggtgatcctggtaattaagtaaggacttacttgaggaacaatgaagtaaaatgatccaaattcctcccattcaactgaatgatcgctcgtggcatcgaagcggatagcaccataagcacgaatcagtgggcaatcccttggaagaaatctttatggaca

SEQ ID NO: 50814 - DNA, 1501 bp, Oryza sativa
tgacagactgaatctagaaaagcgaacccctaaagcggacaagaagaacacggagaagagaggaagccaagggagaggagctaataaagaagggatctttgctcctctccggataatgacgtgaaggcaaagcaagcagcaatcctaccagaagaaacaatccatccagcaataataatagtagtaataaagatttcaattactcccaaaatcaaaactttttataaattggcaagaaagaccaattaagctgccgtttctgcgctgctcaccgcccctgaaagcgccattttttctcccacaaagattggatttttggtccggttcttcctctcccaactcccagattttttatttttgttcttctcctcgccgtgtcatctcattttctcactcatttttcattttttttgttggttttttagggggagaggttgtccaggaaagggggcaaagatccgtgccgtcccgtggcttcctggatcaatttgggtgatgagaatctgagatatccacatccatttatgggagtgacgtgggcttctctcccgctggtgaggtggggacaggtgtttccttgctgatgcagccacctcaacccccactgatgagtgttgtggcaaagcagggagccactggaatttatttctcgaacccctctctctctgccgcctaaagcaatggaagtaagaactaagaagaaaagcaaatggttcataggaaaaagaaagggagtactgtatgctgtgatgaagtgctgagtgactagtcaacttttttttaaagagtacagtaagaaccaaaagagtacggtttgagttttttttttttttttttttgcgggggagtacggtttgagtctatataaggttattcaaatttctcaatttaactttgagagtgaactttagaataaagttatgaagcggcttgaatctcgatccatctctttagttatattttaaatcattttaacccattccatttttttttaagttgagttacaacagtttaattgggttccagcattaaaagaggtggatatcaaataagcccaaaacaaattgtaatatgcattgccaatacatcataagtctgttagtgataagtcataattttaaaatcgggacactaattttacattaagtaattttatgagatattgcaaatttatagtgaaatttaattagttcgcgtgcactatttaaacttacggcacaaccctagtgccctccttccaatccaaaaatgttagtataatctgttagtgggttgaccagatatgtcactggctaattgggttgtactagttaaattaaaggtttgatacatagaaccaacatcactaatctattttttcttaatacaaacctttgatggtttatatatttcaaaccatgtattatttataaattccatttaaaccatcttactctacttaaaaggtatgataaaacgactttaatattaattatttttaaatatttaatagtaatttgct

SEQ ID NO: 50815 - DNA, 1501 bp, Oryza sativa
caagcgatgatataaatgagaatacaccagttgagagagttaaaggtccaaatgtgtttgagcgtgccaaggaagagattgaagctattgttgaagccttccacccaaagaagggatctgacaagtgaagattgagatgttctgttgcctctgtctgcacttgatgtgaaaacattgacatgagttattaatagatccatggatgagttgtgagatatccatcggctggtcttattattgccaaactatggagttgtaactgttgaatggttcattgtaccactgatatatatatgagcagagtgtgtatcatgtgtgacatgaaagtattactgttcttcagtgtttgattttagtgtatgttgaacttagtcctttgcatgatatggtattttacttgctaccatacatgcaaaaatcttttgaggtgcataaataaagagagagtcaattgctgtacaattttataaccttatgctaagcctgtggtttgggttcaacatgcttcacaaaataacagcatttccttagtgaaacaagacagaaacgcgagatatgaacgatatgatacctcaaaccccatgttctttgaaaaataaaattttgagttaaatgttggtgttgctacacctagtagtatagagtcttgaaaaaaattcctctcttttgatttgtgtggtttcaaacgcttcatctaattgatcattcctgttattttcctatccataagatttgagggaactatttcgaaggatcctttctcaagactctaaacggtgtgattttcttaaaactttttgtataaatttcttagaatactgttctaatatttttttttaactttatactccatccgtattttaatgtatgacgccgttgaatttttgacaaacgtttgacctatcgtcttattcaaaaaatttatgtaattatcatttattttattgtgacttgatttatcatcaaatgttctttaagcatgatataagtatttttatattcgtataaaaaatttgaataagatgaatggtcaaacgttggttaaaaagtcaacggcgtcatacattaaaatacggagggagtaacatttatttaatttgtttgttccctcgaataattatcgcaacattacgcgaagcaacaactcaaatagatatttcatattattttatcaatgaataagatctcgtcgttggcttctcatcacaaaaaaaataaatataaatttattagaatattgttttaacctattttttaaaactttataacagttattttatttgtctgtaccctcaaataattattacaatactgtacaaaaacaaatcaaatagggatttcatattatattttttaataatgaatagatctggccgttggtttctgatctaaaggcccagcccaaccagccgctgtctcttccccccactcctcgactcgctctcgcttccgaagcagcggcggcggcggcggcgaggcgagatggcggcggcggcgttgg

SEQ ID NO: 50816 - DNA, 1501 bp, Oryza sativa
ctctcccaggtaagatattggtgagaattcgaccttttaattccccatcccaaaccccctcgaattcccaagtcttccaaccaaactacagacttaaactcccagatatcataaactcctattccccatcaccaactccctccaaccaaacaggccgtgagagctggataatctacatcagagacatttctaactaattataatttggagcatgtttgtcagcatataggttccaagaagatggcagcacaaaacaatttctgcagttgctataaaaaaatggcaccatatgtttcctgcaagtctgcaactggtatttaaagatggaagcatctgcactaaataacaagaatgtatctatggccatgtttagatttcaacttttttcttcaaacttctaacttttccgtcacataaaatgtttggacacatatatggagcatcaaatgtcgacgaaaaaaaaaacccaattgcacagtccgactgtaaattgcgagacgaatcttttgagcctaattacgccatgatttgacaatgtgatgctacagtaaacatttgctaatgacggattaattaggcttaataaattcgtctcacagtttacagacggaatctgtaatttgttttgttattagtctacgtttaatatttcaaatgtgtgtccgtgtacttaaaaaaaattttggcacacgaactaaacacagcctatatttgaaaaatggagggaacagaccaggaatagaatattagaatactaataacacgttggcttaaccaattggcaaaaagattggaaaaggaaaatatttttctatgaatagatagaggaaagagatatacgactgtcattcttgtaatgagggtggtgggtaccttcagagcagccttgctacggttggttggttgatgaagtccataaatcccagttgtaccaggccagtgctccctctgcattgaatagcacttactagagctggtgagctctctttaatgcatatacacagcagcctattgctatcaatcccccaatgccaagccctctacataaacctactcaaatgcagtgagcaagcttgagaggtggagatcaggaaacaggggagggagagaggttttgccaccgttgttttggagggaaggaaaatcctaagaaggggaaagagtttagcttggcaggtggttctcaggctcaatggctttgagcaagagaatgctattcatcttccaggccatggtttgcctctgctccttcagtttatcccaaggtgcgcatctcttgtggttctgtctcatctcatgtttctcaggcattcctcctctattctgtattctgtctcatctcatgtttctcaggcattcctcctttattctgtacatttctgttccaccttcccattgaagaacttgcaatggtgaaatgcagttatatatgctagtttttgcttagcttctttctcgcaagaatatcattatcacgtgcacttccattatctgacacttt

SEQ ID NO: 50817 - DNA, 1262 bp, Oryza sativa
acatatgtatgtgtttagattcattacatctatatgtatgtgggcaattctagaaagtcttacattgtgaaacggagggagtactagaacttaatatgtatactaaattatgaacaaaatacaagaaaatgtagtagaattataaccagaaactatgtttgaagaactaagttgatttggccaaatatagatgtacctgcttctctttgtttccaacattagcaagtccaataaaacgggtaacatgtgcagcggaatcactcacatatggttcccttgcatagaatacacctttagaacctgcaatatgatatctgcaggaaacagacttttgttacaaattcggtatacttttggttggcattgtatcttatagacttatataaatgtaaacatattccgtgattatgctttcagttagtctagtcaacatttaaactactagcttaatactagtgtatttgcttggataaaagaaaattatgcatgtcttcatattgttcaaagaaataaatgtaatttctgcattgaagtccttcaccttttgtgttacaaggggcatttgactgtgatacacacactgatttcagaattaactcacacaccacatatatacatggcaattcagtcatgtttggcctttaatgttaattcgtgaatttgttgttagaaggctaaaagcctaaaagagaataaaacgtcatatggaaggttcttcgtgtgaatttcacaaaactacaaataccttgaccaaactactgcaaaactacaaatttaaggaggtgtataacaaaactatagatttagcatcacatttatctcaaaactatagagttaaggcatagtatcacaaaactacagatttagcagcagttttatcacaaaattacagttttcgttactcccggagaacatcagtgcaatggatttgaactctaaaatctgaattactaccaccaacactactttcttcttcaaggagggatatagaaaatatgaattcagaaaccaaaccgtggcttaatctcagcaaccaattcagcaactacaggatcatatccatgaggatccgatatctgagaaggtgcattagaagtatcaactccattcaccactccagcaggccattcgttagtgcaatctcattatcgtcaagggaactcagcaccaaacttgatactttgagaattcatgtacgacaacacctcagtttaacacaagcagctaagaaataataatgccatagaaagaaaaaaggatat

SEQ ID NO: 50818 - DNA, 1501 bp, Oryza sativa; identical to SEQ ID NO: 50809

SEQ ID NO: 50819 - DNA, 1501 bp, Oryza sativa
tttctcgatcaggtgtagtgcatgaaaaggcaagaagcaaaacccttcttcatagggtagccacccgccgaagttgatttcgagctcaaatgcaggcggcactacgaaggcggagcttgagcgttgcaaaacttgttgaagctcgagcgacacatgtggaaatttagcgcaggcgtgcagcataacatgtagcactagcggaggtcgagcatgagcttgagcatggctatctgctacttgacttagttcttatcgtcagttcagaaagtagcagcaactgtctgtcattgccggccagcttcttcgtatgctagttgctaccagtaggaatacttgttgtgcaccctccgctgtccttgaaattaagccacaagcactaggtagtcgatgattgaaaatgcaaactaccctttgaattctttggaagactttacagattgaaggggagagagggggaagagagttggaggaagaagaagggagtccaaattgaaacatcatgtaaagatacctggcccaaagtgaaaagtttggctttagcctagtccaaattgtaacaatggtaatcaaaggtggctcaaggtgtaattcactcttagaaaaaccaatttttttaggtttaaaatagtaatggtcagaaacggtaccactcatacgaaaacaattctagatcgatcgagaatttttatgactatttttatccttacatgtaaagatgtacgtccaaaagccgaacatataaatctttttgtattagtaaaaagatatggtgtatttacttaatctctttgtttagtacattggattaccaataaacaatagaaaatactatagtacacttgatttctttttccaataatagccgttgcgaaaataacacatcttaactctcatgaatgaatacacgtactaagagaaacggtgcagaacttataatgccctatcctatgtctgaaagaaaatgtgtgtcgccattgaaatcagaaaatggaaagtgaaagaaagaagggaggagagagatgagtgttgttgaaatgttggggtccaccaatagctttgtttattctttttctaaaatgaaatgcgacgtaagcagccacgttagataaaatcaccaaaccgcttagggacataaattgatcttgttttaatagtttgggatgctccatatctggtttttgggttgaatgaatcaatttggggctataattgggggatgaataatgaacttcttctatgaaattgctcaatttcactccaatgaaagccgtatcacaaaatgggccttaagccttgaggcctttttagacagccggagaacaccggcccatctgaagttcgaaacaacccaataacaccaaattacgaaaatacccccgaacagcgatatcacatcggcccttccagcttgcccccaccaacccaccccaccaccgacactctctcttctccgctcctcctccgccgatcacgcgctccgcatccgcatcgccggcgacga

SEQ ID NO: 50820 - DNA, 1501 bp, Oryza sativa
gccggcaacatgctggcctccggtttcatcgagtacaaacttgactaccaaaaaatagccagaagccttttgtctgggatcttttgatccttgtaatctgtatgatgtgaaccttaggcctttcccttcttaatgaaatccttcggcagagcttttgcccttactccttgaaagaaaaaccagaagctttccgtcgagacgttccacgtgcaccgggctgtgctcgccactcgctcaccggtgttcaaggcggagtccctcggctcgatggtggagaccaccgtatgccatgcgtcacgatgcacgacatcgacccggccacgttcaaagctctactacacttcgtgttaaaactttgagtaaataagaccttgccctttttaggtcagattttgacaacctatatatatttccttagcggcccgtttagttggagggagcttttagaagggattgggagtttagagggatgaggctattaactgttttgtttggttgggggacatgggaattttagtgggatggggatagggaattgagaaatgaactccctcattttcaatacctgggtaggggcacgtaattgggagggaattcctcctttacttcgcctaaacaaatctcagccatccgttttcattaatgatctaatctttaactaaactccctattaatttccatcacctctgccaaacaaaagactgtgatgaaaaattaaattcccatcttaatctcaccatcaattccctcgtgtaaactgtggcccgtttggttggagggagtttttagaagagattaggagtttagagggatgaggctattaactgttttgtttggttgggggacatgggaattttagtgggatggggatagagaattgagaaatgaactccctcattttcaatacctgggtaggggcaggtaattgggaggaaatttctcctttacttcgcctaaacaaatctcagccatccattttcattaatgatctaatctccaactaaactccctatcaatttccattacctctaccaaacaagagactgggatgaaaaatcaaattcctatcttaatctcaccatcaattccctcgtgtaaactcccaatccccttccctcaagtacgaagagttgttgttcttatctgctattttcctatatttcaatataccttatcgtataatattaggtatatatgtggtatctatggtgattacgaatccaattatatgacatatctaatccataaaattgacaaattcattgttgtatctgaagtcaaacaataaaaaaaatcatatagtttgacaacatgtaaatatatctatattacaaaaatatatttcatggtgaatctaaaaacataacatcttattatgttaaaccatacattttcttaaaaattaatagttaaagatagacatgtttagtttagcataaacataaaacaccaagtacttattatctcctaccaatcaaaatatgactcaaatgcgtacata

SEQ ID NO: 50821 - DNA, 1501 bp, Oryza sativa
tcgccgacagccgcgcccgcctgcccctcgccctcgccgacagcgattggccgtcctcatcgccttcggcttcggcgtgcgcattgccgctcgccgccgcggctcgccatggccggcggcgaccggctgcaacggcggcgacgcttgagattcggaagaggcagcaaggtttggcagccacgagcctcattccatcgtccactcagctgagctcgagctcgcgcatggagtgatgcgaggttggagttggagaggagcagcggcgacggcgagccactgatcagatggcttatcgtgttcgcggtttggccatctctctctgtgcacaagtggagctcgatttgtggtcggctgcgtcgcgttcttgctgtcgcggtcatcgtcttcaacctgttcaccagttcaatctttagttttcgacatttttttcggagggtgcaatatatatcgaatctttagtcttcaacctgttcaccagttcaatctttagttttcgaattttggaaattttgataaattttgttaaatttgaacaaattattaccaaattttaaaaatatttttttggccgaaataatattgtatcgcggatccaatagaaccgaaattttagaaatttcgttccgaaaatttgaaccctgcttaccaccacggattcaccacttccaacctaccaacgccactaccccaactcacacataaaaccacttgtgttttcttatctaaggatgaaaaaggtccgaaaatatggaaaccactttcatagttatatttctttcggaacggaatcgaaaacagtaaagaataaaatgaaaacggtatcgaaaaatattggaaaaaccggaaacgacgtgttggaaaacgataataaatatcaaaaacattgaacggcgaaatcacacatttaactttacatagctatataaaatataataaattcaagattatacaatgtaaattataattgtctctttttttagccatgcacttgatttgggtatggagttgatgggtatcagtcaaataaaaaaaaatgggtcatagatgttgacgtatttacaaatatagggtaatagatggtaattttcatacaattatggtataaaaattcggaaacactcgatataacaataaaatagttttcatttgcatttctatatttttctactatttctatttttaattttgttggcaacaattttcacatagctcagccagtcaaaatcgagaacaagtgtcggtcagtcaggaatttctacgattattttcacccctagtcttatcttctctctcctttcctctttaccatcaaactattctaaattttaattggaacttttaaccatactaattggagtaaaatgctatcctaccaaaatttcaaaagttttctcaatactatcaaaatttaaaaaggcatcaaactaaacacatagtaaaaaactatcaaaattcggtaacactgaatcttgccaaaatttggcaatgttcttgaactgag

SEQ ID NO: 50822 - DNA, 1501 bp, Oryza sativa
ttaaacctaaaaaaattggtttttctaagagtgaattacaccttgagccacctttgattaccattgttacaatttggactaggctaaagccaaacttttcactttgggccaggtatctttacatgatgtttcaatttggactcccttcttcttcctccaactctcttccccctctctccccttcaatctgtaaagtcttccaaagaattcaaagggtagtttgcattttcaatcatcgactacctagtgcttgtggcttaatttcaaggacagcggagggtgcacaacaagtattcctactggtagcaactagcatacgaagaagctggccggcaatgacagacagttgctgctactttctgaactgacgataagaactaagtcaagtagcagatagccatgctcaagctcatgctcgacctccgctagtgctacatgttatgctgcacgcctgcgctaaatttccacatgtgtcgctcgagcttcaacaagttttgcaacgctcaagctccgccttcgtagtgccgcctgcatttgagctcgaaatcaacttcggcgggtggctaccctatgaagaagggttttgcttcttgccttttcatgcactacacctgatcgagaaagagaccttgagctgtacagagaaaagagagtaagaaagggagttggaggaagaagaagagagtctaaattgaaaccttgtgtaaatatacccggtccaaagtgaaaagtttactttttcactggttcaagttacaacacaggtaagaaaaaatagtccaagatgcaatttactctttttctaatttcgttcggtgtcgcattaatctcgatacttaatattttaattgataaatattatcaattattaaacagataagcgtcgttttcgaagatacgttaccgattccaaatgttctcatccttattcttatcgacttttgtttttctccatttgaccaaagcgttttgagacggagggctttgttgttcagccagcaaataggggagtgtttccagtgtttttccaccgaagaaaggcgaaaaaaaaaagagaaggcagcgaagatttctctagaaagagagacgattgtcccatatccaccgatgccggattagatccggtggactccaccgatccacgggccgggggcccattccaacttgcccagccactggtgggcccaccggccacctcatttccctcaccccccaaccaaaaagataaaaaataaacaaaaagtttaattcgccgccacgcgctttgccggaaagccccaaaagcccgaccaccactgccgccgcgccgcctcctcctcctccgcctccgccgccgccgccgcccgccggccatctccgtcgatccaccgtccggcgagcagacagcagcccggcagatctgcccccaccacgggatcgaatcggcggggggaaccgaatcggggagcgcgggaggcggggagcttagtttgagctcggtcggcggcggcggcggcggcca

SEQ ID NO: 50823 - DNA, 1501 bp, Oryza sativa
tttacgaattacggcccaaagtaatcaacctcgtccattgctacggcccaatttgaagtcctattttcggcctaatttgagtcctttacgaattatggcccaaatcaaccagcctcagttactccggcccaatttgaagtccattacaaattacggcccagataataaacatcatgcattgctccggcccaatttaggcctgacgaaaaagaaacagagcccatttgttttgttttgcttttttgaaaatttggtagtctatatcagtagctgctacttgcaaccaagttgatgagtgcacgtaattgtctcgtgtattttttaatcacttgaccatgactcgatgctttggtagatttaatttgatgctagccacgttggatttacattataatattcgattaattcttgatgccatgacttggatgctagtcttccaagtagtttttttttaattattaattccagtttacttgatcttatccacagtgtctgtcgagagttcagagtcattgtttatttcattttcgatcagatcacagtgtccatttgataatttgatgtgtgaacagaaacctatcgccccaggaatcaagacacatgtatttttgtgtctttttaatgtgactaatctttcgtccaaaaaaagaaagagtgactaatctctaatcaatcatgcaccgacacacctgctggtcctgctccatccattctctgcaagtctgcactaatcacactttcaaggcctaataattatagcaacttgcatggcatatccctgatattcttttaagatgaaaaataccagtttgttagttggtgtattagttatcaaccacaactaaaacttaaatgttaaaacttaattttagatttgattttaggcttctttctaccttggtttttcatccataataagtttagtatttcttacggcgttaccagctcaaccaatgctgtcgggattgtttgtagtactgcacttgtagtagctgccattgacatgtggaaccggatctatttgtcagccactgctactgcaaatacagtactgcagaggattcatgtcccattaactctactactccctccctctcattttaaatgtatttgtggtttgtatatccaacatttaattaacatcttatttaatttttttataattagtatttttattgatattagataataaaaacatgaataataatacttataggtgtggtttattatttttattaattttataaattttaaaatgagatggacggtaaaataagttggacacataaaccacaaatgcacttataaacagagggggagtaatagcatcggaagtatcaatgtagcgggaaaaacgcataaatttggtcaatggacattcatgaacattgaatacattacacaaaaggaaaaaaaaaactgaatactggtagctcataaatacgcacgagcaaacaatgggaaggaaacaaatttgcaaaatccaaacaggaccagcaac

SEQ ID NO: 50824 - DNA, 1501 bp, Oryza sativa
agttcttacttccattgctttaggcggcagagagagaggggttcgagaaataaattccagtggctccctgctttgccacaacactcatcagtgggggttgaggtggctgcatcagcaaggaaacacctgtccccacctcaccagcgggagagaagcccacgtcactcccataaatggatgtggatatctcagattctcatcacccaaattgatccaggaagccacgggacggcacggatctttgccccctttcctggacaacctctccccctaaaaaaccaacaaaaaaaatgaaaaatgagtgagaaaatgagatgacacggcgaggagaagaacaaaaataaaaaatctgggagttgggagaggaagaaccggaccaaaaatccaatctttgtgggagaaaaaatggcgctttcaggggcggtgagcagcgcagaaacggcagcttaattggtctttcttgccaatttataaaaagttttgattttgggagtaattgaaatctttattactactattattattgctggatggattgtttcttctggtaggattgctgcttgctttgccttcacgtcattatccggagaggagcaaagatcccttctttattagctcctctcccttggcttcctctcttctccgtgttcttcttgtccgctttaggggttcgcttttctagattcagtctgtcagcggcgacggcgagggagctgcgagatccggccgtgagatggtggtgatccgaaggagtcatcgtcatcgtcgtcgggttggagcctcttcgtccaagaacctgccttgatcttgcagccttgttcaagcttccgagtcttttgctgatccaggtgaggtggcttttgccttcacctgtaaaattttagagaatcggatcatcgggaggagggagcgaggagaatcggagattcggaatctttcgattttgtctgacttgctcgagcatctcgggttcagttttcattttgcgtgcccatttggtccagtcaagtactttgaaatgttcctagttcgaagaattcgacctgtttctgtatttctgcatctgtgattcgtcccttacctcaaatcagtgaaatctgtcggagaattggataatcgtttaccgcctcaaatctggctgtaattagtagtgattgttttctttgccatgggcatttcatttcatttcatttatttcgacgttgcttgcatatctgagcatcatgtcttctcgttattgtgcttgtccgtattcattttatggttgtagattctttttgagcaaacagttcatgaatcttgatggatcggtcttcaaattttctagcgtggatgatgcatgcactttctgtcatgaaaacattgtaaaataggctgttaatactatcatttgttttctttagagcttctatggaagtagtgctgatgaacaactttttctgaggacattgacaaacaatttttctgatgtgcagggtgcagtttcttagcatgtgagtaa

SEQ ID NO: 50825 - DNA, 1501 bp, Oryza sativa
ttcaaattttggcaaccatgtcataaatcatcaggaaataatttattgcattttctgtgcatatctgagagattatctgataataatttcatatccacacaattatgcaaactttcatttggcaaacaattatgcataaaaaaatttagaaagggcattggttaaatagataaatcatgcacttgtggaactatcatatgacttgttaatggaaataattgactaggggaacactaatttactacaggtatagcatttgttaaactcacaaagactaaagaatggaatgatccgtcctaaattttttgccagcccatctttgaaatacaagatgagccatttctaaccatgggcaattttactggtttgctaaactctagcttgaacatgacgaatagatagacttacttggtttctgtcaaacagcaaatcttgaacaggagcatggcaatccacattaaagatgcactcatttgaaagaaggctccaaactgatataccactagaagtaccacaagcctgggaaaaataggaccaagataataataactgtaaaatacatgatgcataacacattgttatatcagcttgaagtgcatcctaccagccagctttcacttgcatcaatggcaacacaactgacccatgacccctcaaaaatcttgtttttcaccggacgtataacctgagtgcactttccacttctgcaatctgcagtgcacaaagagcagaaataagagaatgcctttttatggatttccatgtagtgccaaatctttctaaacctgtctgaaggtaaactcataagagagaggataaattttgtgaatatgatgtgacctgtgaccagatcaccagatgtgaattaaagagtacaaaaagacaaatagctagttggtgctttttctttgcttgaatcaacgagcagatatacaaaatgaccagttagaacaggatgaacatgagaaggcacacttcaagtacaagacaaaattatcctatcaaaagcactgctcaccccagatacgggctgtgccatcctctgatcctgtaactacctgaaaaaggaaaggctctattaactaaaagttactacaaaatgaaggcaagacatctatgggaaaatggtattggactacatcagtacaataataacaaaccaacctggcggttcgcttcgcggactgcaatgctgtgcaaatagtcagtatgtcccttgaaggtcattttacatttaccactctcctgaaagaacaagacattgtaaaacctactatcagatattttctcaagcaggcacacagaaaatagaaaattatggaagcctgtgccacatgaatcataagaaatctgtagttccttccatgtagctcaggacttctatatattgcatttacctcaagaaaatacataccacatcccagcaataagcacatgcatccccggccgctgcataaacagatccttcctgttgcgaagaagaatgatgagaaagaataac

SEQ ID NO: 50826 - DNA, 1501 bp, Oryza sativa
gcatccgggtgggtctgaatccaatcaaatcaaaacaaaagatcgaacaccttagctgcgcacgaggacgcggcacatggagcgggtgtggggaacgaacgaacctgtggggtgggatgggaggaggaggaggagatgcaggaggagagggagaaggaggcgagggagccgtcgctggaggcggcggcgaggaggacgtcggggtcgtcgtcgtggtggtcgaagaagacggcgcggaagagggtgcggcaggagaggtcccgctcccgcaggatgccccgcctgtacgccgcctcgtcccacccccgcgcgtccatccccgccaacgccgccgccgccatctcgcctcgccgccgccgccgccgctgcttcggaagcgagagcgagtcgaggagtggggggaagagacagcggctggttgggctgggcctttagatcagaaaccaacggccagatctattcattattaaaaaatataatatgaaatccctatttgatttgtttttgtacagtattgtaataattatttgagggtacagacaaataaaataactgttataaagttttaaaaaataggttaaaacaatattctaataaatttatatttattttttttgtgatgagaagccaacgacgagatcttattcattgataaaataatatgaaatatctatttgagttgttgcttcgcgtaatgttgcgataattattcgagggaacaaacaaattaaataaatgttactccctccgtattttaatgtatgacgccgttgactttttaaccaacgtttgaccattcatcttattcaaattttttatacgaatataaaaatacttatatcatgcttaaagaacatttgatgataaatcaagtcacaataaaataaatgataattacataaattttttgaataagacgataggtcaaacgtttgtcaaaaattcaacggcgtcatacattaaaatacggatggagtataaagttaaaaaaaaatattagaacagtattctaagaaatttatacaaaaagttttaagaaaatcacaccgtttagagtcttgagaaaggatccttcgaaatagttccctcaaatcttatggataggaaaataacaggaatgatcaattagatgaagcgtttgaaaccacacaaatcaaaagagaggaatttttttcaagactctatactactaggtgtagcaacaccaacatttaactcaaaattttatttttcaaagaacatggggtttgaggtatcatatcgttcatatctcgcgtttctgtcttgtttcactaaggaaatgctgttattttgtgaagcatgttgaacccaaaccacaggcttagcataaggttataaaattgtacagcaattgactctctctttatttatgcacctcaaaagatttttgcatgtatggtagcaagtaaaataccatatcatgcaaaggactaagttcaacatacactaaaatcaaacactgaagaacagtaatactttc

SEQ ID NO: 50827 - DNA, 1501 bp, Oryza sativa
ttcgaaggaattcaagcaaagtatttgtattcaaactatttttagggcatacatatctaaacttttatgcctgaaaggatttccagaaagtttcatgatttagctgcatcatgttttaaagtcggttggtggcatcaaatttgacaaacaattactgaaaaggatgtttttgcaataaaagggagaaaaatgaagatgctaatattcttgaacttgtgtttgtgttatctcagaaaaatcttgttacagaaaaccagactttttcaacaaagagaaataaattctgatatatgcccaatgcatgattaatgacccatcatattatacaaggaactcaatacacaaggtaaaaaacatcaagctaaaatttagcaattgtcaattgagtatgctgtagcgcataattgctagatcagattttgtactccctccgtttcacaatgtaagtcattctagcatttcccacattcatattgatattaatgaatctagacatatatatctatccagattcattaacatcaacatgaatatagaaaatgctagaatgacttacattgtaaaacgaaggaagtaggacataattactgaagaactacgtgtcggcctattaggcattgaagagcttaagcttgtgcgtttatcttatatgagctttgtgttttttggtcctgttgttaagcagctaaggtcgtgacttaggtgatgaggcaaaggatcgtgcgatactgtgatggactgatggtaacattaagcttagatgtgaattgtctctctgggtgctttgggcctagccgatgctcctctatcctatccttttttccatcttttctgccagatagtttaaaatcctactcttctttctggggataataaaaggtgctcagcatcttcacagaaattaaattacggaaaacaccgttggttcaaacaaattaccagcattatttccatggggactggaattgtgctccatcttatcatgaacagctccaacgagagcctcaacctcttccttggctcgttcaaacagattgggggccttaaccttgtccacagatgttttatgacttatatcgttgctcgttctgtgagtctccttgtcatgaactttatctttgttcatcacgcttttgattcacagtagaaagctgcctattccaagctccactctgcacaaaattccaacaagagcattcaggatttcagcccgtgataaacaacacaaaacctgatacttgccattcatccctacgcaggatccgtgcccgaaaaaaaaaaaggtaaatagcagaccatttgccttaatccaatcgagcgaaaatggtaaatacaccgtttgacatcatgcccaaataaaaagactttaatcatctttcctcaccgttctgcttgctaaatgttgcagcatccagccaaataatacactgggaacgttgcacagggcaactgtttttcggctgtcagtgctgaaccatcaaatcggcaatggcaagcaaaa

SEQ ID NO: 50828 - DNA, 1501 bp, Oryza sativa
cgccgctgctcttcatcaccgtcgccaaagcccagcagctcatcatcatcgtcgccgcagtctgcagccggtcgtcgtcaccagggccaccgcctccgcgcctcccgacccccgaggtcatcgctgaggctgccaccactctgcgccttcccaccgctagatccgctaccactgtgcctccccacctccagatccaccacccaccgcgccgcgctcgtcatcaccaatgcttgcccgagcctgtcgtcgggatccaggaggaagtgagagagaaaaggtgaggagatatggatgaagacttaaaattttgaagatgttgagagggaagagagtaggaaggttagactcgtaggcaggtctttaagagacccacgtgcaaaaatgcattttgccgcctgcaataagtcggacttttgtatgtggcccacgaaccgaccccgcgtaaacgatttttgcagagagccgttatggtccacctacagtctaaaaagggtctcgtaaaaaaatcaattatttagtagtggttgacctacggttaaccaatgagctagcagacgatcaaagcttcaaatgaacggctcaaggattagcatagttatttttcaactcattgtctctgtttaatttgttaagtgtttgcattggctaaagcatccgtagtttgaatgtaactactctatgcgttcaaaatcatgcccaacaataacccaaaaaggcattgtctttccctcgcacattcacaaattttgttgatattgtttgttactatctatcaattaatgttttatcaagctgtcaaacatgcatattggtgtactggttcctatctggagtggattgaattaatctccaacaacaatctaccaactaaaccactattagctataatgtttctcctaggtacaataacataccataatacgagtgaaacaaaaaccatacgacgtgcagagaaacaaatccgtgtgacgtgaggctagatctgagaacccaccctgctgcctatcctccattcatatagcccaatgttcccctacagccggttttagtgatatggattattgtttggttgtttaattaatgagcatgtatgcatgatggagtagaagcctcccgccactgctcccgccattgccaacgccagctcgagcctgtcattgggatccaggagtaagtgggagagagaaggtgaggagataagaatgaagacttaaaattttgaagatattgagagggaagagagtaggaaggttagactcgtaggcaggtatttaagaggcccacatgcgaaaatgcattttgcccgcctgcaaaagtaagtcgaattttcgaatgcggcccttgaaccgaccccgtgtaaacaatttctacagctggagcagttatggtccacctgcaatataaagagggtctcacaaaaaaataattatttagtaggggttgacctatgtttaacaaatgagctagcaaacaatgaaaacctcaaatgaacggctgaaag

SEQ ID NO: 50829 - DNA, 171 bp, Oryza sativa
tatgaatatggtcaatgctagaaagtcttacattataaaacggaggaagtagacaagaaccatttaacaatcccatatatctataatataattatattgggccattaagactttagaaaataaatagggtgcaatacatcatagtagaaccaatacataatacaatacatc

SEQ ID NO: 50830 - DNA, 408 bp, Oryza sativa
aagtatttttaataaatggaattgcatttaagaaataatttaaattgaaaaagttttaaaaagtcttcttttggctttgggccgaaagtcggcccaaaaccgccttctctctcttctcggcccagtccggcccagtctgcagccgcccgcgcgcgcgcgcgccctcgcagccgctgacaggtgggtcccacctgtcaggcccgtcgtcttcctcgggccgaaaccctagtttcgcgccgccgagccgccgccgctgtttcctttccaatccggccgttcctttccttctccggccgaatcaatagaggggaaatgatctcctctaccttttctcctttggaatctttggctcaatcggtttggaatgagttggattcgagttcgtctcggattcgttcttcccgaagg

SEQ ID NO: 50831 - DNA, 264 bp, Oryza sativa
taaatcggagctaagatgaattagttatgaatttttaaagattaaatcggattacaacacttaaatcggtttaaattgaattatgacgcaataatgaattatttttgaaaaggaaaagaggatttattgcgtcagcgggctagggtttggtggaccgggcgcacgggcgacggttcacgcgaacggacggccgagattgatccgatccaaatcggacggccgagatcgaacgagtccacggcggctcacgggagaggggcttga

SEQ ID NO: 50832 - DNA, 1501 bp, Oryza sativa
tgttacaaatcagttgctttctaatctccatatcaaagtgtcgaaactagatttcggcaataataaaagggggtggctatcaagctagaaaagtgtatgggtttggagacaaaggatttatacaggttcaggccttcttataaaagaagtaataccctactcctgtccggggatgaatccgccgagtgtattattgattgtatgatttggagaaaatcaacatatgcccctagaggcgccaggaccccccttatatatgggaaggagtccggattacaaaagataatctatattcttaacggaatatgaagatacaagtaaaatacagtcgtaaccgactaaatctcagggtgtttccttgatacacaagttaagaaacaaacccgaaatacagataagatattctatctacattaagtatccggtacccaatccaaataccatcgccgtgtagatatgggatacccataatctccacagtagcccccgagtcctttgcagtcgaccatcatagccttctcaaagatagtaatccgagtgcttcaaattattcatgccaaggcctgccgagtagcgaagacgaagactgtaaagggcgaaaagataaagaatatggtgcatcgaatagatgcacctaattaggtgtagcccccaactatgtgattagttaacaaactaaacatatagttgaaagacaaaataataacacaatcgtgcattatatgacaaaagcgtacgcggcgcctaaataggcatgctagccgactgctttttagccacaataaaagaaatctgagtggtttacactctaaaaggttcacgaatgaacacactcgacaggcatccgaatataaaaactccaaagattacccatcaagtattataaagattatggtaataaataagtcgaatagcctaggccatgactatttaccataaaaacaggcatataagacgccaaggaaatgactataataaaaacaagtcattcctagttaatcccaaacagcttttgtagcctaaaaaagctcgcaaaaacagcataacgcctttctgtcgggcacctttttaatttgcattgcaataattccaaagaattatatgaccgcataaaaaggatttcatcagcattgggcaacactgttgtgcgcataatattgccaaagcaaaatatgcctaagtccctaaggaacacaatgggccacgctgttaaaagtattgggctgaagtactgttcaggcctaggcccattagcacctccgatacccttaactgaaaaatccgatatccaagcgacgcttcgtcttccccgccggaactctcgccattttccccactccctgctacagtgcaaagttgcgccggcgaactagggttcacaactccggccaaatccaccttcgaaaagtgcatcaaaatccttcccgtgatccaccgcctcaatccctcacctctcccaagccatccctcgaatcaaatcagcacatttgagcgaaaccaa

SEQ ID NO: 50833 - DNA, 1501 bp, Oryza sativa
tggtatagtgctgggagcgtttaatactattaatactttaatattaactcttaagatgaacacaaagtgcctattgtacttaatatgataagtgtggaatcctgaacctacaaaagttgtaaaatgtttatattagactttagaaaaaagtccaaataaccctctaaactttggatggaagtccatctaacaccctgaactttgaaaccggacatttaacccctaaactttataataccatttatataactcctaaggtggttttgcatagtggtttttttttctaacttgtatataagttggatgagtttgatcacatgcttcttattggctctcacttataaacaagtaccaacttaataatagcatgatatcattgtataaggataaattaatgacttataactgatgatatgcaaataagttatattagttattcaaaattggtcgtttaagctttcaaaacatgcaaaaccatcatccaaaacccaaaccaccttagggggtatatggatggcataacaaagttcaaggggttggatgatgtccggttttaaagtttatggtgttaaacggactttcatctaaagtttaaggggggatatttagactttttcctagacttattccttctccataagtaatcgtgcgttttttaaaatatgtgtcaatgtctatgcagtcaaatatttgcattgtatgtttataaaagttatcccctgcatgtatatatatgccacaagtatttgcaaatcagcgagtaaggattttaatttctcaagaagaaaactgcaattgttagtttgttaccatataacttcgcttcatcatccggtcgattaattcaagcaacatgctatcttgcgccattttgttgcataaaaaaaatgtagtgacactaacctttaaaaaagatttttaaaaagtaggtggtgatggtaactctctaccaccatagatcagtacgaaattattaccaatgggtacattgcaaatattaaaagaacaattggagagagagatgtagaataaccaaacagataataacaaaagcattttcactgataggtgcaacgacgaatattaaggaatggcctaataccaaataaatagaaggggtgagacttcgaatccagaccaatgagcttaccacaagttagccagaaaaccatgggtgtttctcacgcattactaattgtaatggataaaaagtttattgaaaagcaagctgagcagatggaagtcacaggcgtaggcatttatttttgaagcaataacacaataaactactaaccaggtacaatatggactcatatatacttggaaatcatactaacgcgatagatggttcatgcaaatcacaggaggcaggagcaagcattttctttaagaaataatacaataaactaactaactaatttttttttgcggggaaactaactaactaattacctgaggtagtatctgtattcatatacttggcgatagatgatagctgaac

SEQ ID NO: 50834 - DNA, 1501 bp, Oryza sativa
attcaaattttctactttgcccgaccaaaatactactcaacaggattgtaatctcttatgtattgtttaatactactctgtaatctaccctgttttggaaacaaagaaaaacgaatactcgtatcgaatttaggaattacaaaactcactgaaagttatgtgcagtcaacgtccaaggttcattaccacagtacgaatctgagcaacatctattgaaaagatccctttgggccaagtgagccaaacaaatgtgtatgctgtttctatcaaaaagattactgtatcacgaattcgagcctctgatttcatccgagttggacagtggatacaaagttttgacttttatcttgctggattgctactcaattagtctttcctgatcaatttctgatctgatggcttcagccaacttcatcaacctgatgctgtggtcttagaagaaatgaacttttgttgctcacagtacagactccagaacccattgtcttcaaggggatttttttttttttgtcttcaaggaaaaaaaaagttcagaacccattgtatttataagtgttgctgtgcttatgttcaatcttaatgtccttcggttaaatattatgttatgggcatgcagtcacaatcaaattacatgactttggtcgccgaccttcactatactatattcacacaatcgttagaatattcatgaggcagatttgctcatatcatcttggatgttcggccatcctgattataatacgccgcacgctgattaaatctacgatatacagccatacatgttcatattatcaaccgttctaaaccaaccatccttttgaatacatcctttgttttaaactttatagtttttatatggaaattgaattgtgttcttggctgtgttcgtttcaacaaatgagaaaactgcaactttttttacatgcacgcttcctaaaccgctaaacggcgtgtttttttttaaaaaaatttatagggaagttattttaaaagaatcatatatttttttaagtttgaagtaattaatacttaattaattatacgctaataacccatctcattttacgtatcttctatctcttattttctatgctctcaaacacaatcttatcgaattcattttggcaagaccaaataccaaatgggcctaatttgtctattagaagagcccacaataatgggccagccttgtgcatacatgtacgtacagtccactaggaaccaagccatatttttgggcccaactaaagcctaaggcccatgtagagatccctaaccatttctagggtttcttccctcctcttagaccgccgccgccaccgagccactgcttcttctgtgcggagagagagagagagagagagctacccttcccttcccttctcctcctcctgctccgccgccgccatggttagtcctgagctctctccgctccggtacgttgatccgctcgtggtttgttccgttattgatctgacgtctcgctgttgcatcttttcgc

SEQ ID NO: 50835 - DNA, 1501 bp, Oryza sativa
tccttttataggctactctgttgatgtgtttctcctaattgttttctttttgtgggaggatatctaatgatggctggctagctagctaatctgaaaaaaagaatgaagaatgcacaatgcactaaccattgcaattacacgttttgcactctttaaacgataatgcacccaagcagtagtgccgcagaaacccaaaatcaatacactgatttcttttctgaataaaaggcaacaaacactgagatatgtgtcacctaggcactgaagaggattgagtgactggaccactatcttctgcactaaggaagacaggaaggtgtgaacatttgagcgcatatgttcacttctcctttttccaaggacaaagatcgagaaatgttcagttgttcactagtgcagagttcttgagtaaactgtactagcgcccatgctgcgttgcatgagttttcaataccgataggccatatacggtactcgtcgtatatatctatcttgttattgggtaggggagcttgctagctaatgttctacaccgctctgtacgtgccatattcatgtcatgatctgtataaaaggacaagaagtttggattggtaggacatgcatttttcttggctctttgtatggatcaggacgagaatgtagtattacagagcggtgcagatcacatagcttgttttctctgcaactgcatgatactatagtacttaggccgtaggccgtgtttagttccatgccaaaattaaaagtttgattaaaattaaaagtttgaagaaaaaagttaaaaatttatgtgtgttggaaagctttgatgggatggaaaagttggaagtttgaagaaaaagttaggaactaaacaagcacttatagagttggggtactcgatcgacgtgtatctgctggcctacttttgagtcaccattccccacctgatgaaatgggtgtaagatgagatgcacttgatagtgcaatgacaaaaaagttaacccgaaagtcttatgttcaatttctaacacgctatcttcttaaaaaaaatatttggagaacgtctccctctaaatcttgttttttttatatattatgggtgcaatatgtagcagttctcgattctatttgatagagcttcggatctagtttttcaagttacataaatttttaaggctagaaatattcaacttattcttaggtaaattcattgggacatgcttctctagatgttccatatctgttttccatcttgtatatgaaaactgtcgattcttattagatcttcgagtaatgtcaaacaggttcaagattatcttttatatccaacgttttagacctggactgttcgtaagtttgtttatccggaaatgtgaaatgcaacgtgtttttaattattcagactaagggatcagatattcagatgggttgatgggttgcatggattcatgtctgtttctcacctcctccgttcccggtggcgtctgaacccaagaaaacaggaggacgacctgat

SEQ ID NO: 50836 - DNA, 1501 bp, Oryza sativa
tcaagtgacagtagtggtgaggagaaataaaggggaataaggaagctaaaccttggacagacaaaacctaggttaactcctcataggtcttaattttaaaacctacaaatggcaggttgtcctagctacgtacaatgtactcctttcgtcccaaaatataaacatttttagcatagcatcaagtcaaacatttttaactttgaccattaataaaaaaaatagaaaagatcaataatataaaattgatgttactaggtttatcattaaacaaactattataatatgcaactcttttaaatttaaaacaccttacttttatagatattgttgctcaaagtagcatctcgaagactatgacaaagtataaaggtgcttatattttaggaccgatggagtggtcgacaaagtttgccgtggtaaaaaaacattggctcatagtattacactgcacgtaaactaattaagacctatgtaaagtatgctatatatgacaaatcttaattttcagctcatctaatctaactactcagcacggatgagcattagtgttagaatcatgtgtgatacgtcacgatattatacatatgagttgcgtctgtcccttgagaaataagctttcatattctcaaaaccctatttataatgcacatgaacggtgagaaataagctattcatcttctcgaaaaccctgtttataatgcataaaagtccatttgataagagaaactgcacatctatattatcttaaaaaatgctaagatgatagtagtggtgttgactgtgttcgctggtggggagtttagaactaaactctccgcacgaaaaacggagcggtccattagcacgtgattaattaagtattagctatttttttaagaaatggatcaatacgattttcttaagcaactttcgtatataaacttttttttttgcaaaaagcataccgtttagtagtttgaaaagcgtgagcgcgggaaaagagaggggtgagttgggaaaggggattccgaacacaccctttgttatcaccaccatccaactatcatatggaacccacgaacaatgagaaaagattttatctgtccctatgaccaacttaacatatacttagaaagtgacaacaaaattagcattacgataatttattagacaatatatttttatgtacttgaagatatatgttatgatcttttttttaagaaaaaaacgtttcaacgcattgatagtatgctattaacataaaaataggggacggatatatttgaaaccatgcactactacagaaaccatctttgctgggttgaccaaaaatcacaatagtcccggtttgaatagaaaccgggactaaatatgattttttttcccggtttaaaactctatcagccctagatgatttttagtctcggttcattttctgtccgaggctgttagggggtcaaggatttttagtcccagttggtgtgaccaaccaagaataaaaattagtctttagtccatatat

SEQ ID NO: 50837 - DNA, 1501 bp, Oryza sativa
acttgccagtcttgtctagaatgttttaagtatgttgtttgcttataattaagttgttgttccatgccatatgtatgatttgctggggggatatggaaaaggttgttgtacactatgtttggtgattgaatataggggacgcgatggatgtgtatgagttgattggtgcaccttttgtctcagcaaaatgtaactttgtcattcaatccgtataagtttgttaccaggagcattcgattttttttttaactggagtattcgttgttggttatatatatcttatacaaaacaaaagaagcaacgctagccatgaagtggtatagaactactgtgaaaccaatttgtgtggtttttgtttttgatggaaaattggtatttatctgagcttagattggttttgaaatatcggaggagtcagcagggtttacaaattcaaagaatggatcatgagtgcatttgcttaagaatccaaaaatacaaattctgaagaatttttaaaagccaagagtttgtcagatttaataaaaattgaaaacaaagtgatcttgagctacaaacactagacaagataaatttaactagtcaggaagctactgtagtatttgctcaaattaataaccttctttgcttgttcaatttttttaaggtaaagagagttttattgattttaaacaattacatcgagttgatacaattaaaaaattaaaaataagtactccatatagttcctcttgttttctcttccgcttcttcatatgtctctctttacttcaatccaacaagtagcagacaaaggagtgaaaccatcgaccagcacatctcccctcgccaccccatgagtaagcatatactccctccctccgtccctaaatatttgacgccgttaactttttaaacatgtttgaccgttcgtcttattaaaaaaatttatgaaatatgtaaaagtatatgtatatataaaaatatatttaacaatgaatcaaatgatataaaaataattaataattacttaaaatttttaaataagacgaacaatcaaatatgttttaaaaaattaacggcgtcaaatatttagtgacgtagagagtatatccatccaccttccaagcttccacaatatggaagccatggctttgcccgagctcgccatgcatgaagtggagagctccacgatctttctctctccctccctttgtttcagaacagttaataactatgtcatcctcccctcttggcctcttctcaacccttcttcaccggaaaaaacaaaaagagagaacatattctataccactgaatttatcataggttaataacttaccattgactttctctctttctatattatactggcgactttatcaattgttctacaatacactattaggctgggcttatttttcaataatagcaaaaatacccttatggacatacaagtataacaattgatttatatcattagaagttttaaggaaaaaataaaacttttatgtggcctcct

SEQ ID NO: 50838 - DNA, 1501 bp, Oryza sativa
aggagcggcggctcccacatgcgaagacgtcgagaaagcaggcggcggtggcaatcgtgtgaagcggaagcaaggcggggaaaaggactgtaaagtagaaaggggatcgatctgatctaatcgaaccaaggagtggtttttcttcaccgggaaaattaaaaccgaccagttctttttttacaacagaccggttcttttcagaacatggaaaccgacccattatattcctgttctttttctattattttattatgtaggctcccacaaagtaaaaaactactgcacagaaaaaaggaagcaaatcttatcttatcgtatttttctgttcatcacgaaggcgctttcgtccgttggcggggcgtcttcgcagcctccaaatcaatagctctgagtcggatacaggaaacacatcccaaaatcgacacaaccaaaactcaaccactctttgcccaaaaaaaacaaccacaataatcaccaaatcacaaaatacgtcacaaaacttcacaaaaatatacataaaaaagaagaagccgccggatccgccaccagccatcgccacagccaccctccgccgttgccatagccgtcctcggccgtcgcaaccgccgccgacgccaccacagccgtcggagggagtcgccgttgccggatccgaccgcggccgccgccgcctttgccgtgggaggaaggcaaacgggggtggaggaagccgccgccgatccgcccgcggccaccatcaacccgccgcaaccgccgccgtatccaccgagggagaggagaagggggcgagagtggcgagacagtgtagagggagcggctgccggcgagggaggcgagacagcgtggagggagcggccgccgccgccgctcgcggggagagggggaagggcgccacagtagccgctcgtggggggagggcgccgccaacgctgctcggtgggggaggtcgccgctactacgggggtaaggccgccatcgcttttcgattcgagggagagaggggatcggggcgagtggggaggtggggagggaaataaaatctagggttagggtttggctacagatatttatgtaggtttggatcaatctgaaccgtccattcgatcggatggttccgggttctcccgctcgggccgtcggactattgggcctccaaatagacctgcaagtttgcgcaatcagagaaggagttaaaggaggtaaattagactttatttacgggatgagacagtaaaaagactaaaaatggcccatagagaaattggggtttttatttacatttttatttaaataaatgctgaaatgatgtttgtattgtcaaaattagcaatgaagctccgaaaattccaaaaaagtttcaaagagcgttattaatcatggttaatttaataaaaattaaatccaaccatatcatattattttacgacctgcggtgggaaaaggcgcagctactgtcgcttacgttgggagagaaggggtattgtttatgtctagaactata

SEQ ID NO: 50839 - DNA, 1501 bp, Oryza sativa
tcgccacgatccacaccttagtgcaccatgatcggttctcagtgtgtgccatcccacacgccccgatcacggcgcatgacacgacatgcgcaaccagacagccagaaaatgatagcagctaaataaactagctacagggatatagataggattatctctgaatttccaacaataatctttttcttttcagcggcatgcacacttatagtgtacagtaagggccgggatctcgtacaagctagaagaaaaggaatattttataccacttacttagcatcacaacgctgcttccttcccacataagctcctccttgaggttatcgaactcctcattcgacattacggccttcttgtcgtaataaaaggcctaaagagaaggaaaaagaggaatctaatcgaattaaattgtgactcaattgacttgtaagtatagtgtatgtaaggtaggaggtagccggattcaacaagagggaagggcagggcagggcacgggcctgcagcgcctggagaaactcctgctccatctccccaatagtcttcttctccttccggttgatgctacagtaggggagcacgttgctgtcgactacaccgtcttcattttcttcttgttgttgctgctgctgcacccctccttgctgatcagcagcctgggcggcccaaacccggtgatggagtctccagccctgacagttggaccaaccgtgcgccgaagatgacgttgtgatgcggcaccggcaccggcacctcgaggacgaggatgtggacgccgcggcggcggcggcggtggggaacaccggactgggtaggagcgaggccatgaaggcacgcgacgccggccaggccagcagctagctaggcgaggcaacaggtactggtagtacaagagagcggcaacgggggaagcggccggatcactgcgcgtgtgcgggagatgcggtcgtgcgaaagggataaggtggtggtggtcttggtgaacgggggagcgatgtgtggtggtctggcgctcccctcctttatactgtgatgatcggaaaattacacgccaacgacaaaatcagacattgacgattggaagaatcgcacggacgaaacggattgacggacgagaaatcttaatcttaactaataataataataattaataataattattaaaagattgatatttttccaatcgtcacccaaaaattatcgtccgtaaatccgagtggcatcctccgtcccgcacacatgtgttcattgcgtcgccaaacaaaaaaaaaacagagacagattcaaaatccttcgcgtaaataacaaattttcccgttcgtcacacagaaattttcgtccgtcctccaaaattttgaccgattcagtgcgcatgctttctgcacgacttgtaggagtccgcatcaaatacaaataatccaaaaaaaaaacaaaattgaacaaatcgatttttaatagaggcaaacaaaaacaaaattgaacaaagacaggcagggaggataccaga

SEQ ID NO: 50840 - DNA, 1501 bp, Oryza sativa
gcgaaacacatcgacacgaaattcgaacaaaaagataaataaatttgggtatatatgtaccagtgatcgtaaaaatatctttaggcatacatcaggtcaaattttcgagattacattcatcaattatattttttttcaaaaaaaagagagaagaagattagattggatacatgaatattgtgtggttttttcttaataaaatatattctttctctatttcatattataagttgtttttatttttttctctagttaaacttacttaaatttaatcaaacttatagaaaaatatagtagcttttccaacacaaaacaaacatgttgttaaaatatattcaatgctaagtttaatgaaactaattttatattttaaatgttgctaaatttagaaaaatataaaatggagagagtaacatatttatgacggtagcaattgttacctgaaattattgagattgcaagtctgaaagttctgatgggcatagcaaacttcagtgtttctagagaagtaataaaaagacgacaaattaaacaggtgactcgtttaagtaatttgcaaaacgaattgaataaattacaccaagttgcaagttttggtactccctctgtcccacaatataagaatctaaaactagatgtgatattttatagtactatgaatccagacaaacagactgtccagattcatagtactagaaaatgtcctatccggtactatattcttatattttgggatggagggagtatcagttatcaatagtgtattttcactctaattttaaagtacttatatttttttcatttttttattatatgacaatgggatcaatttgtattttggagaatatctctatccataaaagcatttttcaccgaaaagcaattttgacatgaataaattattgaaattgcaagtctgaattcttgggttacgtgtctgagtaacagcccagcataacttttacatatgggcttcccctaatgatgacctctttacatgatttccgaatggaataagtccacattaagtccctcaatacagatgcaatctgatttatttccttgaaccaaaataccaaataggttatccaacttttaaaacctgtaaaatagctcccttagtggttttggtggtggtttttcactgacgtggatcattgacctagtctaaccgagtgagttggcgtgtgggcccatatgtcatcctcttctttccatcatcaccccttcctctccagcgggtaggcgatggcgtcggcgccgatgatatcctatgcgatcaaatgcgcgatgtatcgagttgcatgcactaaatagttcaaataaaaagctcaagctgatggggaaagacggacaattcactttatattctaacactctcccttacacgagcctcccttaagccttagtgtggaatagaagtgagctgtaatttttgtttaattgcgtaccaaccaggattcgaactcgagttttctagctctgataccatattaagttg

SEQ ID NO: 50841 - DNA, 1501 bp, Oryza sativa
tcttagtccaggcagatgaatacaatcatatttcggcgcatcgtcaccctagccatagtttcgatgggttcttaccctccagcagggctgcatcggttaagtttgatctccagcgaagggataagccctgtcatcctggtaatcgtatcggtacaattagaattttcccgtatttcgcttgatattctgactagtctttatagtcgtcggtttatctttgatataccaacttttgctaaggctgtatcgcttcgatctcttggttcgatatggtatatccatcacgtttacatagatctatctattacattgttgctaataagtttaattctactaaatcaataagtttaatgtactgttcattggagttttaaccgatgagttatcattattcaaagcttcaattagcagacatatcggcttagttagccgatatacatttaaatctacatgtattagacattaagccaatgtatgttttaatcattggacctgcatctatcatattacactatatctatcagtattggttgatttattcattggttcaattattcatatcatcatggttagttgcatgataaaactaactaacacgctttgagcctaacttttatgacctacattagacttaagcaaatctcttacacctctgtgagttggacaaaatttgtggcaacaaaaaaattgaattcccattgaaattcttagcgataattaaatcggaaagattgaaactccacaggtagacttcctaaaaattgtaatttgattttctatctttcagatgcacaatttatttttcatttatgtacaattttgaaattttcaactacaaccattttcaaatttttgcaccgatgggcgatatctttctcgaggtcagcaatgaaaaaaaaagtggaatttgtgtggtgccaagcacgagggtaccagttatgctttggtcagcaacaagaaattagtaacactctaaaagtcataggagcactggtgcatgccaaactttgtgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacagttggcgcgccaggtaggggtagcgtcaagcttttcgccgatcagtgcaa

SEQ ID NO: 50842 - DNA, 1501 bp, Oryza sativa
gaagaaatgcgagaagaccacaatctcatgagtatccggagacgggaaagcctcaccgtgcgctggtcgccacccgatgatctccttggcagggagaacgccgtgcgccaccatctccttaagattctcctccgttacgtcggatgacgcccattggccttcgaagctttctctctcttccgccattggtttcgctcaaatgtgctgatttgattcgagggatggcttgggagaggtgagggattgaggcggtggatcacgggaaggattttgatgcacttttcgaaggtggatttggccggagttgtgaaccctagttcgccggcgcaactttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcgagcttttttaggctacaaaagctgtttgggattaactaggaatgacttgtttttattatagtcatttccttggcgtcttatatgcctgtttttatggtaaatagtcatggcctaggctattcgacttatttattaccataatctttataatacttgatgggtaatctttggagtttttatattcggatgcctgtcgagtgtgttcattcgtgaaccttttagagtgtaaaccactcagatttcttttattgtggctaaaaagcagtcggctagcatgcctatttaggcgccgcgtacgcttttgtcatataatgcacgattgtgttattattttgtctttcaactatatgtttagtttgttaactaatcacatagttgggggctacacctaattaggtgcatctattcgatgcaccatattctttatcttttcgccctttacagtcttcgtcttcgctactcggcaggccttggcatgaataatttgaagcactcggattactatctttgagaaggctatgatggtcgactgcaaaggactcgggggctactgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacac

SEQ ID NO: 50843 - DNA, 1501 bp, Oryza sativa
ttcatacatatatttcataaaaaaagttttaaatccagtatgcagctttatgatactaaatatatccatttgtgccctaaagtaattcgcaaatcattcagctatttaaccgttcagccattcaacacaaaagaatgtacctcgttggccctctcaagaaggcgatccatagacaaacctctgtaatcttgcgggagactattttgatgcctcaagaggatattgccttgttcgtttaattaaaaaccatccaaacggttatgaatttctttttaaaaaaatatgataacactcatacaacatatctatacaactccataaatttttttatctaaactcaactcacacatcgagatataaaaaagggagacaaatccaacatatgaatagtagcataatataatgttcatatatgaatttgtcactttttttctcaatgtgtaagtcgaatttaaacttgtttttttttggactgatagatatcattatactttatattgtcaattttttaaaaaatctttcataactatttatatcgaaattgaaagaaaaatttatatgagggaacatcccctcgatcttgcacgagtttaccattcgccattcggttgtatagcacttgttcatgtataaaccaagaagacactaaaatgcgcaatttcaatagtttaactaatccaatctttgttgatttgttgctatagtacttcaacaataccgagctactgttatttgcatattggaacactagtctttcacacgtattgttgtactacatccgtcccaaaatatagtacggagggagtagctgctagctggagtagctagtgttctcgagtccaaacattcatggacggtcggggcaccgtgagagccggataagtgcagacagtggtaccaaaccaacagtacaacttctgcagtatcccgtacgcgcgctcgatcatcagcttgcatagtcacggaaaaagcccaccacgtacataaccgataagatcaatcgatcggtttcacggagcaatgcaaatctatcttcagagcagcaatgcctctatgactctattcgcatccagtgatgcaaatccatcgccaagatgcaatctatatacccccggtacccattgcattgtgtatcacaacgctagcttgtacatgtgcgcgcatgaactacgggcttaatttgcacctccgagcgaaacattgatcgtttcttatgaagcacacgcccactggtgggtcagtcacgatcgcgcattcaaaatctctcatgtttttacagtaaaatccaccctggagcctggatgacgggagaatgtagaccgctcctcaactctgtgctcgttggacttggacgcagcctataagtggctgaccccgagttctccgagttagcaagaagccactccactcggccgctcctgcatgtataactagctagttctagctcgctcaggcactcgatccaccgccgggcgcgttggattgagataggctgaggaga

SEQ ID NO: 50844 - DNA, 1501 bp, Oryza sativa
acccagttgttgcccacgatatctacgggtctcgggcgggcgtgcccacgggtaaaatatcacacctacgcccgtgcccattgggtcgggtatcgcggatacccggacccatgggcaaaattgcaatccctaggaagatgagctcctagctctttaagaagaacaaaggcacaaagccactgtgctggaagttttccttttttccctctggtccattttttactttgcaaggtgtgtgatctttctcgagtgcaatctgacgtaaccaaggtttttattttatggatgagagtatgaggctgtgtatagtgcagatggcgagagtagccgtcgtgctgctagacggtccgtgttggatcgttcccgatgtgttcaacttgtttcttgatattgatacgcgatgctacgtttctctttagtattctatgtttagggttcacagtcccgatactgaatcaaaatttgcttgcaagctgtatcattggatttcgcataatccattaataaatcgacaaaaaccaataaattctgaataaattttgttaaaaattaaaatttcagtttgatttttttaaaaaaatgacgaaaaattaagtggtttgtgttttttgatccggtccaaaaattcgaaccggattacactttatttgtgagccctcagtttgtttaaccttggtatgtgtataattaggcgattttgacaattggagagttcatgttcagggtaatattgatctttttctgcttaagtaatcaaggtggtaggtaagcttaagtatatactgacaataatgacataacatcaacatcacagaaaccccatctaaggccaaaatctgtataacatggtccaaccttgttagcattattgcatcctgtttaaggatcaaacaaagaaggagtataaaaatgtttaattagatggtccaaaaccaaaagcatactactacttcagctgacaccctgctaccaaccctatcaacctagtaggagtagaactgtacaagtagataaaaaatcatcaatctcgcaggaagaaagctgcccaaaatccggctgtttgacgctttcccttggaattctgcgaacaaccaaacaacagatgacacaaacacaatggtaaaaacaaccctggcagcgacaagtactactagctgcattattcttctccccatgcatgcttcatcagagcaatcggacccatcgagtgcagaatttgcaggccaagtgttgtagtactgtttccttttcgggcgaataaggttgtggctaggtggtgtttggatccagggacttaactttaatctctatatttagacactaatttagaatattaaatatagactaattataaaactaattacataaataaaagctaatttgcgagataaattttttaagcctaattaatttataattagagaatgtttactgtagcatcacataggctaatcatggattaattagactcaatagattcgtctcgcgaattagtctaaga

SEQ ID NO: 50845 - DNA, 1501 bp, Oryza sativa
agttgccttccagctgaggaaccggacgacctgttgagtggccaggaaaataccagcagtctagatcagggtaagtggaaacaagtaaaggtggatcatagtgcagaccaagtggatgcaaaacaaaaagagcgggaaaataggaatcaaggtgggattcaaactcgtgttattaacaagctgccacctgtattggccattcatctgaagagatccaaggagactggtaaagttagaggacacgtgaactttgaggagatccttgatgtaggacagttcatggaccccaggtattgcatattagcatttctgcatggcaatatctatataagcatgtggcagttccaataaatttatgattcacagtaagcaatttttcttgtttgtatattttgactagctttactgatacatctcattagaaaatcagaattattatgttttagagatgactgcctttttgtttgtaggtgattaggtgcctccaaatgcattttttcaaaaatattagtttggccttattctggttttagtatttggcattagaagggtataattatatagattttttaggtactgaaataaatatcccagccttcgcaccaacatgttttaatggcatgttgaaattcattaaagggcctttattcgttaaatgtttgaggatatgagattcttgttagcaatatgcagcattgaggatatgagatcaaaataaccatgcctaacatctagtttgattgcttttgtttttctgtaaccttcagttctgaggacaaagacaattccagctatcacctagtcggtgtcattgaacacattggccccagcaccagttcagggcacatggttgcttacgtgagaccaaatcaagagcagcctgacggtggcacttccccttggtatcgtgcaagtgataccgacatcagacaagtatctctagaagaagttctcaagtgcgaggcctctcttttcttctatgagagaattggaggctaacgtcgaaggaagtaaatttgttagattagcaagcattctttggatggacaaggatccattcagtagacgtcgtgatcaagtccaattttgtttgctttggctgagtcattgtaggacctgcaaattgactgtaatacgttcctgcccagctgaatagatggtggccggtgttcttaatcagctagtctgatcacattcgtaatctcctttttttttctcatgaggaacgtgttcttcttccctggaaaagaatgaagaagaacacaggactgtactaatgcttggtaatgctttacactaggtagaaaatacaacgatattactacttgatatgtcttgagctttggtcccccaagtatttttggatgtgcaagctaagcaacattgtttcaggcctcttgtttccttgatggagaatgtgcagcatgctttgagtagtacttgctcgtttgctgctttggaactctcctagaatttcggtgttctgatgcatcaatcaata

SEQ ID NO: 50846 - DNA, 1501 bp, Oryza sativa
aattaagtctatgacatatatgacatgctgttgaaaaagtgtggcgagtcacaactgtgacagtgaactaaacacatatctaacaaactgtggcaataaaaaatgtagtgtggcaaaatgtggccatgaacctaacacccctgcatcaactttaaaagttaaagatgctggttctgtggttgaattatcggtggggagaaggcccagttaatgctacttgtcgtctcatttaatttgctatagtccacaactaacgttaggcaagttatggtagtcacaaaagtgtggtgaataaattgctagccacagagtgtggtaaaattggtaagaaaattaagtctatgacatataggacatgctgttgaaaaagtgtggcgagtcacaactgtgacagttaactaaacacatatctaacaaactgtgtcaataaaaaatgtagtttggcaaaatgtggcaatgaacctaacacccctgcatcagctttaaaagttaaagatgttggttctgtggttgaattatcggtggggagaaggcccagttaatgctacttgtcgtctcctttaatttgctatagtccacaactaacgttaggcaagttatggtagtcacaaaagtgtggtgaataaattgctagccacagagtgtggtaaaattggtaagaaaattaagtctatgacatataggacatgctgttgaaaaagtgtggcgagtcacaactgtgacagtgaactaaacacatatctaataaactgtggcaataaaaaatgtagtgtggcaaaatgtggccatgaacctaacacccctgcatcagctttaatttgctgtggttgaattatcggtggggagaaggcccagttaatgctacttgtcgtctcctttaatttgctatagtccagtaggacatcctaggtactcactactcagtccttcactcctttgtcgtcgattcgttcgtggtgctcttaaatatcttcgaaatatagggcctgttcactttggtgtcattttcaaccttactaaattttagtaaagttgccaaaaaagtggctacatttagtttgctgctaaattttggtaactatataagaaatcttgccaaaattttggcaagttaccatgccaaaatgccaaaatttgataaggtttttttttggcagcaaagtgaacatgcccatatatatcacgggttaaggagatggacggtttggatttcgctatcttttgcaaatcatgcaatagtttgtttttgttttttgttttttgtttttttttcggggataattgtgccatagttagtggcctctctgcctcactcgacatgaacaagaacagcagcagcaggaggagacgagggcaataacagcagcagcattttctgattcttctcaattggagagagtgctcagtgctctcctataaatcctactagcactagcacacccaaagcgaccaacgagtgatccgatccgatggacagtcgccgtcccttgcttattccgaa

SEQ ID NO: 50847 - DNA, 578 bp, Oryza sativa
caccaatttctttaaacaattttacaagtgccacatattctcatacaaatattgctagacctatttttaatggacatattgcatttgctagtgattattcaaataattattcgagatctttgaattacgaaaataatatgtcactgcctatgcaaagtaattcacatactttaaaattcagtaatgctagtaatatacaatatatacacacaccttttaattcatcggcgattatttcacaacctactgttacacaacaaattttgccgatgaaagatatgtatggccatgacaatattaattatccagttgattcttttaattcattgcatggcatgccaagtatcggtcagtcacatctcagtcttatgggtcaccttatatagtatctagtggaaataattcggcttcatatgctagtagcgattatagccgaattaatagtagttccactagtgattttgtacccccacatagtttgccatcttcaaaatgtcaatcaaatagtactatgtatatggtcaaacacgcagagttcaaattgtgtaaattcggttgggggcaaactgaaataccta

SEQ ID NO: 50848 - DNA, 1501 bp, Oryza sativa
tttctagtgttgtagtagtattaatctcgttatcatttcacacaatcattccgattcagtttttgggaaaaaaattatgattatgaaaatggtttgagcattcttctgaccgtttccatccctatccatactatatgcatggtgtgtgcccatcgctgcagctaccaaatgttggcagcataggtatcaattgtaaaacgacggcagtctcactattacacactgttactagcacaacaaaagctttatttcgcgatacaagctagaagccaggacaacttgacaagggacgtttttggactaatcctagttcagtagaatcagtagcaagcttgaagaaactagagtggtttctaattaagcaagccatttggtaaaacgactggacaagatgttagatttaattgggtaattgatccatttaaatcaattaaatcaaataaattccaaggctcattatgctaggaattcatgtgtattcattatcttatgggatattaatgggatgatgagttttgagaattaatccatttgattagggaattggtaacttatatcaattactcctaattgatggatggttgatggttgtgtagtggaggatgattcatggctagttgatgacaattagttgctctatttctcttcctattccattggtaacctacatcaattacacctaattgatggttggttgatggttcatggctaattgatgagaattagttactctattcctcttcccattccatgactcttacttcatcttccactcctcatataaaatgagaatggatttgatctccctaaggagaagtgagacacactttcatccatttccaaggcggttgctgctacggtaatcccatcccgacgaatgtgtgcatacgcgttgggagagtaggcctccgaaaccacgcactgctgcgacgtttgcacggacgggcgggcgatcaggtttttggggagcgcaaggctcgactactcactatttatcaacgtctacttcgtcttcaccaacatgtcaaacactggagacaaggagaagaaggattccgtcaacaccaacggaggcaatactacctcaaactccagcaggggaccattcttgtggtataaccttcttacattatttcaattagaagtacataacatttctgtcgacggaggatacccgtagaccggataaatagggtattggggtacgttggtacgaggatctacacgatacgacatcaagacgaacagagagacaaaaattatactggttcagactccttgtaaggtaatagccctaattcagtttatatgagattgatatggaaaaccacagagtacacagagaacagatgaatccggcgttacatgcgagacccttgtcgagatgattcgacaagatcttccggcgagtaggcttcgcatcctccggcttcataacctatgatgggtgtgttggcgctatgattcgatgatctgaacttctcagggggtgtgtctttta

SEQ ID NO: 50849 - DNA, 1501 bp, Oryza sativa
ttcagccgtgcgagaattgggtagcagtgacggggtcgaagcagtgacttgacgagacgcacaaaatttggatcgaagtgagcacgagatcaaagcaccgaactcgccagccggtcggtcaggaagaccggaactctagacggcaattctaagaccagccttttatatgtgtgtcaatccaacccgtcctggattctgtaggagttggccggacttgacctgatatgtatagttaaggataaaaacggctcggagttttctatcattgtgttctgtactagccattttatttcgactctgtattatcttatctggaaatcaagatggaaaacgggagggtgttttctttaactgttttaacggtgcaccattttcatccgaaacaaataagtgtaaagtatcggcaacccattagaattagaaaaatgctaccataacctccatgtgttgtcggtctcgatgctatagtatcattataaagaatttaaattaattatttacttctttaaatctacactaattgcttagtacatgacgttactttgtagtatagatatgactatgacctccttgttcttgtggtacgttatctctgagactctatttcagtaattttgtttatgatattttctagtgttgtagtagtattaatctcgttatcatttcacacaatcattccgattcagtttttgggaaaaaaattatgattatgaaaatggtttgagcattcttctgaccgtttccatccctatccatactatatgcatggtgtgtgcccatcgctgcagctaccaaatgttggcagcataggtatcaattgtaaaacgacggcagtctcactattacacactgttactagcacaacaaaagctttatttcgcgatacaagctagaagccaggacaacttgacaagggacgtttttggactaatcctagttcagtagaatcagtagcaagcttgaagaaactagagtggtttctaattaagcaagccatttggtaaaacgactggacaagatgttagatttaattgggtaattgatccatttaaatcaattaaatcaaataaattccaaggctcattatgctaggaattcatgtgtattcattatcttatgggatattaatgggatgatgagttttgagaattaatccatttgattagggaattggtaacttatatcaattactcctaattgatggatggttgatggttgtgtagtggaggatgattcatggctagttgatgacaattagttgctctatttctcttcctattccattggtaacctacatcaattacacctaattgatggttggttgatggttcatggctaattgatgagaattagttactctattcctcttcccattccatgactcttacttcatcttccactcctcatataaaatgagaatggatttgatctccctaaggagaagtgagacacactttcatccatttccaaggcggttgctgctacggtaatcccatcccga

SEQ ID NO: 50850 - DNA, 1501 bp, Oryza sativa
gtgaccgccggcaggtggacgccagagccttgccactccctcccctggtcaccgtcgggtcgccctcggccggccttgccgcgcgcgccgcgtctcccctgctgctcccgctcggtctggaggtagaagacgatagagagaacgagaaaagagaagagaataggttgtgggccccacttgtcattagcacatcctatttccctttagaaaattaattcggtggaaaataaagtaaaggtttgaccccacgtgtcagcaactgttagtgttaagaacagacttcggattaaaaataaatcatttatgaacagtacctttttgcaatttctcggattaattcaaatttgaatatttaaactagcgtaactctctcattttaactcggatttgagtgaaacttgaacctaaatttatctaaattcataagctttccaatggtatataattaatactaagataatgcataatagtcaacttaaaaatgtgctaacaaataaaattagtactagatgtaagaatatttctctctaacatgctttgtcattgtaataaccacacaaactaattttaaatgatgtctcaaattaatgtatagggagatactagtactattaaattgttgtataattaaacccatgacttatagattatttaaataataaagctagccttataattaggtcaatcaaacatgaatacacatagatgagtctttaatttatttatgaggaataggaacagagttgttatgatagaaccacccaaataaggttgagtcggttagcatccaataattactcaaacagtaaaatcacttgtcaacccacttaaatcacatatactgtacaatccatttaaaatcacacataagaacaataacctacctttagcatatattaaaccaaggagtatatgacaaacatgtatggtggataaatactagttataaatcttgaccttataattataattatagttcaactgtaagttaggattgttcattaagggataatctgtaaccataatatggttaacctaaacaactctaacattcaaagcatggataattattatcctttcataatttattgtgacaagtaaaatatgttcataattaaagtaatgcctccatcagtaaaataataatacaaatgattcactgtaattatttgattgatcctaaatctatccgacaacagaacctctagtatatgaccactttatttagataaatacatgtgtagccataatccttccatagtcattagcttgactaaaccacagattagccatatgtatatctcatttatacactatcgattaactcctaaatagaccacgatgaaaatagaaagattaaggaattttagcccttagcatgattggaatcccctagcaagcaataatagtacgagcaaccctaggttcgaccctgacgtttgtattttggttgtgcatatttgcttgttgttgaatattagtttttctcgcgtattataga

SEQ ID NO: 50851 - DNA, 1501 bp, Oryza sativa
aagtaggtcacaaataaaataaataataatttcaaatttttttaaataagatgagtggtcaaacagtgcaagcaaaatgtcaaaatcccttatattataggcggaaggagtagtggatgaatatgggtagtttatagtggtaaaactcaccttttatgagtactagcttggtatatttaggaccaaatttaaaatctacatgttatatttgagacagattgaatagctaaatgcccaaaaaatatttagtttttgtaaaatgtttaatcacgtgtttgtttatttaattatatgatattcatttaacttgtttgaatcaaatagtgagacattctctaaatattagagaatagtatgaccaatttgaaaaaactgtaaagccgcacaatggaggatgggatgttagatttactgtcaccagtcttttgaagttgtatagatattgcaataacataaaatatttatgactggagggaataatatattatgagtcgaagtgctaagtttagtgatatcttataggactttccaggcatttcgacgatgtatataaacggacatcccatggaaggtattaacggatcgattttgtcgtgagcatatatatatatatgttgcctaatgtcatgggatgaactcatgaacatgcagtgactaggaattaaatttaaaattatactgttcactcaattttttctcaaaaatattcgggatgcaaaaacttgtgcagaaatataccatcggtgtcgcacttctgttacgcgaaaatgatatgacgatgacgttgcgggcggtatcgcgtggcgaaagcgcgagaccgcacggtctcgcgcacgatctcgcggaatggaagagcgagaccattcggtcggtctcgcagaagcaatcagcgacactgaccaatgagatccatttgattagtaattaattacttaattaacaattaactaataataattagtgattaattattctgattagtgattaatcgctaactaggataattaaccgctaattaaatcggcaaggcacggtatcgctatttgcttgagcgatagcgttgattgcttgcggtatcgctgtttgcttgagcgactttcactgtgtgatacaagtcacgacgtcattttcacgttattttcatgcaatggttgtgtgagaccgatagtatatttgtgcaaaagattttgcatcccgaatatttttttaaaaaaaattgaatggacaatatgttttcatatttaattcgtgaaaatgcctagtgccccgggctacgaatgggaataaccgtaaaatctttgagctccagatagttcatttgcctcgcataattgatttgactaatcggacccactgttttagttggagtgttgaatctgaataggctgttttttttcctgtatcgcgcactcgtgctgtattgctgtccccttctgcagaaagtggttttttttttcatatgtttatcctactttactttaataagttacaacatactccg

SEQ ID NO: 50852 - DNA, 1501 bp, Oryza sativa
atggtctaatagtattgacaatataatctaatttaagaatatttttgttttttttgctaagcattatgcaattgtgttgactgaaagcatatgcatgtagcagcgcatgtaagaatacagaggttaatttgcttttttttttgcttaacttcaaacttgtaaccttgccttgcccatatggatcgcaagcgcatcatcttataccaatagggtttttaatttagcaacaaacacttcatgtgacatgtattctataatatttgcacccatgaaacaagttgagtggcttgtttgagtaatttataagattagtgactagagtgcacgcacccaccttacaagttttagtacccacggtgcattttactcttcataaaaggtgcaatgaagaggttgaaaacaacatttttcactctttctatgaaattaactaaaacgagtttatttttgaaattttacatcaacgtgcaacataacctctaacgcatatggtgttttttagaactttttaaactgtaatatatacagtttgtttgttgcatggttttcatgattacaccagaataataggtgcttttctacttgatactttcctcaacaacaccattatgaactgaagaataatttttttcatccttctagtttgagctttcaaccgcaactgtgatcaaccttcaagtgttatttcaacccttggaactacaaaatcttaactttcacgtttaatttgaagtgtgagactgagcacatgagttagctatgtgtgtggaattgaaataatcataaaatttatcaatatctatactaaataggcactgggaaagcaccaagattattagaaatacttttatgctgattaggtcgatctaaatatcatgattgcagatcttattaagagtttgttttaaattgttgggacccaaggtcacgaacaaaatggggataggtggggaaatacacttttcccctaactatcctcaaggtgacatgaacttgagatatattggttgacttatgttgccattgttccaatccaatgtcacatgtcttgctacaaggttaggctgtcttatattgccttgggaggtatacatgaagttacattagtgcccccaaaggtacatgcaaagttacggtaataccctcaaggagctgtaaaccctaggggtgttcctgtacacttggatgactctctggaccactagcgccatcttgcaagggcagttggagtggtcacccaatattttctaatggaatattcttgccgggttgtataatcaagccttctcctcagcatggcgtgtactacatgcccctcttgtaacaagctcgaataatatttgatggataaaacaactttccctgaactagacacgaatagtatttgatgggtaaacacaactttcccatgaacatacttgttaggcgttcgaggccatgtcttggttaaataggaggccaaccctttgttccgggtgcctgctacaacataaataaaata

SEQ ID NO: 50853 - DNA, 1501 bp, Oryza sativa
gtggggctcgaggccggctaggacggcgcagtagtggggagaaagagagctgggatggctagaaaccaaatcgaacacctaggggctaaggaacagtgctagccaactatttctgattttagagggtactttgcaattaggaacttggtgcaatatcgatctacatatcgaattaaatactcccataattctattatatatagagagagcctagtttatttgaatgatcatcatttcatgtgtactcatattatggcacccacctacattattcaaatattttaatatttgataaaataggttaataataactttttgtttatttgattttaatatcttgtgcataattatttgtaggattaaatatattctcgtaaattatatctattacttaaatgtatattacatttaaaatgtagttcttttctttacttttttttatcatttatggtttggcaagtaataggaatcataacaaccagcatgatgcaaaagttttaaaaaaatttgaaattttagtgatttttattatcggaaattttcagggtgttacatgcccgaagccccgaagtccaaaccgagagtagctcgcgcgctgccgtgtcgaccgagctggcgcctccaacaagtccacggcacggggcgggagggaactgtattccgtgagacaatggcacgagaggcagctgcagaatatgtccctgcatgcctggggctatgatatgagctgtggctgtctctgagatctcactggcctgatgaaactctacatggtgcaatgcatatgctgatttgcatttggcgaatagcggaatagggaatcgcgtgcgtagtatattaatccgccgatcacttaacctaaactccaaaaggtgatcgtcgtgcgtacgtacgtacagcgctccggtctgttcggtcagccctcgcgaagcttcacggaaacaaagaaggcctcatgatcgggagatcagaagggaggaaaaaggataacgaggaaactgtttcgctttgtcctcacgcacacacgcctcatgcgtccgtgtttatcgatcatgccactgccctgctgatgaacaagttcttcaagcaagttacggtgatatgcgcgcgcccactctgcaaggagcagggaagtattggcggcacatggagcagcggaagaaaggcatttctttgaaccggatcgtttcagctaatctatcgcccatcaccgcatccgacgcatggttggatggaatgaaatggaattacatttacacgtccacggcgtggttgaaaccgaaaaactggatcgcgtgtcacaaaactcataatgattggactaactgaatgtcgatttcctagcgcaatgattcatcaataatgcctggaattggctccgaaagtctgaatatgaaaatgatggctggatgggactctatatacatatgtcgataaaaagatcttctaaaaatttatcagatgtaaatatattatgattgtagtataacttatatagtat

SEQ ID NO: 50854 - DNA, 1501 bp, Oryza sativa
tcgtcatatcattttcgcgtaacagaagtgcgacaccgatggtatatttctgcacaagtttttgcatcccgaatatttttgagaaaaaattgagtgaacagtataattttaaatttaattcctagtcactgcatgttcatgagttcatcccatgacattaggcaacatatatatatatatgctcacgacaaaatcgatccgttaataccttccatgggatgtccgtttatatacatcgtcgaaatgcctggaaagtcctataagatatcactaaacttagcacttcgactcataatatattattccctccagtcataaatattttatgttattgcaatatctatacaacttcaaaagactggtgacagtaaatctaacatcccatcctccattgtgcggctttacagttttttcaaattggtcatactattctctaatatttagagaatgtctcactatttgattcaaacaagttaaatgaatatcatataattaaataaacaaacacgtgattaaacattttacaaaaactaaatattttttgggcatttagctattcaatctgtctcaaatataacatgtagattttaaatttggtcctaaatataccaagctagtactcataaaaggtgagttttaccactataaactacccatattcatccactactccttccgcctataatataagggattttgacattttgcttgcactgtttgaccactcatcttatttaaaaaaatttgaaattattatttattttatttgtgacctactttattatccaaagtattttaagcacaacttttggattttatatttgcacaatttttttaaataagataagtggtcaaacagtgcaaacaaaatatcaaacttccttgtattatgggccagagggagtatcatttagctttattatagccccagctagtccaagcatgcacctcatacactccgagggaataaccaagttttttttacctctctccttaataattgtgtcaaaggctaaaacttactatattttagaatggagggagtagtatttagtaaaaaaaattattatcggtctcatctcccaagtggatacccccaagcttctacggtccgcttattgaggaatagatataggatggatgttcaataaggacaggtcatcgcaaagaaaaactaatactgcctccctcccaaaataattgtaattctaggttatttagcctccctcataaggtttgaaaagaaagactatgatgtccctcattaaatggtgtataagtaagagtggaagagtggttgagggtagaatagaaagaaatttgaatgagaagtaattgatgggacaactagtactctattgtgataactattttgggataaatttgaattgtagaaatacaattattatggtagaaagagataagtgagcctacgagtctacgactaccaattccatcggacttatcaaatactcggtttaaaaagaattatgtgcatata

SEQ ID NO: 50855 - DNA, 1501 bp, Oryza sativa
agtactccagctatctcagccctaccactagctctaacacagcattaattcctgagaaaacccaacgccaacggagctcgagtcagtgagggggaggcgacaccggcgtaccaggcgagatagcactgcgagtcgccggaggagacgacgtggaaccccgaggcggcgcgcgggggcactaggacgaagggatcggaatcgccctccggtgagggggacggggtggaggggacggtgagctcgatccaccgcaccctgtccgagcccgggatggggacctcggtgccggctattttgcgggcggcgggggtggtggtggccatggaggcctcgccggcggccgcggcggcggcggcggcggcggagggttttggaatgggcgcgggttttgggcggtgaggtggggaatgttcggagaaatttgggacttcaccacatcggtcgagggttggggggagatggtgagggtagtgggccgttttcttgggctgcacgcgttttaggcccagcgcctttgtgaacgaagtggacccggcccattaaagatagcctctcattttcagcccagtcagccaccaagaaaaatataatgtctataatgcctcccttaacaggcaccggcgcgtcaaaacattggatcttaagagcaaatggaagcggctggccatccccggcgacggcgttctcgggaaataaagtaatagtttattttggcatatgcaatttagctcttaatatcaagcagaagctatggtacttcctccgttttacaatgtaagtcattctagcattttccatattcatattgatgttttcccacattcatattgatgctagaacgacttatattgtgaaacggagggagtagcatatataggcgaggcaattagcatatgttgaagttggagcagcgtcgtagttacaaaactgtatgttgtttatgaccaaacctcattttccttttattgcaatgttatgatttcttacggcttctgtatttatcactctttcatagctcattgataacaaaaaatataacctatatttagttggatgcttcacggctcatttgggcttttttttaaggtgaaagcggcaagagtattgcccaatatattagagagggagaaagggtctacaaatcgattagcagcgtattagtacagacgtaaaagagccgccttcagcaagcgagaagaaagcgaaaatgggggagggagatagatggtagacagaagtggagaaagagaaaaaagcagaaaagcagactacatcagggaggctggaacacgaattcatattcttgaatgtcttcattaatctgttgggctgctcgatgtgtgttcggttgttgatgtctgaaaatcttggcatttctttgtagccagacatgccaccatgttaatcacaaacatttgggcaattgattgtttgataatcacaaacaagaacaaagtctttcacacaatttccttccacgtgttaattgatcagcctcttc

SEQ ID NO: 50856 - DNA, 865 bp, Oryza sativa
atagaaggtcatctgacaaggtattttgttcaacatttttcatcggtggagacaacagtgtaggaaatgtatgaactcatgtacttgcaaggagtttaacagatgtccctagaaatttagtgtctaggtctcatcaaccatgacagtataggactttcttttgtcaaaatgtccctaaaaattgaatcgttaaggaactctactgaactattagcacataactttctgtcagatgataacagcacataagtttctgtcagatgataacattcctgaatatcatggttgtaccagttataatttgtcaccatgccagtatgtcactggctcactgccctgtggtgtcatgtatattttcgatgaaatgcactagagcttaccctcaactacagtgcgacggtacaatgcaggataatacaggattgaatttgcacaaatcaactaactgactgcttagctgaagctatcacagacttagtgttcctcggagcatcacagcaaccagttaaccaccgcaatacagagtgtgcagtgtattcccacaaagtaccagatgaataagaccaaaatcaactccactgcacaaaactccatagtactccagctatctcagccctaccactagctctaacacagcattaattcctgagaaaacccaacgccaacggagctcgagtcagtgagggggaggcgacaccggcgtaccaggcgagatagcactgcgagtcgccggaggagacgacgtggaaccccgaggcggcgcgcgggggcactaggacgaagggatcggaatcgccctccggtgagggggacggggtggaggggacggtgagctcgatccaccgcaccctgtccgagcccggga

SEQ ID NO: 50857 - DNA, 985 bp, Oryza sativa
cgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaatccaatataaatttcaaattatatgcgattcaaaattacaccatctcttataaaagttatgatgtaagtttcatgaaaatattacaagaaaatatactgtaattttgagtgagacaattgaatgagagataagaaaaaaaaatcttttaagtgagatatagaaaaatcgttttggatatgcatcattctttaaaaaccggtttcactgtaatatcatttttaaacgcgagcattcgctataatattgttttctttttttattgcatttgcaaacatttttgtccaaagcatatgcaatctctctctgaccacgtactcatgatcgagaccgagccgagcgagaggagagaaaggcgagggaagggacgaccacattagtatcgtcactcactagacacgttgccaccttcccccactatccacgaaagatgtggtgaaaggaggcaggagatattgctcgagtaggttgctgcttcttgctgctcctacctctcttgtctcatggcgtggcatgccactgggcttctccctctcgccaaagaaacagacgttgtggtcgtctcccaacaaaaccttctccatctctttcacga

SEQ ID NO: 50858 - DNA, 1501 bp, Oryza sativa
atatgtttacgtgcagctgtcatgtatggtgacctttaatttggatttatttatgatatctttagttcttagccgtgaaagacattatggtatgtttatttgctgtaaaaaaaaggcaattatttgtgaagtgtaaagttaagtttggacactttatgcaattatctgtgtagcacatgcacatacctgtttgtgtttttacatctatgcacatgcaatacaccgaaatactttgatacaattttgttgagggtgatgcattggttcagaaattcaattctggccgtgtgcaggaattagagataatctatatatgaacttgcagtcgtagaggtacactgaccaaacaaattgttattgaagagaaaaaaatatctaaggtttcactgaatatttcaaacgaattgtatattctagagtaaattccctgtgtgaaaactcactcaatactttctttagctaatcccttctatacccttgaaatttcaacttgatcccttccatgcccctaccgttacattttccatcatttcactattacgtttagttacaaatgaccttttttcccttgatgctttaggtttgaatataaccttcaaaaacaattaaaaattttgtttgagtgcgcagtatgtgcattttatgaaactaatgagactaaataattagtgcagaaaattttgacataaattttgaaaataaaacaaaagtaataaattgaagtttttatttgaaattttaataggacaatggattttttttatcgggagcattcataaaaccattattgtgaacattggtcctatatttgtatgaatgctcctcattttttatgattttttttaaaaataaatacatattttttatttcattatataaaaataattttggggataaataatacatcgcacaacaaactcataactattaatagtctcatgcgggaaacttttatatttttaataatgtaattcataaatttatatattcatccgaagggtaaaatggtcatttttatagaaattagacggtcaactaacggtcaactgacgggaggggtatagaagggatcaaaatcaaattttaggtgtatacaaggaagtaagtgaaattcaggggtatagaagggattagcttaatttccaggggtatacaagggattttctctatattctaagcctccatgcgagataagagttaacgatcttgtgacctactttttgcgagcacttcttggatgccctaatattatgtttgcttagtgcctttaaggagaaccgaagcaatgctaggctcagtgtgtggcgtgttgtagcatatagagatgtgttcgtaccacggaaatgataagacattttaaggatgttttttattaatcaaataataaatctactatttatatattttgcctacatttattttcttgaatatataatttataatttagaggcaatggtaagtcatatatatgtttcttgatatcattcatctgtcatgtatg

SEQ ID NO: 50859 - DNA, 175 bp, Oryza sativa
caaattgaaacagcaaatctctacgcggcagccgccgccggcagcacggctgtgcacctcctgggagcgggcgccggcgcacgcctcggccgctcgcgcacggcgcgcccgcagccgccgccgcctcgcgcacggcacgctcgcgtccgccgacgccgcctcgcgcgtgcgccca

SEQ ID NO: 50860 - DNA, 1501 bp, Oryza sativa
gcataatagggttgcatttgcaaaagcagcatttagcaaacatttgagaatttaataaaacagttaagtaataattaaacaatattaatccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagtcgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgagtcattagttatcccgaatgtgtactaatgtttctaagcagggctaagcaattatatctaatatctagttgaaccaatataaataaagctcaactagtcaaattgtaataacccaaggtatcaaggaataaggtaatcaaatacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatctaagcagaaaagagcaaaatcaccaaaacagcacataaacaagcatgaacagtacatgtggatatttttaatgtgtaaatctcaattttagaagaatttagagacttgaaccaactaaatcggagctaagatgaattagttatgaatttttaaagattaaatcggattaaaacacttatatcggttaaaattgaattatgacgcaataatgaattatttttgaaaaggaaaagagaattattgcgtcagcgggctagggtttggtggaccgggcgcacgggcgacggttcacgcgaacggacggccgagatcgatccatccaaaacggacggccgagatcgatcgggtccacggcggctcacggcggacgaccccga

SEQ ID NO: 50861 - DNA, 1501 bp, Oryza sativa
ggccgactttcggcccaaagccaaaagaagactttttaaaactttttcaatttaaattatttcttaaatgcaattccatttattaaaaatacttccttagctcaaataaatcccagaaaaatctaggaattatagaattaagcaaagtatttaatgaaattttatctggccactttttatattggaatttattaattaaacttagattttcttttcaagacttttaaaataaattctagaaattccatttaaacaacaatttatatattttgaattttcaggatgtgacaatcggccaccaccgcctccacggggacctcgccgtgggcagccgccatcgtccgatggccgatgcgctgctcctccgacctcaccctcttgcctcgtccagcggcgacggtggcggcagggatagggcgacgtcgatggtgaccttgttggggaagcggtgcaggcgacggcgaggaaggtggaggccgaggcagagttatgacggggagtgccgttggcgagtctgcacatgcagcggctcgtgtggtcgctaacgacacctgctcctgcatcgttgtcgccaccaaaaggcccttcccagcccccgtgttcccctgccgcgcctcttcttcccctcccctctccacctctcttcctctctcctcccctctccatgggtggcactcggcagagagcaactaggcgtgggcggccgggagaggagctgcatggcggtagcgggcgacgtgggtgttcttggcgtgtagaacgccttagatgcatgcgagcggcgggcggcggggagcagctgggctgggcggcgaggaaggagcggcgcgcgaggggcaaggagcagttgggcgcgggggcgggggaaggagctgctttgccgctggccggccgcgcccacgcagagccactcccccgccggctgcctgtggagagaagaggagaggagagagtaagagaggtggagagggggaggggaagaagaggctgacgtgtggggcccacgctgagttggctgccgcgtcggacaaaatcaaagtcaaaaccgtcgagggacatagtttgtactggtttttctaagtttggagatgtgttgtatcaggttttacgattttggaactcgatgacaagctggggacctttggtgtactttttccttacgtgaatacagcgcctccccaatatttcggctcgtatgcctctgcgacgatagtagtttgtgggccgttgcccgacgttactccgcattgctgctcggtttcgtccggccacgggtataggttagcctacaactaagagcatcatttgtggctgtgctaccgagctgttttttcatcgtatgaacagtagcactgcagcagtgcgtacgatataactataccattacacaaaaacttacaccacccatccatctgctgagcagagtgccatttgtcggatctgggttattcccgaaaatccagcgaggaaatggattagtgcccccatatcttttccttgt

SEQ ID NO: 50862 - DNA, 1501 bp, Oryza sativa
taatagggttccatttgcaaaagcagcatttagcaaacatttgagaatttgataaaacagttaagtaataattaagcaatattaatccaacgctatacaacataccctgttgtataggcccaaccattctgaacaaccaccccggctgcacagttctatctccaaaccaggaatgtaccattccaaaccaggagctaatcaaattattaccagttatagcatcttttataatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattaccaggttttagttggcacattaattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcaaaaacggactctccggaaacgacggaatctaagcaaaaagaagcaaaatcaccaaaacagcacaaaaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaggatttattgcgtcagcgggctagggtttggtggaccgggcgcacgggcgacggttcacgcgaacggacggccgagattgatccgatccaaatcggacggccgagatcgaacgagtccacggcggctcacgggagaggggcttga

SEQ ID NO: 50863 - DNA, 1501 bp, Oryza sativa
caccattctgatgcgtgcattgatgcttggttttacaaagcaagaactttgaatagtctgctgctgtgttgacaatcataccaaaccgctttcttcatgccaccatcttcttcttttgtttgttcagggcactgtacaatataattccagctgcctgcctatgttgtcatcctactcaagtagtacatatctgatgtacattgtggattataatccgtttgtaacactaactcttcccatcttattctacagagcatggcaaagtgttagatgagttcttcctctctaccgctggtaatgtcattgttgcaggctatttaaaaatttgtaaacatgtcctctgttgttaaacatatctgtaaatcttgttactgcaggcaagttccagacagagattggcaagagctgggctgctgaagtgaatgcgaggagagaacagagatgcggaaaacagaagtagaagtggctagctctacgtttgattgctttagccttgctgaaatgtgctgtcatgacggggtgatctgacgagttgcaaggtccagagtcaacttcaatataaacttgacttgttggagacttggtaggaaatagtgttgtccaaaactcaggatctgagcccgtccagagttcttgggctgcgctcaggctcgcagtacgtactgagcaattgctatatactcctaatagttagggatctaaggagacatgcgttttcatgaactcaggtaataataaaataatagtaacattttctgttttacgttttacatttgatggactggagcatgttcaaccattcattgttttctctattgcataaaaaggctgcacgagccacttgtattacgttgtcattcctttttgccattggttttcatcgttagctaaaaatattgctatagaaatcaatgatgggaatcgctatgagctgatggtctcatcagaactagctccgtgctgtatctgttcatctggaccattgcaatcggttacgtctactgggcatcgtagtcgtacccgataagccacgtatccggcctatacgatgcaagtcctattttgaatacgtatgcacagcagtagtctgtagatcacactgtacggtagtcaccctccgtcccaaaaaaacccaatcctgggtttgaatctggacatacactatgtccagattcaaacctaggattgagtttttttacgtccgtatactagacatactgggcgtcggggccggcctggagctggaagccgagacgaactgtattttggcatcgcggccggatcggagcgggaagccgaccccgaacactagtaggccgctacctctaccaccaataaaaccacacgcccggagagccgcatagccacacacatcgatcgatccaagtctcgacacaagcccaacgcccacgacatcgaagcaaagccccgcggtttacgtgcttctccagcttccggcagccgtcgtaaaccttccacaagcaagccgaatccgtcgaga

SEQ ID NO: 50864 - DNA, 1501 bp, Oryza sativa
atccagccaaaacttagcaatattgttaaatttggtcaggtttatttggctacaatccgaacaaggctgaatatctggtgagaaatctggaagctgcgtggctagaaccagggtttacgattccgacgaaatccgatcggatttcgcgaaattttgacatttcgacgagactcgaaagtagaaaccatctgagatttcgaggaatttcatccaaatttaaatttgaattgataaaaaaatcttataaatactatgatattcatagaacctattgagatataaattttcgaaaaaaaaatgatgtattgtgtgtatttactaaaagctacatcaggaaagaaaagaataaagaattaaaaaaaagaaacaaattaccgatcggaatttcgatgatttcgatcggaatttcgccaaaaccgaccggttttcgagaacttgtcagcaaactcaaggatttgtattcaaattttattcaaattttggtttataaaatttgttcgaaatttaccggttttccaccggatttcgtgaaattccgaatttcgccggtgcccgaaacggaaggtcatgtcagaatcctaaaccctggctagaactagaggccccttaaaccattgatgcaatacctgtagtgcatattggagcatggaacagtcggaaggggtgtgacttgtgagaggtgaccggggtcgtcgtctccgaaggatcctgcttctctgctctggtaagacccgatgggtcgaatcatggcgcatggaaggacagctctctttaaaacctgattggtactccgtactctggtgtgacctgcttgtgcttggagagatatctttttcctcggcctcctcccctttctgcctctcgcaaggtgattgatgtcttcatgaatgtcagatggtggattcggcacaagcgactccacagatatggattcccttctcgtttaccgggccggtacttcgtgctgtatatcatcagatcctcactgtttacctcttctctccacgtacgttggcttatccttctcttttcactgtaatcacgttttgttccgacgggtcatgcaaagcagttttacacaacaaagcaagacgcttgatttcagaatgcatctcaattctcaagctcccatctactgctcccagaatcgttgcagttgcagagctgccgctaaactcaacttctgaactcatatggttcaaaacagcaacactcactaacagtttggaacttctgacagtatatacagtggttttctattcttctctgtcagtctaacagggcgcagtgcctacttcttcctcgcgtggattcgtgctaaagctagtaagctcttggtcttttcggctaggtaagacaaggcgacattccctgcagcttatacccactaaaagcgattaagcctctattaactaagcacgcaagtgatgatggcctcatgctatcattcgatgggggctcgcccaggacagcatgcggcgcctacccatgaactcctgcc

SEQ ID NO: 50865 - DNA, 1501 bp, Oryza sativa
gttgcatctagggtgaataaggatatattattattctgttcgatgttcgtgtgcgccaaaatttccgaagtggactggaaggctccaaatcaaaccctcaatgtgtaactacaattttattccgagtaattttcctcttttttttcccttcagatgtacaagaaatctgcgtatcattatagtcatctcataaacacccactaaagcaaagttaaaaacatgagaacttgtcaaagaaaaaaaggtactacgaccagcaacctgtacaaacatatattcaaggtcaaatactagtaaggcctttggtctaccattctttgagtacttttgatttcagctaacttcaatattatgatcaagtactacaaaactacaaagattttaacacatggcaaataagcgtattatggtcctaaggtttttacaaactacaccgtataatcaaatgtttttcttatcccaccatgcttatgatttatgaaattaatccaaaacatctacaatatgagagttttaatcatctaacttaagtgtttttatttttttttcaatagtagtagttaaattgattaatggtgtggttttgtgtaactcagtgctaaacatatgtggatttgtacaacgccgaactacgatactccccagtcccaaattataagacgccccctttttttttagaaaaatcaaactcggtatattttttactaatgattatactaaccatatatttatgttaagtattatgcatgttatattactagattcaaattttaaagtattttcacgtgatggtaatttcatattcattgaaaatacaaaatataataaattaatggttaaagtatatcattgaaaaaccatgtaaaaaattataggccttataatttgggacagagaaagtagattagtttttgtgaagttctactcatttctttcacttgatcataatcttatggcacgcaagctatatagataagaggttccaactcaagaaatctgaaaccacattatgcacacccagcttgttatacataggaataaaagcgacaccaattttgttacaactggcacagcccaccttaatcgtataagaaaatgggctgcagttgggcttgtcctgatgagctgcattggcgtggtttggccctgttgttcaccaggaaatactacatgcaggcatgaagcaaccactacgaaaaaacaagatcatctgccgcaaaacgcactcatactcgcatggttttctcatgtgttagcatccatattctccgaagtgtgcgtatctgactcgacgaataatggaactcaactatttccaatagcaaactcacgtccggtaactctgcaaacctagcaagcatccaattctgtaaaagctcccccgttgcatcgtgccatcacttgcctggacaagcaacaataatacaggggcgcctttattcctgcacatctaggatttgtactctgcacacttgagagagatcttgcatatctagcacga

SEQ ID NO: 50866 - DNA, 1501 bp, Oryza sativa
ttatgcggctccggtcctgtggtttttattggtggtagaggcaagctttcgccgttcgggttggtttccagttccgatacggccgcgacgcccagcgttcgcgttgggctccatctccggttcggcggattatccaactcgggcctgtatctggactctgaagatacaaaagacgtactgttgccggttgggatttttccttgagatcatgtagtagttctcggaatgggactcgtcatcgtgtacgtttctacgactacgatgccggagtacacggctttgtcgggtacgattatacgatgtgccgaaaagatgcagcccgatctaactcaggactagtgtgattcttgtattgtaagcgacgaagtgcatcccagtcgggtacggtacgattttgatgtcgaaagggcgtaaaagttctgtcattgcggatacgagaaaaacactgagtccactctcacacggtaggagtacatgcattatttgaagctggccggcgtgccaggatgagacgaaaaaaaatttggtggagaccgggtataattctgtaaatcggctcccgtgcagccccgaccccgatgattgccgcatggacaatctcagaatcggacgtctagttcgttgcggcttcaggcccagcgcaaatatggcataggagcctcgctcgactcggctcccgggcccgtcgggtcgtgggctcatatccctctcgtatcggcctcattcgtccgcagcagccgccgccgccaccgtcggccagcggcgtctctctcatctactgtctctcgtccaccatcgctccctctctcggacatcgtccactcggcggtgatgacgagggcaaccggctcacaatcgccgacacccactgcggcaactccatgcatggttggtctttcggcaagaaatttaattaccggtaaggagattgaggttgagggtgatgacgcggaggttgtacacatcggtcttgtcactcattttcttgaactgcacattacgccatcagaaaatgttagtggcactatcagtattaggtatatagatgccgaaattttgataatttaactcttttagaaaatttatttgaaaagtaaaccgtgtcaaaaacttatttcaaaaataaaccgtgacctcagcgtcattgacgctgaggttaacgattaaacgccaacgatcatgacgctaagcacaccttggcggggcactatggagggttggatgggatcagccatgggttttggcgctgaccccttatgtagtgataaagtgggtttgtgttaattcttgtcactttctatgatgtgccttggtggtttaacttcctatgatcccaggttcgacccctcattgctcatttttttgcttgctttaatcacacgaaaagaaacaaaaaaaaagcaggacgtagggatcgaaccctagtcttctgcctgacagtggacacattcaccgttgtgctatacttcggttcataacagtattagccatgttttgcatg

SEQ ID NO: 50867 - DNA, 238 bp, Oryza sativa
atccttttccttttcaaaaataattcattattgcgtcataattcaattaaaatcaatttaagtgttttaatccgatttaatcttcaaaaattcataactaattcatcttagctccgatttagttggttcaagtctctaaatttttctaaaattgagatctacatattaaaaatatccacatgtactgtttatgcttgtttatgtgctgccttggtgattttgctcttttctgcttaga

SEQ ID NO: 50868 - DNA, 1473 bp, Oryza sativa
cggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggttgcatttgcaaaagcagcatttagcaaacatttgagaatttaataaaacagttaagtaattaaacaatattaatccaacgctatacaacataccctgttgtataggcccaaccattctgaacaaccatcccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactgtcacaccctgaaaattttttaaaatttataaattgttgtttaaatggaatttctagaaataattttaaaagtcttgaagagaagatcttgttttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaaagtcttcttttggctttgggccgaaagtcggcccaaaacctctcttctctctcctcggcccaagccggcccagtccgccgcccgcgcgcgcgccctcgctcgctgacaggtggggcccacctgttagtcgtcgtctaccttcggccgccgccgccgaaaccctagtttcgcgccgccgccgtttcctttccaaatccggccgttcctttccttctccggccgaattgaaagaggggaaatgatccttgggatctcctctaccttttctcctttggaatctttggctaaatcgttttggaaaga

SEQ ID NO: 50869 - DNA, 1501 bp, Oryza sativa
catccgtgcatgagtcggtttttaagttcgttcgcttttagaaatatagatccgtatttaagtcaggttttaaattcgttcgcttttggaatacagaagtagtcgtataagaaatctctttaaaataaactcgcatgttaacttgacatgattttctagaaaaaatatatatccaagcgagttatcacaatgaatttcaatagcctttaccgattgcaacgtacgggtatttttttctagtattatatataagtgtatccctgtgttgacgcttttttgtggccaacacaacattacctaacaatttgcagtgtaaacaatagagtcgccaaaatcaatagatcaaaatcggctagtggaaccgatttcaagattaattcactttcgcggaatcacacgactaatttataaggaaattagcaaagagggtaaatatcagcaaactagcaaaggataatctcctcgctttcgtggtgaagcacgaccgtttttcagcgcaaaacggcaaatattaactaaattctagggttaccagaactcagctatgaaaacaaaatagaaaataataggaaagtaaataacaagaaaatagtagattgatatttttttttgggggggttcctcaaaactaacctaatacactaatatttataggagcacctgaaccctagccgcaccacttgagcgtacatggaaactccaataaattagctaacagaatccgactccatctaaatattaacaaacaaaaaataaatagttcgcatgcaatctaatgccagtcttccagcctgatcactgtcacccttcggtctatgtggcacgggtcccgtgcggcaacagcagcacagctcggcaaattaatcatcaatcaagcactgatccccgtcgcaaatctctcctaggctgcatgcatgtgacaagtccaaaccaaataaattgctgctgcacccagcattatacacagatcatccaagcagggcatcacaaattcctgcacacatatatgtttcaaaactctcgagcaaacgtctagataaatgtaccaactactctcaataatttggcctgcccaaataaactaattttaagccaaattatggtacaaacacatacccctgttttcagtataagaatcataacttttttttaccgaaaacactataaaaattaaccactaatatgatatttgtcctaaaccaatccacagtcatcttcttagaacgatactttgaacacggtatcagttctgagcccatccatagtcgtcctctcaaaatgatactcaaataggtatccgttttaagcctatccacagtcgttctctcaaaacaatactcaaataagcattcgtattgagacaatcaaacctcctacaaataccttctcaaatattttccatttagtacaaattttactactaattcggtcatcactaatgtccacctaaccgaattaacctatcctccaattctggctatgatactacactatctgtagc

SEQ ID NO: 50870 - DNA, 1501 bp, Oryza sativa
tagtagggtttcatttgcaaaagcagcatttaacaaacttttgagaatttaataaaacagttaagtaataattaaacaatattaaatcaacgctatacaacataccctgttgcataggcccaaccattctgaacaaccaccccggctgcacagttctatctccaaaccaggaatataccattccaaaccaggagctaatcaaattattaccagttatagcatcattaactatggtgagaagtgtgaaactaatcacgaaagacattgttagacccgcccataaccgcgggcacggctattcgaatagttttactatgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaagataaagccgttgcccacgctggcttgtggttggcacgattaatgtttcacaaccgaaactcgtgaaccggtccttaattgtcatgagcacgaccatcaaaaccatgtgctcacaacccaccattatcaggttttagttggcacattaattaattaactaatcacgattgtccatcgtgaactatcattaagccatcattaaataatagtgagtcataagttatcccaatagtgagctaatgtttctaagcatggctaagcaattatatctaatgtctaattgaacccatataaataaagctcaactagtcaaattataataacccaagggatcaaggaataaagtaatcaagaacaaaaagggctataacaatgaataggttaattccacccaatgacattcgaaaataaatgcaatagttgaaaagaaacaatagctttaaacaggatcaacatgctcaaagggttgtttgggatctgtgtgacttgccttgctggccttggaactcttcaaactcttctccggcgaaaacggactctccggaaacgacggaatctaagcagaaaagagcaaaatcaccaaaacagcacataaacaagcataaacagtacatgtggatatttttaatatgtagatctcaattttagaaaaatttagagacttgaaccaactaaatcggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacggcggcggttcacgcgaacggacggccgagatcgactcgatccaaaacggacggtcgagatcgatcggtccacgaccggctcacggcggacagccacga

SEQ ID NO: 50871 - DNA, 1501 bp, Oryza sativa
gggatcttctcctcccccttgcaatctcttcatgtcatgtaaactcagttgtaacccttactctatttatttaatgcaattcaggtggggaacctctcccctccggtgacttatctaaaaaaaataggcgtaggaggctgctgcagcaaggtgtcgctcatctggcacataagaatcatcatacctatgccagcaatctgctgcaacatgtccccgcttgtagcacaccagacacacgggtcgtgtgtcgttgccggagcgctgctgctgtccagcgccacgtcctccacagccggcgtttgtgccagcaccattgaagccgccgcgaccaccacgtccacggccggcaccaccccggttgctcggagcgttgccacggccgcgcccggctacattggccgtcatgttgccttctcgtcgtagattaagcctgttctcaaagttcaatagctgggcatatgtttctgatagagtaataggtttagttttggccgctaaagccgatacaacagaatcataatcatcatctaaaccatttaagataaaagcagtgagttcttcggcatcgacttgcttccctgacatcgctagttcatctgctaaggccttcatcttggcgaagtactctgagatggtctgggttcccttcctagtgctggtgagagatagcagcacgttgagggagcgcgcgcgagtcgccctggagttgaacatctcctggatcatcttccaggcatctgtcgctgtggtcgccgtggcaacctgggataatatattccgtgacagcgatgaaaagaggaagccgagaacctgttgatccgcggcaaaccactctttcgtacgctgggttgtcgatcatgatcttgatcttcgtcttgtcatcttctttcttttctgcttcgatgtgggcggcgggagtgacggtcttgcctttcagatgccccttgaggcgtgccccacgaatcgcagtcagcacttgtgcgcaccacagctgataattttgcttgctcaacttctcagaaacattgaagcagaacaaggaatttgtggaggtggaagaggaggagctagccatggtagatgggatctaacttcagcgctctgataccatgtgggaaaacaggatggatgggaacgtcgtcctttgcactcgggtcgacgatgcgtgttaacctatcgcacaaaacggcgatggagaagatacaaataggcatgcgctatggatagaacggccggatccttattacatgtgatcacaacaacctaagctaatctatagcttaatccaccggccatcctaatccaaagcacacggattacacagagatatactttaacaaaatcgagttgaagaaaagacagaaaatcaaatataaactcacagaatcgaagacaaatagtatctgatccagccaaggtggaaaatcgctctgcttctttcaagtgaggttgatgctggccgggagcggctgcgttgatccgcgtcacctgcgcccaatcc

SEQ ID NO: 50872 - DNA, 1501 bp, Oryza sativa
cgccggatccaccacccaccatgctcgccactaccctcgaacctcccccaccgccccctagcctcgccgtcacccacgcgcctcccaacaccggatccatcgcccaccagcgtcgtcgccgcccgcgcgccttggccgtcttagctgctgcggagccgtcaccgctatggccgccttggccatcgccgccacggccgctgtcgctgtggctgccttggccattattgccgcggccaccgtcgctatggctgagagggagtagggagcaaagagaggaaacgaaggacaggaaaggagatcgatctgtgccagccgccacgaggggggagggattggcaccggcccactgcgcaagggagtcggagaggcgccgacgcaagcagaacatacttaggtgcttcgatgaatcatcgaggtcaaactttataaacctagccattatcttgtgcaacgcacggacattttgctagtttacacagatgacccctgctgcccaagtggagagcggcaaggtgtgcgtattttgcactgatatcccttaccaccctctacaagagctgcatgggggtaaatgtaatttttaccctgccaaaaatgcatttttcttttttttttcaacttgtccgtccctcacgtctctcaacttctgtaaatatttttaccagtacaatatttctgtaaatattaaaaaataaaaaatgaaaaatgaaaaaaattcgtctcgtgcccgtgcccttccgacggcggtggcttccaaagttccaacccgcatccggttcgctgagccatgggccgtgggctgtggcccaactatagcggctgtaagaaagagaatttttttcggttttagattttttttaatatttacagaaataatctatcgaccaaaaaaattgcagaaatagcccctgccgcccacctctggggcggcaagctgacgtggcaaacgggggaggaacgggcggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagccctcagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatattacgttgtagatgtttattgcatgaaagagtaatatgatctagttatttcgttgacagata

SEQ ID NO: 50873 - DNA, 1501 bp, Oryza sativa
atgccatgttctggtcatggacgtcaaggtcatggcgtagacgcaaccccttcgatgggttgagttgatgacttggactgatgttatatgttccgtcttggtctcaagatcctttctttttgagttttggtgtcaaattgaaggatgtcataacatgttcatggcttccttgagtttggtttgaaaaatgccaattttgttatagccttatgatcttcagtcatctacatgcatgctcatgccatgctaaatacctctacaacgttaattatccttatccacattttatattatgtttagttattaaccaaatactccctccatcccaaaatttttgacgccgttgacttttttaaacatgtttaaccatttgtcttattcaaaaacttttgtgaaatatgtaaaactatatgtatacataaaagtatatttaacaataaatcaaatgataggaaaaaataataattacttaaattttttgaataagacgaacggtcaaacatatttaaaatagttaacggcgtcaaacatttagtaaaagagggagtaactaagcatgatactttttggcaaaattttacagttcttgagatgtaactaaagatacaaaattattagtgtaaccggaggcatagaaaatgtgttacctccaggaaaccgttaagaagcactataaaattagcatttttttgttataatataatttattatcaaaagaatgttatcaaattaactaaagggttaatttattaacactattaacactttacttaattataaaaaaaccttccctaaatgatagaaagcctacaaaaggtagaaagcataagaatttttccaatcgtagaatttattctagcctctactttaaaatctagtagtattaaccaattaagtaaaaggttatcctatccaattaacctttacaggttaattttgtttgatcaattgcagaggaggttggactagttggacaacgaatcggatataaattcataatccaacaattggataggatatacgcgaatcgtcctggctgctactggaattggataggataaaaacctaactcccccagctactacttgctgttgcttcttccatctgctcttttgttgcgccctgattctgcaggcaccatgcgaatcgcggcaatgacaccaagagatagagagattcgcgggaatggcagccaccaccaccatccaccaccaacaaatcatcgcgccaacaacaaaaaaaacccaaaaaaaaaacaacaaaagaaattcaggcgtggcagttcgttaattcggataacaccaaccaacgagtccacgtcgtctcgtctcccaatcaatcaattgctgatcgtctgacttatataagagggagaggagaggaggagtgtggagtgtggagtctctgataataagtgtcgatttttgttgttccgggagaaattccgggagatttggggcggcggcggcgatgaggattcggggagacggcggaggtgatg

SEQ ID NO: 50874 - DNA, 1501 bp, Oryza sativa
cacagaacttatcttgcaaagatctcactgtttagttttgtggcaactggctagtagtagaacaaatattcaaggctatgttgctagcatgcaagtttgttagctgcacgcgttgctcctgattttatatttgcttttgtcttaaaatgcctctgtacttctagcacacttatacttggtgacattctttgtgtgagttctgttttaagtgatgagcattagatgattaactttaaggaagaaagcccgctgaactactttagcatgtttgtatggcgcaccggactttatgtgtatgtattttctagtgttatactcatgtcctgtatgtcaggataggattatcatccataccttgaaattgctcctcaccattttctttctcatctttcagatcaggcttttatgcaaaggaactttcacgggctggaggacaaatctcctgggtgcagcaacttcttggctttagttccttggacaccaccacaaattgccacggtatctaattggtctgcttcagattcagaaaagagagaattcttcgaagtgccaatggagtctgatgagacagaagtcgattctatggacgttgaggaatctccggaagcaaatgtcgcagcaatcgatggcgaaagccttcaccagtggcaacaacactgcatgaccccatcgtcgctaccaaacccttcagcacctgttatgtggtcaaggtgacggtcagatgtcattgttgtgaattgactgctgctgtttacttacaggaaggatgaagaaatcctccagttagttagcatccacgactagtacctcaaatggctgccatgtggtgcatagtgctgatcattagatcaattggtaaaatgattgttatgtgcatagtagctccctctagcatagtgctgatcttgcccattcagtgtttcagtgtacacctagaaatagtcctgatcttgcccattattagtgttttagtagagagtgtacactgttgttgttacaaaaaacacaagcctgtatgttggcatccaattaatttatctagcattttggatttaccacctcaatgctcttcgcctcttccgcatttgtgatcttcttgatatgttccttttcttatgttgtattgcacatatttgtatcctgtagatttcaaacagaaatttgagaaattttactcaaactacggccttgtttagtttcaaagtttttttctaaacttcaaactttttcgtcacatcaaaactttcttactcacataaacttccaacttttccgtcacatcgtttcaattttaaccaaactttcaattttagcgtgaactaaacacagccaatctgttaggatacctttgtccaaacaaggggatatcttttaggttatcagtacaaaatcggacgcgcgaaaagctaggggtttaaccggtacggccaaaggaagaaaccgccgccccccgccgccgctgccgctgccgccgtcgagaaattcatcggtagttgtagga

SEQ ID NO: 50875 - DNA, 1501 bp, Oryza sativa
tccgtgtatgagttgatttttaatttcgttcgtttttgaaaatacatatccgtatttgtgtcggtttttaagttcgtttgcttttggaaatacagaaaagacttctaattgtagctcatgattttcttaaaaaaaatatatttatccaagcgaatttctacagtaaatttcatcttaactaaaccatatctctactattataaaaattgaagatgtttttaccagaattttagtacgtcatccgtgtttgaatcggctttaattttatgtttcggttttaatctatatctctactaaaaacaataaattctggtcttatgttaaaaaaagaaagaaataaagtccaacttaacgagcgataaaaaaaacttccgtcgttagtaaaaaaaaaagcatctcgtcgcttgaaaaaattgtccgactcctgtagaaaaggaaaaaaaatctcccagtaaaaaaaaagtccgtttggtttttttcactggtattttttttccctttttatgtttggctgggtcaaagaaaagcagaccgaatggaggaaggtagcggacacggaatagcggactagtctagggctgaaaaggaaggaaggctttcggccgaaaacacagaaaatatttttattaacctttttaattattatctatagcgatcccaatgttaagatttttattaacttttcaattatagtgtatagtaatcctgatattttttattggtatgaaatcttaggtaatcccgattttttgaaatcttaggtatgacaatctgaaaatttattggtgcttgttttgatataaaatctgaagttgcaatgttgtttgttcagaaatctcaaaaacgttatagtactagttctgaagctgataatatgacaagttttacagtgagttcttgaatgaactagctgataattgaccagagactatttggctacatgtttaataactttaaacttggttagtttcaagaaattgtagcagtgaatgtagcacgttctgaaaattttacctcggtgctgtattttgcttctgacggatataaaatttcactgtattagattcatggcaactagtcaagtactgaactatcgtgtacatgtaatggatgttagatttaattgggtaattaatccatttaaatcaattaaatcaaataaatttcaaggctcattatgctaggaattcatgtgaattcattcttctatgggatatcaatgggatgaagagttttgagaattaatccatttgattaaggaattggtaacttatatcaattagtcctaattgatggatggttgatggttgtgtagtggaggatggttcatggctagttgatgacaattagttgctctattcctcttcctattccatgactcttactcttcatcttccattcctcttataaaatgagaatggatttgatctcccgcgagaagaagtagacacactttcatccattttcaaaagctgttgctgctacggtaatcccatcccga

SEQ ID NO: 50876 - DNA, 535 bp, Oryza sativa
cggatcagatcatataatgggtgcctagtctatcccgtctgactttgcaccacagatttggacatgggccatgaaccatgtggggcaatttggagagtacaaattaaaaggacatgagagaaaatatcgctagaggaagcatcatttatataagttctgaagagttaacctgtcgcggggctccggaggggactacgagttcgtcgacgacgtcgagtagttgcgtgacagagatgccgacgaagcagcagtgcgacaccccttcgccctccgtgcagcagacaatggaggaggcgggagaacacgtggtggagacggccgtggagttggtgggggcgcgtgagtctccgacgaagcttgatccatgaacgaggagagcgagcgccgcgtcgacgcgcgtagccaacgacgccacacctccaacgctgcgtcggagacgggggggcttgtttctccggcggtgccctccacggcagctgatgaggagggtatacacacctcgcggtgggactcgctgatggagagcgaagccagc

SEQ ID NO: 50877 - DNA, 1501 bp, Oryza sativa
tacccttcctgagggaacatagtatcaagctcctcatccgtaagaggcctgttccgctcctcaatgtcccgctcccaccgcaagagctggtactgctctggagtcattggaccacgagaagcaatctggccggggtgttggcgtcgcaaggttgtcaccaccaaatggcgtcggaccaggagtgtaacctgcaggcgtcgcagcaccagtgcctccaggtgtagcactacccatactagcaggagtctcatcccatctcgatctctgcttcttgggtgttggcgtgacaagcccaccaggcagcttaggagtagcatcccaagctccagaaggtgtggcacctggagtaatgccaccagctgcaggtgttgcatccgcatcggccatcctcccaggagttggtgtctcatcccaccgattccttctcaccgacggcgtcgcatccccgacacgaccaggggtggcatcccagcgcccaatcccaggagttgcatcaggagcatcccaatcggaggaggtcttcgccttcttggatccagaagcagcagaagcatcaccatcttgcgactgatcccatctattgctgcgccgactggctgctgctcaggcaaggccttcttctccttggccttctcctcttccttcttcttctgagctatatcacgcagcagctgctccttctgcttctgcaggtcattctcgcgcatggcatcagcataggtccgcacggaagggtccggggtggcctcaccggcggcgaagggatgtggcgctccggcgagatgatgcgggccagccggcggcggcgatagtcatcctcgcggtcgatgatgcgctgcgacttcttggggaggccgtcgtcctcggcggcgcgggggatgtcggcggcggcgacggcgtggccggtgtaggaggcgaggcggcgggcggcggggttgacggccgcctcggagtcgtcctcggaggcggggatggaggtgtcgtagccggcgaagcggttggggtcggagccgccgccgccgtagagatcggtgtcgaaggtgacggaggagacggccatgggcgcgccggcggccagggcctcctccatcttcttgcgctcctcctgcgcccgcgcgagctccgcgtcgatggcgtccatggcgacggcgcgggggagaggcggttagggtttggggtggagagattgcacgaggcgagaatgggggaggattgagttgtggttcaagataaaacttcgtgacacgttgtcacgttgatgcgtcatcgggcacgttcggagtaagtcccgggtccacgatacatatgtacgagtttgatacatggcacgtttcggcagagattgtatctatccatctttctaaagatttatacgttgatatcacacacagatttttaatttttagattaaaatctaatagacacaggataaaaaacaaaaaacaattaagaaaaaccataatggacactaattaccatatattcatgaaaaaaaccaaat

SEQ ID NO: 50878 - DNA, 219 bp, Oryza sativa
aacccctatactaattttgagagttgagactaaaaaatcaggtccaacaaggcccctacagagcatctccagtagaggtcctaaacacagcccctatactaattttgagagttgagactaaaaaatcaggtccaacaaggtccctactaaagcccctaaagtaggaaagcctccaaattatccccttaggcccccagtccctggggctttctccgcagc

SEQ ID NO: 50879 - DNA, 1501 bp, Oryza sativa
acaaatggttaagcccggaatccgtccgatctactcggaccaggtcgaatataaaaaaatcatggtttttgtgtcgagcgcgcatacattatagcaaaacggtttttttgggacaaaaaagattaagtccgagtgtgtccagacctgatcgaatataaaaagcatcatggtttttttgtcgagcgcacatagaataaaggacaaatattattttaggacgcaattggttaagcccggaatccgtccggtctacctggaccaggtcgaatataaaaattcgtggtttttctgtcaagcgtgcatatattatagcagaacggttttttagtgttcgaatgtaatttgttggaactttttaaaaaacatggtttttcggtcgactgcgcatagaataaagtggaacggattattttggacaactagttattatgaagccatgatcaggtcgattttaaaaaataaagcagaacagattattttcgggaactagttattatcaagccccgaccgagtcgattttaaaaaataaagcggaacggattattttggacaaataactatatgtacagaccaggtcaatttttaaaaaacatagatttccggtccaccgtgcgtagaattaagcggaacatattattttcgacaaataactattaagaccgggattgtccgagccaggtcgattttttaaaaaaacatagttttccggtcgaccgcggatggaataaaagacaaatactatttatactattttaggatataatgtcgaatattaaaaacctcacgatttttttagtgtccgaacctaatttaatagtgaatctctgaaaatatccacgtatattctcagcaagtacagcccataaagaaatttggaggccatctacgaacgagtgggcctgtatcgagaggcccatcagccgaagcgctatttggcagcacaatctggaatccatgcgcaattacataatacacccccctaaaaactgaacttacaagaataccatatgattttttttccacaattactcttttactacactactactccatccgtcaaaaaaaaaacctttgagggatgtgattcagtttatctcttttttgacagagggagtacacatttatattaggtgtagtagcaacgaattttcacccttatatctcatctcttcaatggtctatattcatttagaggtacactaaaaaaaatccatttaacaatggactcagttgttgtttccaagtgtgaattaagttacgtctaaccaacaaagacacacacgtgttgaatgtggtgttcaatgtaaagtaatttcttctacaggatgtactatgagttaacattttaagtagaagtagaacattaattcttacaaaataaattggatgttgatcttcttattataactggagtgcaaccttatctgtgtgctactcccgcgccgcctcttcccccaccgcatctgctgccgccgctgccttccccggtcgttccaagcca

SEQ ID NO: 50880 - DNA, 206 bp, Oryza sativa
caaagaagaaaggaaaagctatagaacctttaccgaactccccgaagcctccgcggacttggaactattctaactctactccactaacactactactaactttgtagagagctttgatccttgcttgagtgtgtattgaaagtgaagaaggtgaggtccttttatagcacccaatgacggttgtagagcatgggaattgtcggaaa

SEQ ID NO: 50881 - DNA, 1501 bp, Oryza sativa
tttttctctcgaaaacgcagttgagctgcgtttcatttcattaataaggaagaaaacgtatttacaaagaaaaggggcaaagagaaactgtaatcaagattttggtggaattttcactagtcaaaaactgcactgaaggttccagtacaaattttactcaccggagttccttaacctgaactttagctagtcacacctctccttcagtatttgttcaccttcatttcttttttattgttttttagctattgcgtacttaattttgtgtttccgtttctttaggtaagacacgaatactaagatccagatagctgtagcacgtggagaaagactagaagtgtagttgttgattgacaaatatgttgtgatcaaatgctccaagaaagttgacataacacaaaaaaaatgaggtgcctatgataatgccggattaccaaaacaaccattgtgcttaggcactccatttagcactccaagagttgcgcatttagtttaatagtaattaattaccttataggcattctgtacaaaagaaaacctacagatatatatttacactactaccagaactaaaataagggactcgctaagagcagcgtcaacgaaacatgaaaaatccacaagaacagcatgacacaagattccaaaatgtcacaaataaaaaacaactcaagaaaaaccctaaacctcctgaagaacggttctatcttaaaaaataatagtaataaaaagaaaagcaataaatggtccattgcggaaaggaagggaaatgtgactatagagagggtgtggagatccacggaccgaactggaaggaagggaagggcggagaatcaagcgcaagccacagattcttgcccttgcggcgagcagcggagatggtcctcccgacaagcgctgcctccagccgcggcggggcgacgccgtcgatgaccttggtgtcatctgcagccgagcaccgcacgatcctcttcccgacgcagtgctcctccagcgcccgtcgcgccacctccacctccggcagctccggcatctctcctcaacctctccctcgttgggtatatcctcctcttctcttatttttgcaccggttggatcccagaatccccagattccccactttagagcctgtttgggagagtttgtccccgctgcagctttttccaaaagccgcttctgctagaagctgcctcaagcagtccatagcttctgagaatatgtagttacagattctaaaaaatgaactaagaagccagaagctagagaagctgggttttagagcttttccagattctcggaagctggctaccaaacagctgtttctcagaatctaaacctcccccaaacacctcccccaaacagacccttaccccagtctgaaaaggttaatttgaaaaggtaggagacccctcctcttaccgcttctttgacaagaggattgtaagggcaaaagcaatgtgtcatccatttattcagccccggaggaccaaatagatttaag

SEQ ID NO: 50882 - DNA, 1501 bp, Oryza sativa
ttgatttgtatttttttataaattactatggctcatcatcccttcccttaagtactaaaatctggagaagaaatgtaggacttagaaatatgatgattgatattaaatttagagtaaaatacagcagcggtccttaaacttgtcgtgaggtttcacttaggtccacgaacttgtaaaacgtacgtcgagatccctaaacttggtttattgtatcatcccggtccaaagtctcgtttgaccgtggtcttaccaacgtggcacgccacgtggacgatgacatggaattttttttctcccttcttctttttctctcccttcttctccttttttttctcccttcttcattttcttttctctccggcggccgctgcaccacgagctccacagccgggccttcatctccttttccatcagcctctactccactcgccgagccaccgtgccggaggcaagcacgcgacaggagggaggacagtggcgctgacgggagggaggggacggcggcgactcggggaggaggatggcggcgctgacgggagggagggggacggcggcgcatagatgtcctcctcgatctcctccggggtgagtgccaccaagaacggcgcgctttctagcgtcgggacgaggacggcacgggcaccgccgccgcccacaacatggaggcggctgggcgccgccgtgtccactgtagcaggttccacggcctcgctgcaccgtccgcttgcggctgtggcagggcgagaagtggaggcggaggcagggccttgaactcgggctcggagtccatctctgcaggtaggctctcgggctttgtcgtcgtcagcggcagcggggggtggggggctaggctggggcacgcggagacggttggcggcgtctcgtaggtgacccatgagcttcacccaaagctcctcgatcccaccatcgaagggagttggcggcggcggctgcccccacggctcgaggtggtgcgtcgacgtcgcggcgggcggcttcgcccgcggatccgccgtcgccgctatggccagcttatcgtcagcagctacggtggcacggcgcggcgcggaaaggcggcggtggcggcggccgagtcagcgaggaggagacgagcggcagaggagaggaggttttgaggccacagcgggtccaaaaaaaaagggagaagagaaaaattccatgtcatcgtccacgtggcgtgccacgtaggcaagaccacggtcaaacgcggctttggaccgggatgatacaataaactaagtttagagacctcgatgtgcactttgcaagttcgtggacctaagtgaaacctcctgacaagtttaaggaccgctggtgcattttactcttaaatttatgttttttcctgaagtggcgaggctgtaagtagacacttcaatttatttctcaaatgtaacaaacattttttatatttgtctgaattaattgtatggaatttctaattatttgcaaataagaactaaaaaaagaagtttgttta

SEQ ID NO: 50883 - DNA, 1501 bp, Oryza sativa; identical to SEQ ID NO: 32711

SEQ ID NO: 50884 - DNA, 1501 bp, Oryza sativa
tatacgactccttttgtatttccaaaagcgtcccaagttagcatgcgagattttttaaagagatttcttataagatgtcttttgtatccaaaagcgaacgaacttaaaaaccgactcaaacacagatctgtatttctaaaagtgaacgaacttaaaaaccgactcaaatacgaatgacctaccaaaatactgataaaaacatcttcaatttttataatcttatttagattccataagataagaaatgttctgcagtttaccaactgggtcaataaaaacgttcttacttatattattattgtacagctgttctttcattgattgcagcgtgtctttcatacttcctccctagaaaactatagagtgtactccctccgtggggtggaggaagtataatattttgaaaaggtcacttttttttttattttgaccaacggttgtcaaattataagtatatttagtgcatagaagttataccaatagattcatccttctaagagcttttataaaacattattagttttataagtattgtaaatatattttataataaaacacatcatataattttctcaaaagacttcttcaaataatatacaccctataattttttgagggagttctttatagtatctgatgcacataacacaagaatggagaaatgcaccgtttagccttgcagtagatttggaccagtgtgtacaagtgcctagggggtttctcctgtcagcttcttattatatttgatgagcaaattcagaatccgaattttgctgtgcggtggatctcaaacgcttatagtttcatatgcagaatcatgatatctatgctcagctatcaggtaatagcaaggttcccaacgctaagagcttgccatccagatcagttggtagggccagaggaaggggtgagacaagatttcagcccaaaggttctagtacagaagaaaattcaaaggagcgagagcacagtattcaagaaatactgaaggctttctatattcgatttgttcgcctcaatggaattcttttcacaaggacaaggtacttcgtaaaacacttctgtgactcatcttattctctctttctttgtctcctaaaatgtcttgcttttttcctctaatagcttggaaacatttggggagttgtctgctacagttatcagcgatttgcaaattcttctttcatctggtccttacgaggagcttaattttggtgttgaggctgctgaaaacgcgctttctgttgttaagcttattgctatccttatattcacagtgcacaatgcaaacaaagacgcagataatcaatcatatgctgaaattgtgcaacgcagagttcttcttcaaaatgcatttgctgcagcctttgaatttgttggataccttctcaaaagatgcgcagagcttcatgatgttgcatcaagtatctacttgccagctattttggtcttcattgaatggctggcgtgccatccagattttgtggctagttctgagatg

SEQ ID NO: 50885 - DNA, 1364 bp, Oryza sativa
cgggaggagtgggccgacggcccaacaaaggaaaaagggaaaaagaaaagaagaaaaaggaaaaaagatttttcctaggatttaaatattacacatgctcatttttaattagttaaaattatttccaaggctctgaaaattccattaaaaatcctattagcatattttgacacgtagaatccaagaaaaattccacacgccgattccgattattaactgtatttattaatttagggtttctctcttgcctttaaacaaataatttcttaaaacaatttatcaattgaatttttgctaggaaggaaaacttcagggcgtgacacgcgcgctgtggggcaagtgtcattggggaaagccgcgacgacctagagagggatggaacctagaccacgtcctggtggggcttccttggggaaagtggcggcgccatacgtcgggaagtggcaccatctggataaacctggacgtcgtcgccatcttcggtccacatctccaccgacaagtccgagctctccgccggctctccaccttcaaacagcaacaaattgacccgcaccactgggacaatagcccatggccatgtccggtcgtgcacgaagccactccggagcttcatgtcggcgacgtcagacggctcatgggaggtgcgtgaggaggagaggaggcgatgcatcgacggaggagaagaggcgatgcgttcgtccccactcacgagaccgagtcaaagggcacggttttgagggtacccaggtcatttcgccttagctcgtatcgctttggctatgtgggcttggtcacgtccactgtgggctgtgtatccccatgtgtggctatagataggtttggatcttgtttgaggccatattgcattgtggatcctgagacttttaaaggacttaaatctatttggtcctccggggctgaataaatggatgacacattgcttttgcccttacaatcctcttgtcaaagaagcggtaagaggaggggtctcctaccttttcaaattaaccttttcagactggggtaagggtctgtttgggggaggtgtttgggggaggtttagattctgagaaacagctgtttggtagccagcttccgagaatctggaaaagctctaaaacccagcttctctagcttctggcttcttagttcattttttagaatctgtaactacatattctcagaagctatggactgcttgaggcagcttctagcagaagcggcttttggaaaaagctgcagcggggacaaactctcccaaacaggctctaaagtggggaatctggggattctgggatccaaccggtgcaaaaataagagaagaggaggatatacccaacgagggagaggttgaggagaga

SEQ ID NO: 50886 - DNA, 1501 bp, Oryza sativa
aatatgggacgcaggtagtatgttttagcccctctctcccaaacacccccttagttactgtggtgcatggcctagtctagcattaggcaagatactaagcacttgattgagcagtattgatgagactgggatcgctgtatatgtgtagttgggcttagaactttattactcgggcctagggttaattagtctgtttgggttgacatggttacataattggctctgctttcaactaattttacaaatttaagagttgaaaaagggaccacttctatttaagaatttctagggcagggctttcaactgaaaactgaacaagtttagggcccttttaattgcatgattgaaaaaaacgtaggaataggaaaatgcatgactttgatatgaatgtaagtgtaaaacagagtattgcaaaacacaggaataactgtttgattgaaccgtaggaaaaacacagaaattagagaagagataaaaactcaatggaaagtttatatgaggtagaaccttatgttagtttttctccaaaacttggcattaggtatttcataggtttctatagaatttatttatttgattcaaagggctatatagaaaaaattcctataggaatgaaattctctaaaattcatatgagaccttgtttagatcccaaaaaattttggccaaaaacatcacatcaaatgtttagacacatacacggggcattaaatgtgaaaaaaaaccaattgcacagtttgcatgtaaattgcgagacgaatcttttgagcataattacgtcatgatttgacaatgtgatgctacaataaacatttgctaatgactgattaattaggcttaataaattcgtctcgcagtttataggcggaatctataatttgttttgttactagtctacgtttaatacttcaaatgtgtgtccatatacttaaaaactttacccccgaagaactaaacacaccctgaatttcctttgaatcaaaatgggcttaacctgaaactgaccgaaattaatccttctgctgggctttgaaacagctcccagctgggctgaaattgccgtagcccaaatgggcccaaacccttgttgaatgggctcgaacttttgggccgtcgaggcctatgcttctgagttctgaagtttctgaaccgcgcaatcaatcgaaccttctgaagcctgaaaccaacgatgcggtcgcatattcgcattgccgcagctaacgcctagcgccggcggcggactggcggtggatgctacgccggactccccgactgctcgccgccgtgaaccccgccaccgcggttcgctccacagccgcgctcgtccagatcgcctcccctctcgaccccttcctcctccaccaactcacagctcgctttcaccatgcaccggcggatgcccaccacctgctcgacgaaacgccgcgcagagccagctccatcgtgcgcgcgctcggcgcatgcaggggcgcgtcacgcgaggaagcggacggcgtcgcgg

SEQ ID NO: 50887 - DNA, 1501 bp, Oryza sativa
ttagtagtgttcaatatacaaatttaattttaaaagaacccacaattgtatttgtttttattttcttatcttgcatgatccactactcagtcaccgttttttgaaattgcaaatcgctatcacatgattacatagttggagtagtatatattttctctattgctgacatgaatacatagttgtagtcccaaatttcagctgcattcagagtccttaatacaagttgcagcacacaaatgggtgtataaattttgaaatttgaagtggtccatgagttgacataacctccattatcttgagctcgtcaaactcatgcccacgatgcgtggttgattagctgtctaacctaaccttcattccacgacaaaccatcattatcttctatcacccatgaaaaactaaaattttaagccacctcatactttgcatactgaagtcttaatagcatactaacacacatggtaaataaaagggagtacctatgcatctttcgaaagatttttatgatcatatcacacagatttttaatctttagattaaaatccaatggacacattaaaatgcaaaaagcaactaagaaacaccataatggacactaaattaccatatcttcaagaaaaagaccaaatccaatataaatttcaaaacttacatgcgaagattcaaaaattacaccgtaacttacaaaagttacggtgtaagtttcataaattacactgtaatttacaagaaaacacactgtaaatttgagtgagaaaatcgagtgagagataagaagaaatctttcgagtgagatatagcaaaatcgtaaataaaattcagcactagtcatatccatataattgattattgtgacctcatgatagagacaagaccaaaaaaaaaaagaaacgcaaaaccataattctctgattaatcatagtataacaacatatatataagtcatgataaaaaacttaaaaaaattcagacaatacctaacagacacaataatttatgtttttaaaaaataaaataaataaaataaatgtaaggaaacaaaaaaggaagcggcaagaaaaccgttataacaacagaagaagaacatcacaaggacaacaacctccctcccttgtcttctcaagtccttccctcttcttcttctctctcatcatgtagagagagaaagtttagagatagagagagagaggagcagtacaaacaactgcatgcatatccatttagcaattattaattgctccccaactccaactccatcatctccaccaccacctaaacccacaaaaaactaaaccagaaaaccgcttaaccgcaagcgccgaggcggagagcggaggcagacgcagacgcagcagccgagcacgcggcgacgcccacgcccacgcacacagctcggcttcccggcggaaaccctagcgggcgggcgggccccaatggcggaggagggcgacaaggccacggcggcggcggaggcgggggggaggagcagccgctaccgccg

SEQ ID NO: 50888 - DNA, 232 bp, Oryza sativa
ctctagcataacctgttctaaattctaatgattagaaaaatttgctaccattatgcattctaccaacatatattagctagtatctgccatttttcctgagattgattggagaagttgtcaatttatctacttattgcagtgactagattgtgatggcaaatgaatgtgattcctttgtgtgcatgatgtccgaagagacccatgttgaggcatattccttgccaatgcaaaa

SEQ ID NO: 50889 - DNA, 1501 bp, Oryza sativa
gatccctaccaagctccacatatcaaaccttagagtaggaataaaaaaggaaaaactggtgaggaattcaaattgatacacttggagagaccgagtgaatcatttgaggaacttggttttctttttcaaaatcatttgaaaacttctggaataagagttgaatgaagattggatgattggtgctctaattgttgttctgtctttcaactgcccaaggcaaggagaagcagtgtctcgtggtaatcaggagtaagggtaagtcaccgtgtcaaagattatttaatctgagagagattacatataccctgcacctgtatctttgagatatgcagcatagtagcaactcctgatcaacaaccaagtctttgtttccttctgtccttcacttggaacgagcaaaggttcaagctttgggggttttgttgacggtcgttatcgatcagtttcgaccgtcaatattactaaaatagagaagaactagtgatacttgcaatgcatatatctgttagaataataatattccactagtattaggtatactaaccttttgcagagaatgacaataaagtggaggagaattgtcacgtcctgataaattcatcccgaaataaaaatcattccctaaaaggaataatagaattaattaaaattcaaaaagaaattggcaaacactaaaatacgtacaagaaaaattcgaatatggcccggagaatttttgttaaattctccttggtctaaaaggagccctcaaattttacttgaattttcagagcaccggaaataattattaagcaacaacaacatttatcaaagtttactaaaaagaaaaagctaaaaataaaccctccttcctcctttgggctgagcccagcccaaagtccttccctcctccctctctttttccatccctctctctctcttgggcctccccttccccttccggcccactccatactctcctcctccttctgggccgaccctcccctcccttcttcccctcagcccagctccctcctcctccctctccctcccgggctgcctctccctcctctcctcctgggccgcctccgggcccaagccaagcggcgccctcctgcccgtgccacgcacgtgcgtgcgctgacggcgcgcccgcatgggtcccacgcgccgggtcgttgtcctcctcccgcccgaccttctctttctctcccggaaacctagcgccattcctccccaaaatccacgcgattcaaaccgggaattccaaaattgattagggggaattaatcccctttccttcctattcaattccccccaatttcccccttgattcgtgccctctaacgcccggaacagccgcgccattcccggccgccttccatggccaccggccacgaattccgccgccgttccccgcctctcccgtggccggctccctcccctcacctataaactggaaccccctcgctccgttctctcgttttagccttctcccgcacccccccgtgtgatatgacca

SEQ ID NO: 50890 - DNA, 482 bp, Oryza sativa
cccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagc

SEQ ID NO: 50891 - DNA, 1501 bp, Oryza sativa
gatcggcagagttcgagttggacagggttagccgattgagccgaatccgataatatgacacggcatacgttgtcgggttaggttgacgtgcttcatgatgatttccacgcatggatggagtcctgagaaggcaattgtatagtgcttcatgatgattgccacgcatggatggagtcctgagaaggcaattgtatttattaattaggatattttatgtaatttctttagagatatgtttgggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttggggttgagctgcatcggtttcaatcttcaacaagaggtaaaacttattgtggcggcttgcattctcgggattagtgcttccatctttatgatactctaatcttgtttatgtgataaattgaattatcatatatcttatataatctccggcaatatcgctatctaacctacaatcggctaacatcaatctgtcagtagaagacagccgattaggttaaataccgatgttgacttagattatataggaaatccaccactctatgacacatccaacggcttgattgtctagatattgtcttttttttcatacttatagctgcatcagttgagtttgatcgtatgagtcgtgattagaatctcaatctctagcctgcctttggttgccaattagggtagcatcggggtttcagccgatcttatctgatttgactatatttatcttatgtgcttgattgacatgttaaatccaccctttatgttaagatctcgtcgtatttaagtatattaagctttctgtttggtatattctacttgctttaatatctcaatatagaacggtatcggagtattagccgatacatgctagatctatctgatcggctatgttatgaacatatataatcttgttgttaatatatatttcggtctaagtgatttatactgtctcgacatggcgaccaatctatcccaatcacttgatttaagtatatatcgacataaggattatatattgttaatatcaacagccgatcaagtagatttagttctttcttacttattaatgtctgccgatcgatgcatatatgacatcggctcaaagataaatgatatgtcatcggcatctagccgatcggctatcgtttatagatttaaccgcggtttctttgtctttgtctcttgttgatcgcaggatcaaatcaactggcacgctcacatacccaaaggcaagttttggacctgcactggagttaagcagatctcccagacctcgtgtttttacatcaacacgcttttggcacgcctggtgggaccattagaagtcagaaccgcaacagtattctctca

SEQ ID NO: 50892 - DNA, 1501 bp, Oryza sativa
tgcagggcaatcagatgggaaacaaacaattgaattgaaggaggccatgacagcaacaaaaacggatgaaaaaggagaggagcaggtcgctaaggataaaaaggatgacgaacaagaacaacaagccaccgccgctccaattgagtcgccgaaacaagaacaacaagccaccgccgatccaattgaagcaccgctgaattgaaatttgaaaatgagacgcatcgtaccaaacaaaatgcattgctgcatgcctccacgaaatgtccaaattttctcccttcagtttattagcaagaaactgtacatgatgcttatctgttcttgttggttaaatacttcatcttcaactgagatgatgactgctagtttgtgcaatttcgagtatttaacgttgattagcatgtgctgtatatgtattatttaataagcacgtagattaggggttgcttggcttgtaatacagccacgaggggatcagtaaattgatctctcattattgctgaatctgtcaccgtcagagaaaaaaattgcagtgcagtctaggtcagcctgcagcccttgtgttagttcaggtaagaatgttctttattcagattaagcagcagcaattggtagccatctttgcaagtctttatccacattaggaagcctaattgcagtcaggatcatgatacagtgacagcaagtggctattaatgaaagctgatgacgtgcgtagcgtaacccaaagtgatgtgattatcatgtgaagcagtggacgcccataattgctactattcatattttatcatctaataacaataaaaaatactaataaaaaaatttcaaataagacgaacggtcaaacgttgaacatgaaccgtacaaaactgtatttattttggaacggagggattactcaccagaatattcaacagtgtcctgtaaaaaaaaaagagaggaaccattgtttttcagaaccgtgctagagaagaataaaagaacaggttctcaaattaatgtgacctggtctttcaccacttggcatttccgtatcatcaaagggtggatccaacttgattttcagcgcatcagcgatgatcctatatccaaattaatactacgtcaatgacagtgccagttaactgaatgtataagtttgcattgatcaggtcttggctaaaagagagatgatcaggtccaccatactgaaatctgaaagaaattaaaaaaaactagacatttcaagattaatcaacactagtaaaatcccgaaatgcacttcaatctctgcatagttataacttacaagaactctatcctgatgtgctggtagtggtggccatggttggtgcggaattggttgttcgatttgtctgatatccaacctaaaggacatagccatggaaaagaagttgcatcatggaagggctagacagtgatgcctcaacaaccagccagcccacatgatgcttgaaagcaccccaagattcatagccaaagtgtcatagaatacagagac

SEQ ID NO: 50893 - DNA, 1501 bp, Oryza sativa
ccggccggtcgtcgccaacgccgacgaggttcatcaggaggatgacgtcactagtgtcacctcgccgacgactgccccggccaccctggagaatgacaccagtagtagcgccgccgccgccttcccggccgctgtcccggcgccggtggccggcgaggaggtagcacaactagagcaacctagctcttctaagtccaacaatggcgaaatggaggcggtggccggagttgatcaggcagaagatgccaagaaggagacaagcaacattgaggcgatcaatgtcgaacaggaggagatcaaggtcgaggaggaggaggagaagatcatcgtctcacaggagacagaggaggaggaggagaaatccgctgtcatttcgagagatgagatcaccaaggtcgaagtcgaacgcgaggagatcaaggtcgaacacgaggagatcatcgtctcccaggagacagaggaggagaaatccattgccgtttcgaaagatgacgatggtaaggttcagagggaatgtccctagatgtttgcatgacgtataaataatataaatttttttaaaaaaataacatagattaatatgaaatatatcactccacaaacatacaaggccaaattcgatttctacaaattgcaataaaaataacaaattaaattaaaaatagttatcattaattatttttgttacaacatgtagaagttgaattttaacatgcacttttgtgaagtgttatatttcatattaatttatcttgtaattttttaaaaaaaataataactatttaggtggcatgcatgaaacaaggagatatcgcctgagggatgaaaacactttttcaatttagtttctttgattgctaaacattacacgcacaaggactatttatctaaaaataataatctgaaatttcctgcctcccgttaaatatgacattcttaactatattttggttgaaatttcaaaactttgatcatccacacttatttagtttaaaaattgagatcatacaggtaaaatttttatttagaattacttttaaaacattatgattttaatagatcatattattatattctaatacttagaaaatagtggtcaaagttgtgcaccaaggactgcataaaatcaacagtgttatatatatctaataatctaaatacgaaggtagcagctcaaaaaaaaaaaaccgaaggtagcacatgcacatgctattatctcatctattgtgtttatcaaaatcaggggacccaacgatcattattcttcttttgcatcttttctaatcattttgtctctaacaacattattccttacatccagtgatctaggcatgcttgcataaattgcaatctataattctgctgatctgttttcctttaaaaataaaaaagagatgaactttatcagctgccgatttcaactgctcacataatactcctagacgttcccattccatgtgcagggcaatcagatgggaaacaaacaattgaattgaaggag

SEQ ID NO: 50894 - DNA, 444 bp, Oryza sativa
catcggtgaaaccaatacgattcctttcagattagccaacccagatctaggacactggaagaataccttcaaatcttggccatctctcgagaaaacttcacccgagaagagctggactatatggtacaagcgcatgtcggctagcaagaaagttcactgggacgaaatcggaatcggccaagtgcttgcccttaccatagccaattcagctaaagatgaacctttaatggccgccgccacctatttctagtccaataccatcaacgctttcctgttcaaccaagggccgatgactccaactttgattgacatcaccatgattaccggattagacgtaacttcatcagctaaccctatgagtatgaacaccaagaaccaatttgatttcaggaccaaaagcataggtggttggtctggctatgtagggctatgtagcggcataca

SEQ ID NO: 50895 - DNA, 1501 bp, Oryza sativa
aatgggtatcgtccacgaggagaccaaggatggagcatttctccatggggtagatcaagaatggaccaaacacaaggaggtcaaagtaaaaccccgaaggacggatagcctcaatactttcatgatgaacttcctggagcaggaagaaacgagtaaccgtcaataccttaagccggcatccaagaagccgggaatacaggccggtcaacctgtgttcccagttacgaagaggccgctgcccgcacctaaggcaaagaaggtgtggcgggttaaggagaagacactcgttcctgtacctccggaactgggtgcctcattgagctaaatacgtcggaggtatggtcgtgctcgtcggacctaaaacgacatcccccttgccaacaggtaaattggtagttatctcatatttattttccattgcatcaaagcatgtttggattttcaaacacacattgagatctgaatttgaggcaaattcttcaaataaatttttgtgagcaaaataaaataaagtttttagaaaacttttgcacagccaccaccacattggtcgttggaatccaatagctaaaggtggggctggttgggtccaccaagggttcggccgaatccctggttcggccgaaccggcctggcaccggctggctggaaatttttgcagggtagcggctagtggggcccacatgccattcctagccgttatccatgcactatatatgtagctcggctgggagaaggaagtcacaccaccttaactcattttcactccctctcaaaaccttgctctaaaaatttattcaaagttttgcaagctcgcctcaaattcacacaatttgctgcatttagtttagacacttgcatatacaagtttgctttagtttggtgcaaggttatcggcgggtatttgcttaacccccgtccgagtagtcttgtattcttgctctttgctgtagccataaagaaacgacttttgggcatattcaagagacgatcaagctcacggacaagccgacacgataagccgagtacaccttcttccgcggatgcatccatgaaggaggcgtacattccaccgaggctgtacaacaactcctttcacgacctcgtgggcgaccgggaaatgcaagcctatcatatgctgaaagaccgaacctgtgctcggacctgagcatacgactcgaccttctgaaaaggataggtatagatgctgagcttcattactttttggcgtgctataggttgggataaatttcatgtgtagacgagccgggttcctggcgggcgccgaaaaggaagcagtgacgccttttcgacgaaagcttagcttggtaggcgctgcttactcaccctattcccttagacaatgcaatgctgtgaacacgaaagtttgcagttcagccctcttctcccatgcagagtcgcaggcagcgcctcggataaaagcatggacgagccacatgcagggaaacttgcacgtgtggttctggccggggaccccggt

SEQ ID NO: 50896 - DNA, 1501 bp, Oryza sativa
tgcgacgacaactgctggcgtcggtggctggtgatagcggcatcggcgacggcagccgacttgcagcggccgtgactgaggagacggtggcgacgtcgaaggatgtggcagtggaggtggggaaggagttgggtgtgaggtgacggcagcgacggtgaggtggtgaccgtgacggtggtgggaggaggcatggcggcctcggacggcttgccgagggcgtggcagacgactgcatcggccggcgcagcatcgtttgaaggaggggtcggagaccggctggacgcagagtggtgtagccgatggcagcggaggccggctcggcgcgagaagcgcgggcggcggagatagaggccggcttggcgcgagaggcgcagctgatggagggaggccggattggcgcgagaggcgcgtccggtggaggaggccggcttggcgcgagaggcgcggccggcggtggaagaggcgcctcggtgcatggtggagctgccggtgggtgtggcgcggtcttcggcgcacgaaggctggccggcgggagcgtcggtgcaggggccccacatgtcagcagagtttgagtggtggtggagcatcggtgcatcagccgtagattcgcagatggtgagcggcgggtgaaaacctaacccggccttggctgaaccgacaacgatggttaattccccctcctgagggcattgtcgtgctgtctcacacctcaagggtgattaccgggcgaaagcccagtcttggctcctttgagccctgatggacggcggcggcggtcttccgtcgcttctctttttgaagacgtcgttttggcacccccttgctgtagggcgatctcgtctgtgttcctttgttggtctagcggcggccggtccggtgctaaccttctcctggtcgtgtgtgttggcgttgccggtacgtgggtggtggtatattttttttctttctcctggttatgacccttcagggttataatcttgtaattttttcctgctctatcaatataatttcgcaccgtctcgtgcgagtcgttaaaaaaaagtatgggtatgttgcaccaaactagtgatggtgtcgtcattgccggggacatcgcatctagagctatagcttggtctctttactctgcacgagtatccatcagtttgttgagttggttatgcatgaattcgacgtaacttcttcatgtggcaataacgatgtaacgatataagtatgatatattatgatgcgcaagtagctagtgtactgcaatagtcatatatatgaatagagaggcttgattaatttggcttctttctgaaatgtttaattatctaaaccttgtttgaaacctgctacctgaaagacgagcgatcgatcgagtcagcatgcaattaagcatcgacgtcgcgtgaaatggcagcgaatttagcgtgtgatagcctcgttgcttgaacgatcggagcagctcacctctggaatcgaagaagcctgacacgaaaaggcgagagagaaaaat

SEQ ID NO: 50897 - DNA, 833 bp, Oryza sativa
accatggtcccttaggttgacatgtggggtccgcatgtcaacagcgcagtcttcctgtcttttccaggctagcgcttacacatgttttatagttgtaaaacctaattacaataatccgcaaatctccatataacagcattaaacttcggatgaccatgtcttggtcatacgagctccgaatcgaaccgttcaagtctcctaatgtttgttataacctaaagaaccatgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaaattcccgcgttatcactgttttatttagccatgcctatttatctttgttatgaccttatcattgttgttattgttattattaccttgttcaccctaggataaacaaaaccccaactagtgggtactctattcatggttccactagtatgaatttaggtagatgcttcgctgattaattaggcaacattagatggttttataactttagactttgggaattctcatatcatttggacactatggaatggttggcttatgttggaattggacacacacctccccctctattcaaaacccccaaaatagttttaggctgggctcgaggtgcgtggttgggttttgttagtcgtacctcgggtactataaggattaa

SEQ ID NO: 50898 - DNA, 1501 bp, Oryza sativa; identical to SEQ ID NO: 32434

SEQ ID NO: 50899 - DNA, 171 bp, Oryza sativa
gttttgatagattgaagtttagccattgctacttgcttgcagcgcgcgtgtcggctagaccgtccgtctgcttgttcttcggaaccacaacttatcattcgtatttaactcctatttgcaattcagattgcttttatcttgttcttgcttgtttcttcgatttgcttgcag

SEQ ID NO: 50900 - DNA, 1501 bp, Oryza sativa
tggggagatatcccagcttctgacgtgcatatgctctgaaaattgatgaaatctctgaacacctgaaagcactcaactctgcagaaaattgcaaagggattgggcaccagagtggttcggccgaaccaagactggccccaacctctcccaatttttacaggtaagcaggtgagcacgtcttttatctgtatatctccaccatggtatagtactagagctgaaaattcagaaaacaattggttcaagcataaatgaaagataaaacttccaactcatgaaattcttcatgtgattgatcttgtatattcattattcccagctgaacttgtgtttgtgaacaaccatccatgtttagggaaccttatgcatctaagtaattgctatatgagagatgattcgagatgaaaggaattcttgcaactcttgttatgactcttgggaatttgttttcaaaataaaattgttttaaaagctcaatcctctaattgacttcatcttatgcctaccaagaccatatgcaagtatatcattgatgaaccttatcatgcatatgactgcttgacattatattgagctttgtcaaattcgtgtgactcatgttagatatccttcatactctcatgatcaagtggtcaattccactttcatttccacatataaaattaagccaagcttctacactgaaagttggctttccacaaaaatatccattcaaataaactcctacattgaattatactttcttctccttgaaaagttcttggcaaaaagaaaatgataaaaggagggaaaggcatggctaaaaaaaagagaaggaaataaagcttgctctcaaaacattgagcaaagttggaaagaaaaatgtagccatgccccttccacaatcatgccaagagaaccaatttggagagaaagtataggaaaaagggataatcatttctttattccaccattccactacatattttactttttcattttccaccataaataaagacccttgatctaggagtatgatgatcttcttgagtccatatttttggctttgcaatatatatgatgcaggtatgtcacagtttatccctaccaagctccacatattaaccttagaataggaatgaattatggcacattttgctttggtaaggatccaaaaagaaaatatacattcttgagagacaagagaggaagtcaataggagaagagcttatttgcgaaaatttataaaaaaatcccatgagtgtaacagagaagcaagaaggactagaatcaagatcgttccatttatcaattactcaagatggtaagatagccactgataaagttcacaggtgcaggtatggttgtgaatgatttatatgcttgattcatatcttgaagaaatttattctacactaacctttactcagggacgagcaaagggctaagtgtggggggttgtcacgaccggaaataacccaacgggcgttccttacgtgcgtgcattattccttgtcccagg

SEQ ID NO: 50901 - DNA, 1501 bp, Oryza sativa
agttacgcacagctaggagtggataaagtctaaaccaaggtggcacatgagctcgagagagggactaggtgtagccaggcagcatgattgctactagcgaggtgtatagccatatttcaaagacacgcacataatgcggtctttgatccaaatgtagctcgtcagctctcttgctcttttcttcttctcccattttttttcttttcttttgtctttcttttctcctctttttttttatcttcttttttttttcttttttttctagcaagctaggactaacaccaacttcaaaccaagatggccttggttgatggaactcgtcatgaaaagctcgtcgacctttcccccacacttggacttttgtgtcgcaagacatcaaaaaccaagtgtgtgatgtcggattctcctatcgagtgtgttccaatacccagggtcaccaaagtgtacaattgatgtagctacagtgttcttaggcatcgtatgaccctcgttcttaatctcaacctaaaatggttagtgaccaagaatacctgatggtgcatactatcctaaaaactggttcttgcttttattagaaagaaaacttaccatgataatccagggtatctcccggcagtgctttgtttatggtcacaagcttgaccaacgggacatcgctatgcaagattagtgccacaaacaaataggagatttgcagtatttatgataaatgtaagcatctacaaccatccttctaaacatgctagaaatgtggaccggaaggtggttgtggtcctcgcacagagacgcgacactaatcgaacaggactctagggattccttatgtgagcatgaatcctgggggattttgaaatagaaactttcatgctcatatgtggaatgttttctctcatcctccagagtcgatgtctcaagcttgtccgtggcctccttctcaagagatacatcgtgcaagaacctggttgtttcttgatgataaacaataacaacgctttgaggaccagagggacaaggcttaggcttgatcgagggtgatgagggtcgttccgtttcatgaagatggtcaataggttcagaagaaacgaacgaagatacaaacatcacctcctcgaacggctcatgcttgggatgagcctttgtattgctggaataattcagggtgtttccataatcttcataaagattaattactactactcgcgtaggaacttccttctctatccggagtcctagtactagagcacttagtataaatgctaaacaatgaacctgcaaagatggaaatatatcttactcagactaaataattaaataacataagaaaggaacatgaatgcttactttatagaagaagttctccgaacccggagcagagtataccgatagctccggtactcctcccgaattcctcctaggaagctacactcgtcgaggcagaagtcggatgagcgccaaacttctgggcactcctccagagcttcctctcactctctaccttatt

SEQ ID NO: 50902 - DNA, 274 bp, Oryza sativa
catgttctggtaatgttatatttcacatcttggccgaatataatgatcttggaatatatttgtgcatagagtttacatctgctcagatttaaaacttcctgtacatgtggataaaacatgcaagctagagaaaaatgttattgctattcaaattgtctcgagtttgccttgttttgattggaagaaacagattgttgtaaatggactacgcaaagagcaccatatggaaaaaccgagacggttttccatgcagaaggggacgatgatgtgacca

SEQ ID NO: 50903 - DNA, 1501 bp, Oryza sativa
agcgagcttgggacgtggcccgggcttgatgatcacgccttgacgagtcctagtagttgctctcatcaacgcctcccgtgtgagctcgttgatgtactcctccatagctttacgatcttctccttcgaagtcatccgatgtgaccggcatcacattagatggctccacctccgtcttggatggcggcttcgtcatggcgaagtcgaagttgagttgacgatgaacggatctcctccccagcggagtagccaaaaatcgtgttggcaactttttgtgacaagttggcaagcacgatcgcagcaccttatgccttgcggtgatcctagagtcgccaaccacttagatgggttttgataactaaaccggctagcggagccgatttctagataactacccgtctcgtgggcaaaacggaaggttttcaggacaaacctacaaagaggtgttgcactctcgcagcggcggcgggcggtttacggcgcaaaccgacaaagatggacaaactaagagaaaactaaaagcaatatgaaaaacgattcgattgattgatagtagattggtcttttacaatgaaccggccatgtcccttatataggggttggtcttgccctctacaggccctcctccacgtccaactcgggatagaagccaaaggaaacccgaaacatgccttcccgagcaaggaaacctcgagacccgacgaaacagaatcggactcggtcctgccagttagaccggccacacaccgccggtctgaccggccctcaaccggcggtctgaccgcccaacacacagcggtcagaccggcccactcggaggaaaccggtagacttccaaattttggcggggatcttttctattttaatcctaggtgccaaatttgggtgtaaacactatgtatgttagaagtataggaatagattatctttctctgttcttcccaattagcttagataatatattatgagaatgagtagttaatgcttgtgtgtcactctacccttggattatttttaacccctgcttagaatatgattatcacaagtaatatataaattattagtcaagttctctctacatgatcttcccacgggataaaataaatacgatacccttggaatactctcgggtgaaatgctacaatggtatatccgtgcacttgcggatgaactctgtaaccataatataccagaagtatttatgcgtcattgctgggaattatatttctagtaatgtcgttaagaaataccaacaaacatttctggcgccgttgccagggaagattcataatagagattacttgaactaatactttatatttatctctgtataatcattttcctttgcaggctaaccttggttgttttcactttttgttgtgaaaacagggtagtgcatgactggtttcaacttgccggaaaacttcaaagaaaatccagaagctttcttctggagcgtcaggccgcgagtcgttggtccgcagaaaactctaccgacaaag

SEQ ID NO: 50904 - DNA, 1501 bp, Oryza sativa
agtgaggttaaatatagttttgatgtggccaagtgtgataagatttttgattatcttttgcaagagaaacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccaatggctccaagatgaagcttgatgatgatccttttccggtgaatacaattagtttcaatgataaaaaggtgttgattcggccgaagcaagtcgaatctactaaggaaaaggaagtggtcattggtgagccgaggcctaagatgatagtgccaaagaagccggaggttggcgtttggaaggagaacaaaagtggagcttcaacttctaaggcccctaggaagaccaaggtgacttttgatatgctcttggagaaatataagaggcaaggtggtgagaaaattcacaacaaagggaaaagaccaagatcacctcctagggagagatttggtcattcaccaagacggtcacattcaccttcatatcatcatccacaaaacatgtcatggggtccctatccaataccgccgccgggctacccttatccttacttcatgccatggggggcaacaccgccaatgttcaactatatgcctccaatgcaattcaatcaagggtggggaggaccgaggaggccaattcatgagcgtttgtcttcatccaacaatagccggttttatggtaagaatcgggctaatgaagaaaagagcgaaggaaagcgcgtcaaggtggaggaaagggcttcggaagtaattactatcaaagtggggttccatgatgtgcctataccttctggagatggagttggaaagtccccaagcaaaaaatccgaagccggtaccagctcttcgcagtcggccggtctgaccaggccctctagccggtctgaccgcggccatgttgccggtatgaccgggccattaggccggtctgaccgtcgacccgacagtgatccgaccgacgcctcaggccggtctaaccgcgtgccacacgtcggtctgaccggcgcgtctggccggtctgaccggtggtctatggccagtctgactgggctccagcgccggtttgatgagaggattgcaaagggcaatgtgagggcttcatcgtcttcaagcaaagttaataaaggacattatctacctcctggaacagagccgaatcctaggtagatgcctaaggatttgacggctacacaaaagagaaggttgcaacgtcttcgggcccaagagctaagggagaaaaaggccgaagaacatagggataaaaggttcaatgagttgcgaccaccaccggtatggaggcctaaatccatagagaaggcaaaaccgattgatgtagaggagaaggaagaacaatcagttgataaaagtgaattatctccaaaagaagaca

SEQ ID NO: 50905 - DNA, 435 bp, Oryza sativa
taggtgctagcactagatggtggcttgctagcacataatgcatttcggcacttctattaatggaataaatcaggttggacagcacacttccccgggtgccttatctagaagtagataatatatgcaaaaagtacaataaccctcccacaacaaatattgtaatacttgcctttgaaagtattttcaaaacatgtggatttagctcctacaatttactagtacattactataaaatcaatccagtcaaagtcttggattgaagaccccaaaaacacaaaataatcttaatttggatatggaaggagtatttcaaattcatcagtgacctggcggatgcattaaaaaaataggtgtggaatagaagattagaatccatactacaacaagcagcttggaatacttcaaaggccattcctcagtcgggctcactgcaga

SEQ ID NO: 50906 - DNA, 417 bp, Oryza sativa
tagtggccccacaggtcggttttgaccgttgtgggtgcactacttaagccaaccggccggagagggaactccaccccatttcaccaaattttcattccctctccaaagtttgctctcaagttcattcaagctttgatagtttccctcaaattcaaatacttagttgcatatatacaagctgctttggtgaaactaatcggcgggtgaaattttttttattcctaacccccgccgagttagtccgttcttgctccattgtgcagaatgaggaggcgattgtctcgtctgttcaaggggtccagctcttcatcaagtcatcatgatgagtctagtactcgttcattagctaatgtctcgatggaagacgccgaagctccgcgatgactcctaaacgacaccgaccttgaccttgtcagt

SEQ ID NO: 50907 - DNA, 1501 bp, Oryza sativa
ggacggccgagatcgaacggtccacgaccggctcacggcggacgaccccgatgacgtcggcaatgacgtcaccgacagcggcggcggctcggcggagcggacggctcgggcggcgcatgctcgccggcgaacggcggcgcgaggacgcaaacggagggcaccagcacgtagaggacgacgcgacgaacacaccggtgaccaaaacggcggcggaaaaacaacgaacgacgacggcgacgaggaggaaacggcggaaaccttcgggttgtcgacggcgacgaagctccaacgatctccggcgacggcgaaggggcggacgaggacggcgacgacttggcgaccacgacgacggtcttcccgagcgacggcgacgtctggaacagcggcggagcacggctggagcggcggcggcgacggcgaagctagggcacacggcgctagagcgattccgacgacgagaggcgaaggcgaaggtggcgacgggtagaggagacaccgggggtccttttaaaggggctcggaggcggcggcgaaggcccacggcgacggcaacggcgaaggaaagctcgggaagaacaaatccgagatgaactcgaatccaactctttccaaagtgatttagccaaagattccaaaggagaaaaggtagaggagatcccggagattgtttcccctctattgattcggccggagaaggaaaggaacggccggatttggaagggaaacggcggcggcgcgaaactagggtttcgggcggcggcggccgaaggtagacgacgactgacaggtgggccccacctgtcagcgacagcgagggcgcgcgcagctgcggcggactgggccggctgggccaaggagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaaggaaattttatctgggcccattttatattggaatttattaattaaaaaattagatcttcttttcaagactttttaaaattatttctaaaaattccaattaaacaacaatttacatattttgaattttcagggtgtgacagctaatatggttttgggaattgtaagttttggatagtgctatatggttttcagtgtggtttttaatatgcatgactttgagacactatgccagctgaaatcttgtgatcgtattctagagggtatgggtgtagtgctgcttaatttcctgagctacacaattttatttgtaccgacgttagttatatgcaggttcttcgagtagactgttaaaaaagagaaaaaaaataagctgctttggggtgctatatggttttctttttaattcaattttgtagagctctagcataacctgttctaaattctaatgattagaaaaatttgctaccatta

SEQ ID NO: 50908 - DNA, 1501 bp, Oryza sativa
catttattctcacattgcaaatcatcttgatattttatttcagtttgaaatctatcattaacaaaacatttagagtaggttgtatatattaagtttattttttatgttatctaggccatttgtggattctgtacacacatttgtacaatatttgccgatttttattagcatatgctcacagttttgagtgattggtattcaactatctttgctgttccccattttactgcatgattgcattaaaacacatgccatacattgttaaaaaaagatactcctatgtagttactcctacttttgaatgaatagtacactatttggttggtacaaaatatacttgtgagtgaaataccataacaagagctatgcccccaatctaatacgagagatagtaactcaaatcaagaagaaaaccattgtgtaaaaattgtgtgtaggtacttttgatatgaaatgtatttgcatggtaaagtaaaattatacaactctataaaagatactcccactatcataagaattttatttacagagaaacacaaaatagccatgtagcaaatgcgtgggattacgtctagtatctcaaaatattcagtgacaagtttattgcaatactccatattccatcatgttattttaatatagttgaggacctacctatacaaatttggagttttcaattaattcaatgctaagagcatctccagtagaggtcctaaacacaacccctatactaattttgagagttgagactaaaaaatcaggtccaacaaggcccctacagagcatctccagtagaggtcctaaacacagcccctatactaattttgagagttgagactaaaaaatcaggtccaacaaggtccctactaaagcccctaaagtaggaaagcctccaaattatccccttaggcccccagtccctggggctttctccgcagcccccatccgcggcagagacgcacgggcacttcttttttcgtgcgaaatatcctgctagcggcgcctccacggatctacgccgctcctcctggccggcgccctcctcccctgccggcgccctcatccttggtggcgccctcctccctgcccgtcacactcctccccggtaggcctcctccttcccaacgtcctcctccttgccggcgcggcggcaccctcctcccctgtaggcatcctccctggtgccctccttcctggccggccacctgcccacccagcaatatcctccctagatcctgacgcccttctccctggcgctagttgaaggtatcatgttttcatttttccagtggatttgtggattgagttatatggtagcacctagcgtgttcgagagaaaagttgtcagtacgaaaatgtatatttggagaagaaatgggtaggaactaaccttccacgatgagatggttttgtttttttattatgtgattttgttttcctcaaatttttgactattaattaatacaataattaatctcataatccatatgtaatacaaatc

SEQ ID NO: 50909 - DNA, 1501 bp, Oryza sativa
gagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgtgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtttcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgttaaattacttaactgttttgttaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggagtggaggtttaggagtagccttggtcaagctgcctgtggagtggagccgtctgcgccgtttattttattttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaagtagaactgttctcctccctttctcttttaattaaaccaaactaatggcacatgcatttcataatctcttttaatagttctcattcaaaatttattccagtgttattagtactgtacatccattactgtactaatggctcatttatcagcaaaagttttacaatattgttttatttaatcttgctgcaataaaataaatttagcatgatgattttataactttcttttatttcttttgaaacttgttgttaaaaagtacaaaatttgtaaccttgttttcaactatttcaaattatcttgcaagtttggtttactttatttacttaccttttactttgattttcaaattttattcaagttaatccaaaaacttgtgctgttaattggatagatgtcttaactctctcctttcacttgtctttaga

SEQ ID NO: 50910 - DNA, 1501 bp, Oryza sativa; identical to SEQ ID NO: 37047

SEQ ID NO: 50911 - DNA, 1501 bp, Oryza sativa; identical to SEQ ID NO: 37060

SEQ ID NO: 50912 - DNA, 1501 bp, Oryza sativa
aaggaagagggaatcaagaggatcatttcccctctatcaattcggccggagatggaaaggagcgacggaattggaaagcgacggcggcgcggctcggctagggtttgcgggcggcggcggccgaaggaggaagacggctccgacaagcgggccccacctgtcagcgacagcgagagagagaggagagcggcggctcggcggactgggccggactgggccgaggagagagagaagagaggttttgggccggctttcggccaaagccaaaagaagactttttaaaacctttttcaatttaaattatttcttaaatgcaattccatttattaaaaatacttccttagctcaaataaatcccagaaaaatctaggaattatagaattaagcaaagtatttaacaaaattttatctagcccaattttatattgagatttagcaaattaaaattagatcttctcctttaggcttttaaaatcatttctaattattccttttaaacaacaatttataatttaaggattttaaaccagaaaagctcttaacaattataattagatcattaatgatcaaataattactgaactgttctttgtattatttaagaattgagctctgaaaaatccgagaaaatttcagagagtataattaaccatggagaatcaaataattactgaactgttctttgtattatttaagaattgagctctgaaaaatccgagaaaatttcagagagtataattaaccatggagaatttaataaaaattaaatccatccatgctttatatttaggaaattttatttcccacatttaacttcacttgtaaattaaagatcatttaatataaattatattattaatttattaaataatttataaatcctgaaacaaaaaatcaggatgtgacaaactaccccccttacaaagaatctcgtcccgagattcggaacggctagaaagaaaaagggaataggcaaactgcagtctatcttattccatcactccgataattattctaaggctttaaagaaaactactgctgctttgaaactggtggctgagttgtaacacttgaagacacaactcttgaagacgcaactggcactgcattggctcctgtgacgacaatgttgttgacttgaccttgtggctgcggatgcttcggcttcggacactctctagcaaagtggcctggcttgtaacagttgaagcatacctgctgctcccttccactactgttattcgactgatcctgctgaactggcaccgactgattagcttgctcgatgttaagttcattgctttcattagtctctaatttgatctcaccaccgatgttcaactgctgcgactgtccttgaccagcggaagaggattcaccaatttggagtggcttgatacgctgcctctggctactaccttgtgcctcctggaaaacagtcattttccttttacggttatccatcctgttcttcttgtcttcaagtcgaattgctttgtca

SEQ ID NO: 50913 - DNA, 869 bp, Oryza sativa
ttctcacttacatgtgggccctataatttttttattttgctgactaggatgccacgtcacagaaaccagagactcatgctgccatggaaccgaaattgcatggttttgtatagtttagaggtgaagatttctggtagtgggaattagggatgacacccaaactcgatgaaaagttgagggatggatggtgaacttattcccaaaatttttttttggaagctttcatgggtccagttgggcttgggcttgatctttggcaggcggcaaggccggcctagatgggagtaattattattatttctcatgttgtatattggcacatttagccacaattagcactatggtgcgtatgctcgaatttttttttagataatggaagcttttattgaactcagtcaattacatcaaggtgatacaattatcctgagaacacttccggcctctgcataactaagatgcacacagacgaacaaacaaaaccacactcgaaaagaaaaaagaatgacatggagtattgaggaccatcaatctaacgactaaatttccactcatgaacaactccttagccatctcctccaaaagcacagagttttaaggaccaccaattctaagactagattgccacccatatccctgggtaaaaaactccttgaccaccttctccaaatgttgacatgccgcaactaccatatcccgcgaaccaggcttgtgtaggatagcccatgtacgaagccaatggataagagaatatataacctgcaaaggtgaagatatgactttttttatcaaaaaccacaatattcctgcatagccaaagcgaccaacaagtagcagctgctcctaatagaacatgtgatttcaaattatta

SEQ ID NO: 50914 - DNA, 1501 bp, Oryza sativa
gaaatagtaattagatgatatcacgatagtgatataacttcgtgcagtggcttctagcagggccatacgtttgacgagaggtttgataatttggttcttttttaaagtgggtttcgattatttgatatttctgatccactttcatttactctcgtcaatcaaaataaattaagctatgtttgatatttctgatagtacactatgttatttttataagtgccaatcaaaataaattgataccgaagaaagtgtcgaactatcaaatttctctatgtttgaccctatctgtatatgtattgtgtagcttccgtgcggcacgttgagagctccatatatatttgactattcatgtctcccttccctaatgagctaagcttaagctgaaagcaacattaattaacacagcgattcatcatcacacatgatgtaagtatgaaacaaactataattaattaacccgtaaagtccaagtaaaactatagtagtacaagcttaatattaccccatgtgggaagatccattatgtacaaacttaattaatagtacaagcttagtactactcgattgatctcatcctctgatccaaccatcacatcgattattacgagagtaattaacaacaaggggaagaaaacatggtaagcttagctacctggagggaagctaattaaggttttgagccaataattgatagctgttggagaatgcaaagggtcgcctaagaatatacaaatgtgagctaggactctgacatctcatcacattagcctctcttttttttgctgctaactactaattgtatgtttttttaatttggatgtgacctgatgattgacatggactgcacttggctacatataggccatacaggaaatattgccggccaaggttgtgtttagttcacgttaaaattgaaagtttgattaaaattagaatgatgtgacgaaaaagttggaagtttgtttatgtaggaaagttttgatatgatagaaaagttggaagtttgaagaaaaagtttcagccctaggttcttttttacactcataacctgtatatgtatgtgcaacaaaataaaagacacgatattactatatatccccgttccaaaatataagagtgtatgcgaaaaagcatgtatcctaattgttgtagtgacctaggtagcatcttaagatcccgagttcaaatctccatagaaacaaattttagattgggttatttatggggctaagttcccaattaaaaggctgcatatatccggttggatatagaggctgggtaaaaaatatccttctctaaaaatatatataagggtgtatgggctactagagtggagtggactgcatacccttagctgtcgtgtcgcctcccacacatgtgactcgggtggaaactctagccgccgccgcctaccttccctaacctctcccctacctcgcgccgcttgagtgagtggccgcaaagtcggcgctcaaagccgacggcctgcgaggacagcgac

SEQ ID NO: 50915 - DNA, 838 bp, Oryza sativa
ctcagttgaagaaaaaggatccagaaggagaagacgtttggattataccccagttgagctgcctgtgggagtggagctggagcttcgctagattttattttccgctgcagttttcttcttggtgaggactaagtgcctcataagtaagtatttatcgttctagttaatttgatgaatctgtatattaaattgtcagtttgtgtacctcggctgattcctggacgaggattttatgcacaaataagttcggaaattactagtgaatttccgggcgtgacaagttggtatcagagccatctcgactgtaggataagccaaatggtcaaaccttaaggactaattttccgaaaacatgatttgtgaaaatttctcctttcttccttatctagaattctttgcaaattgtttcattgtctactctcctctctcgttcaacttgagtagttctaaaactagtggttgaaactagaagatgctgatgtgggcaacttatggaggttaagtcaagtggatcgatgaataagaaggtgatggtcgatctgaagagccaagtggtcaagatggaatgaagtttggatcctatcttagaacctatgccgccaaagtgtctttgaagaatagttagtagggtagaacgtttgttgtttgcttgtgtgtaggtatggttgcattcccatcattggagtagttcaatgatgagtgtgtaactatactaggttgtttgcttaatcaacttgaacaatataatggtctacacacatcagatcagttttaacctggttaaggtcttgtctttagtgtaacccctctccttctatcttctctaatctgcaacaga

SEQ ID NO: 50916 - DNA, 1501 bp, Oryza sativa
cattctcattgtttctttttgtagcagcttccatgcagggtttgtgtcgaaacaagatttcggcaatactaaaagggggtggctatcaagctggaaaagtgcatgggtttggagacaaaggatttatacaggttcaggccttcttattcaagaagtaataccctactcctgtccggggatgaaaccgccgagtgtattattgaatgtaagatctcccagaaaattgatgtcccaggaaggactcggacccctccttatatagaggaaggagtccgtattacaaggtataactcatacccctaacagaatacgagaatacagataaaatacaatcgtaaccgactaaacctcagggtatttccttgacgtacaagttaagaaacaaacccgagatacaaataaagatattctatctatattcggtatcatatatccagtctaaatataaccgccgtgtaaatatggggtatctataatctccacagtagcccccgagacctttgcagtcgacaacatagctctctcaaaaataataatccgagtgctttaatttttccctgctaaggcctgccgagtagcaaagacgaagactgtaaagggcgaaaaataaaaaacatggtgcatcgaatagatgcacctaattaggtgttgcccccgactatatgattagttaacaaactaaacatgtagtcaagaacaaaataatcgcataatcatgcatcatatgacaaaagcatatgcggcgtccaacaaaacattcagccgactgctttccagccatagtaaaaagaatccgagtgaataacactctaaaaggttcacaaatgaacatatttgacaggcatccgagtaaaaaactctaaagataatccatcaaatgttataaaaattatggtaattaataagtctaatagcctaggctatgactctcaccataattaaaataggcatataacacgccaagagaatgaccattgtaaaaacaagtcatctcaaatcaacccagatagcttttgcagcctaaaaaagcttacaaaaatagtataacacttttctgtcgagtacatttcaatttgcattgcaataattccgaagaattatataactgcattaaaaaggattttatcagcattgggccacaccattgcgagcataaattgccaaagcaaaaatgcctaagtccctaaggagcacaacgggccacgctgttaataatattgggctgaagtactgttcaggcctaggcacattagcacccccgaaacccttaacaaaaaatcccgaagtctaagcggcgcttcgtcttccccgccggaactctcaccatttcccccattccttgctatagtacagagctgcgccggcgaaactagggttcaccattccactccaatccacctccaaaaagttcacaaaaatcctccacgcaactcatcgcttcaattccacatctctccccagccatccctcgaatcaaatcaactcattcggatcaaatcga

SEQ ID NO: 50917 - DNA, 1501 bp, Oryza sativa
gatgccattttcgattattaaatgcatttattaaattagggtttctctcttgctattacacaaataatttcttaagaccatttattaattcaatttaggcttgggagaagaacttcaggatgtaacatccatgcactaataaactatgtcgttttccatgttggaaggaaaggttcccaactcgttgaaatgaacacagccttaatggtttggcattataattaatccatccaagcctgcgtctaatgtatgatagaagacttggagcgaggtgtgtgccacagtcacgttcatcctcgttgtatcttataaacttaaatttaagacctacagattcgtgaaaatgagtagtgagcaatgaaaagaatcaacggtccaaaactccaaaagcccatcatggcctagcaatgtgagttatcgtccatctatctcaatttctcccttctcattgcattcgtgatctttcctcaagaatgtcggaattttatattattctcacatggagtagtagtttaattcctgcaaactttctttttaagaaaaatcttcattccaaagtttttaccacattagacctttaagtttaaatttttgggtgcatcaaaacataagcatgagtaatgtgcacctgaaagtatcacacgcgttcgtcatggatttctacccacaatagagaaatcccatatattatcctacacacattgaaggcgaaatgatttctcaggatgcaatacaaattaatttacaccaggggaatgtttcaccactacacatgcttataatataaagagaaaaaactgatgactaataccaccttaatgatgcggttgcataattttgcaagttaacttgccacttacacctatatatttagatcaaatcgtgacacactgaaactatatattgaccatataagcaaggatattagtaccgttagtagaaaaatttgtacctactctgatcaaactcattccctgtccaaatttaactgataccctgcccaaagtaagtttgaaatttgttttcctccaatccccataacccatccacaactaaacaaatatatctccatagtggttttgaaaaatgcaaagcaactgtgtatttatcctacagtgctaaccaattgctgattgccatgttgcattagcacaactaacgaccacatgcaagaaaagacactgtttctaaaatgctttcacaaagtttacatgcatggcacgggcgtctaagagcaggtacaatagcagactattagccagctataaacatattttaataagataaaagataagagagaagaacagcgggctacagatctgtagccggctgtagcacggtctttaagacacaatgtgtgtatgatatgtgggaccatatattaatagtatagtaagcaactattgtatgaattgactattagatcggctatagatgaattggggcttgtagtgggctatactattaaacttgctctaagatgtgccaaaatataacttcg

SEQ ID NO: 50918 - DNA, 1501 bp, Oryza sativa
gtggaagcccaaggcaagtcacacagatcctaaccacaaccctttgagcatgttgatcctatatttaaattctctatttatttcaactgtgcatttattttcgaatgtcaccgggtggtgtgaacctactcctttgttatagccaatttgcattgaatgccctattccttgataccttgggtaataaattgattagcttgaaccttatatattggattggttcagctaaatgctatatgtaagtttgcttagctatgcttagaaacattagctaactaaaggggattaattataaactatgttacattattattattaattatggttacatttaatggtagctcacgatggtaaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtgacatgatgtggggttgtgtcttgtgggtacagtggtacacctctgatcagagtttaaaactattcgaatagccgtacccgcggttatgggtgagttgagcaatgtttttcgtgattagtctcacactactcattattggtgaaaaggtgtaattgatttaattcctggtctggaatggctaattcctggtttggaggtttaatttgttcaattggggttggttgttcaaatgtggttgggcctatgcaacacgggtgtgttgtatggtgtttatttaatattgattaattattcaactgttttactattctcttaaatatttattaaatgttgttttctgcaaatgagctatattatgccatcctttgttatcctgtgcacttgcatatttgctgtgtggcttgttgagtatgttatatgctcattcttgcaatattcattcatcagaagaggagtacttcagtgaaggtgatgatctggaggactaggcctgttcttggttaagttgcctgcggagtagagtcgccatcgctgttccgtagtttgccatagttttattttccgctgcgtagaatgttatttttgtttgagaggaactatccacctctgtaataatttattattttcgaatattccatagttaaatatttgtactctattatcaatattgtcattgtgtgcctcggttgattcctggacgagggcttaacacacatgtaagcgtttggaattttggatagaaattctgggcgtgacaagttggtatcagagccaccttgacttta

SEQ ID NO: 50919 - DNA, 177 bp, Oryza sativa
tatttgtgctctgaaaattccactaaaatttatttacgcattttaggcttttaggaaatatacaaaaatcctccaagccttatttgacttttacatttgcacattttaattgttggaggctttcacatggattttacttattctttgcataatttcgaggatgtattttagagtcgt

SEQ ID NO: 50920 - DNA, 1501 bp, Oryza sativa
aaagaaattgagtttcaataaattttgtgcataaccttgcatgtgctgccaacttaattaatttgtaagagaatagagaagagcagttctatttttttcaaaaatattttgaaggctacttaaggtttaccatttagcttatcctaaagtcaaggtggctctgataccaacttgtcacgcccagaatttctatccaaaattccaaacgcttacatgtgtgttaagccctcgtccaggaatcaaccgaggcacacaatgacaatattgataatagagtacaaatatttaactatggaatattcgaaaataataaattattacagaggtggatagttcctctcaaacaaaaataacattctacgcagcggaaaataaaactatggcaaactacggaacagcgatggcgactctactccgcaggcaacttaaccaagaacaggcctagtcctccagatcatcaccttcactgaagtactcctcttctgatgaatgaatattgcaagaatgagcatataacatactcaacaagccacacagcaaatatgcaagtgcacaggataacaaaggatggcataatatagctcatttgcagaaaacaacatttaataaatatttaagagaatagtaaaacagttgaataattaatcaatattaaataaacaccatacaacacacccgtgttgcataggcccaaccacatttgaacaaccaaccccaattgaacaaattaaacctccaaaccaggaattagccattccagaccaggaattaaatcaattacaccttttcaccaataatgagtagtgtgagactaatcacgaaaaacattgctcaactcacccataaccgcgggtacggctattcgaatagttttaaactctgatcagaggtgtaccactgtacccacaagacacaaccccacatcatgtcaccatgtgcctcagtaccaccacgatacctcggaaaggagtcgtgacaatacccctcgcataacacaattcaccacagtgcaccgtacctggatcataatcacccccttataaacaaggcatggactccccagcgacccccatggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgatttaccatcgtgagctaccattaaatgtaaccataattaataataataatgtaacatagtttataattaatcccctttagttagctaatgtttctaagcatagctaagcaaacttacatatagcatttagctgaaccaatccaatatataaggttcaagctaatcaatttattacccaaggtatcaaggaatagggcattcaatgcaaatt

SEQ ID NO: 50921 - DNA, 1501 bp, Oryza sativa
actaatgttttcttgagccttatcttatttagtctcctttacattgagaacatagagatcatgtaggtatgtgtttttgtttatctttatcattgctacatgccttctctatgtgtataggataaaccccattggttattcattacttatgcatacactcgcctctcttgtaaatttatttgtatgcatatgtttagggggagtgaatcctatacatttattgtgcatgttctagatccatgttattcacctattattcatattggatctttgcacttgagcttgcatacgagtatatgacacttgtggtgtaaatgaatactcaacaaatatatccatatctttcatatgcaaccggttgatcatcaagtgaaggatgacaaccgatttgttgagactaatgttctcctttgagatgtgaaaaggaataggttccaccataatgaggctaatgaatgacaccatgggttaatggtcaccaagccaaggacatcatcatgttggcaagaatgaagtcaaaattgtgatgagaataaagtcttgacaaaggatggtaaagacctcggcataaacatggttcaaccggatggtcacaagtgttgatcttggcttaagcattgaccccaagttggatggcgcaaggaaaaggtataatggagctaagaatgttttcttagtcttttcccgttcatggtgtttggtgtagaccggatttgctagatagatgccgtactatcaagaggggtctatgaagcgagcatgtggatgatcttgcaccatattagttcatatgcatgtaggtgtatttggtgggcttgtctagccaagtgtggtgagttttctcaagtcctaaccaaagagagaagtgggaaaatcctataggtttgggtagcctcttgtgggtatgtccggtggatatcctttggagtgtgagccctttatccttgtcttaagttgtgtttcttggatggtttttttatgggttggatggccctttgaataagctttccatagagtccaagaacgccaaattccgagacccgagtcaagagagatcgccgttttactaacggtcggttgagctgaaaagtgacatgcggtctgaccgtgggccttaggccagtctgaccagggctgttagccggtctgacctacgtggtaaggccggtctgaccggccccactggtctggtttttggtagcgatacagatctatcagagccgcaaccggtcagaccaagccgacggcggtctgaccgagccgtggacggtctgaccggccactatactgcggtcagaccgaccaggttgagtgggctcaatgattgccctgtaacggctagttttctagccgttaaaaagtagtccggtctgaccggcctcacaatggcggtctgaccggcagagcactgagttggggatttcagttccaacggctagttttggtggttgggggtatatatacccactccccagcagcaagggtaaggttttggcactcc

SEQ ID NO: 50922 - DNA, 257 bp, Oryza sativa
tcatcccagtggcgctgcgaccaccaagggagttgcttggaaggagggtagaaggcccagcgggcggcagcggcgcatggtggatgttttttgccgtcgtagcccgtcgatgacacttgcttgtgtcggcagtgccaccgcctcctcttgttgctgctgtccctcccgtcgtcatcttccatagtgatggcggtggtgaggaagcggccatggatgcgacgccatcaggcctggcctgccactgcaatggaagacga

SEQ ID NO: 50923 - DNA, 1501 bp, Oryza sativa
gtggaatatatttatctccttttaaagaagcaccttgtttctatatttcatatccatacctttaaaaacatcacgttgtattttgctccatcgtttgcccgttagcttatgagtcaaagcaaaatttgaatttttagacttaattctagagttaattttgaggcatttttttattatagtttagttttcagcattggtttttaaaattgccaagagcacatatatacaaattttatacataaatcaatttttgttgcttcattctattttacaacttaatggcagagcaaacgatgaaaataatttatatcgtgtgctctagaaatgttgttttcactatatcatggatcagtttaggtagacgtgtagatatccttactccgtaataaaacgagccaacaatgctagcttagagccgttaattattgttacaagtaaatgcaaccttaatctatatatgcttatctgacttcaaaagaagtactccaaccatgtaaccaaaatccaaccgtgttataagtcgatttaattattctctagctacttactaaagtttgatatactcttatatagagaaaattagcaacatctacaatacaaaattagttttattctaacattcaatacattttgataatacgttttaaacattagtatataattctaaaaaataaattaaagcaatgtcgagtggaaaatacaacttttatcactgtgatgcaatcctatatacgactacctttatatactactctattcatttcaggttacaagacgtttttactttggtcaaaatcaaactctttcaagtttaactaaatttatagatacatatagtaatatttataatactaaattagtttgattcaatcaataattgaatatatattcataataaatttgtcttgagttgaaaatgttattatttttttacaaacttggttaaacctgaagcagtttaactttgataaaagtaaaaacgtcttataatctagattagagggactagcaccagtagtcggcaaacacattgcaactatttgaccagagtcaagtcaaacaaagcatagcacactcctccttaatacaccctacatacacaaaaccatactactactactagtaggagtctccccgttctgaaaaaagaaaaagaaaaaaaaaacctccatctcccgcccagtgccgccgcgccacgtcacccctcccccgccgcgcgtgtgtgtacgcgtagcctttccggcggagacgcagcacaaaaatggttttacttgcgatacccttcgtctccctcacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagta

SEQ ID NO: 50924 - DNA, 1501 bp, Oryza sativa
gaaaggcggttgccaacatgttggtttggttaaccacaatttggattagctctggtgaggtttcgttgatgcttttctcattcccattggcttgggttcttgagtcatcggatccatcattcccatagcctttgttaccagtgttatccatctgtcacaaggtaggggttgagagaggaagcatacaaggaaagaatagaccagagctagggacaggaccttaaaggaactaactctttttattgatgtgttgtttgttttgcttattctgcaagttgattaagcaaacaacctagcatggttacatcacaacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctagcggatcctgcagtcttccggagcttcggcaaacaactgacgatatcttcttcttcactgacctgaccatctagtactagttgaaatccgaagaaggaagaacggagtaaaccttttgcaaatagcattaggggaaggagaaaaaggaactttcgcaaataattttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacagcagcgggctagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggagatgcacaattaatgcaaaggagtacaaggggataataatatagggtttaaggtttgcagtaaacagcatttaaaagtcacttagttgcccaaagccattttataaagacgatcctagagctacacagtattattaaacaaggccgtgaaccctcacgaacctgccttaacccaaggcctacgatgatttggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgcaaacacgtgccacataccaccacggtatacggacggaagacgtgacatagttcccaacccatcctagc

SEQ ID NO: 50925 - DNA, 1501 bp, Oryza sativa
ccggtagtcgagatgtcatacggcagagggttggtgccctgctgctaggggctcagttctgcctgcctgtcccgggtatcccggccgtaggtgggattgggtcggtactcttgtttatggctaggatgggttgggaactatgtcacgtcttccgtccgtataccgtggtggtatgtggcacgtgtttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagcccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaattatttgcgaaagttcctttttctccttcccctaatgctatttgcaaaaggtttactccgttcttccttcttcggatttcaactagtactagatggtcaggtcagtgaagaagaagatatcgtcagttgtttgccgaagctccggaagactgcaggatccgctagcgaagcgaaggaagcagtgaagccagctgtgaagcaggagtgaagatcttggagaacccgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaataaaaagagttagttcctttaaggtcctgtccctagctctggtctattctttccttgtatgcttcctctctcaacccctaccttgtgacagatggataacactggtaacaaaggctatgggaa

SEQ ID NO: 50926 - DNA, 1501 bp, Oryza sativa
ctactaatggctttaagggtggtcagtattcactagttggcacaataatttaggtgatggtatgcgccatagtttcctatgttgatatttattcattagtttacataagttgacatataccagcctgtatgttgaagaagttgaacttcatcttgcaaataccgaaaaggatagggtacatgttgcaaatatacttatcactgccaaatatgctgaggacctatatgtgatttctgcaaacaatagtgctccgatgaaagattgaaagagtttcctaaatgacatttagacccagataccactatgtaatgtaaactagatggtacctcgcgcgttgctacggaacacttaacatattgtcggattaggaaacattttttttataatatgccatataagcaatctaacatggccgctgataacttgacaggcagttatattgtttagagactaaataacatgttaggaaggaaaaatgagataaattgtatcgttgattttaatcataaattaaagaaaatgcttctcactaatttggtagacatcacattgctaggtaaagctataatcacttgaattgtttggataaacagatgtcaatccatcccatgactccatgagggagatccattagaccaaatgctgatggtcgatgcagttgctgtaaccattgagaaaacatacatttactagctaaaatcaagtttacataccagcaagatcatgtaagatattaaagcccttccatagttccatcaaatgtaagtctgaagagcaagagactggctttggtttattccttttatctagtggtctggtgatgaactgaaacaattcaagttttagtgttttattatggaaaaacaaaatgcacctaaaatgcacagagctccgatggagggaggaccatggaaatgatgaggaagatggcggcaacaggaggggattcctcggcgacctactccacccgttatcgcgctgggagaggcgacgaccggcatctagcgagcagccggcggccatggtcgacaagcggcagcttcattcttgatgcactgcttttttcagcttcgtctttattttgtgattgggccgaacctagaaggccgtagcacgcttgtgggccgagcgactgaggacggaggctggattagcgatgccgttggatgcagaagaaacgatggatctggcatctacgtccctctgacgtagaggcattctacgtcagaggatcgtgttcccacctagtaatataaatctagacaactctgttcagattcgtaatactaattaagtggcatctaatcgaattctatgttgctagaatttgatacggaaggagtagttgctacataggagcaagagatgtggcacatcttagatgcctgtgcattgcatgtaaactttgtgaaagcattttagaaacagtgtcttcttttttttttttgcatgtggtcgttggttgtgctcatgcaacatggcaattggcaattggttaaca

SEQ ID NO: 50927 - DNA, 911 bp, Oryza sativa
acagtagttcatcatcacgtcttccgtccgtataccgtggtggtatgtggcacgtggttgcacgtgaggaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctgggacccaggtcgggttgccagttcggtccaaatcatcgtaggccttgggttaaggcaggttcgtgagggttcacggccttgtttaataatactgtgtagctctaggatcgtctttataaaatggctttgggcaactaagtgacttttaaatgctgtttactgcaaaccttaaaccctatattattatccccttgtactcctttgcattaattgtgcatctccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagcccgctgctgtttatttttgattgtcaggccttaagtgcctttgtaataatgtaaatattatcgatataataaagatgtgtcttttatatcatgtttgtgtggtgtaccccggctttttctgggacggggattaatacactagcgttcgggaaaaggcaattttcccggtcgcgacagaaagtaacaaggcagaattggctgcacaaagggactcggctttgaaggaggttgaaggtattgtcagccaacaacctgagtttctctctttgatgcagcagatcattgacatgaa

SEQ ID NO: 50928 - DNA, 1501 bp, Oryza sativa
  unsure (1)..(1501): unsure at all n locations
atcttgaatggtcagagtatggctgtatacctggttctcgaccaggngtcacaacgattctcccactgcttctgcaaagtgatggagaacaactacacactcggtcttcaccttgtgtggtagtcacctcatgaccccatatgcatcaacttctgtaagtgtttatatgtgtaatatttgtccgttgatccttttttcttctatcgcctcgtcttgaagttgatcatatcgtcctttacgctattctgacaaagcctcaagaaacctaaggggattccggctggggacgcccagagctgataaggccttgtcagatgctatagagccaaatgatcatgtcatatctagtcatgtcagagtgctccttggatgcgtattaactaagctgtgtaatcaggaattggttttcccaacttcatggccgggggcttcgatttcatcagctttagcttggtttgttataagatttaagctgcctttgtggaaaacgacttttccataaaaacggttgggggctaggaagggtaccatactccgaccactgagggcagctttagcgagaatactcttttattgtcacatgcaaattcaatttattcttaattttgaaatttatattatatcgtttaggggctatttgtatctaacaatctgttctgagttttgatttcaggaaagtcagacttcagggttttgtcgcagactctacaactacttgattactcgagaatggttagagtttgacaaggattacagaataaagcagaggtgtacccgccgagtccgaattttttaacttcaatccaaattctcaattacagtaagacaaggaatttagttgcatactccacaccttctcggtcatccgagaacggttaagcgagcatgacgacttttgttccatggtcttcggtcgagaacatcaactcgttcatttgcattgaagtcgggggctattgtcatggttatggatacatacccaatagtaatcgacaaagctcggtggggcccaccatatgtcgtcttatatggaatcatatctcgtatagaagggattccgaataaggaaggacaagtagagttttatatggaaactataaggactactcggattgtatccatattggtctccctagctttacttggacaagggaacatctatgggtattaatacaagaccccctaggaggagagaaacacaagccataacagaccaatactccgccaaacatcgatatcagagattagcctagacagacccaatatggtggctacggaggcagacaagagggatctggtgccacctcttatctcaacgagttcgtattcgaggaggaagactaccttgtcatcgattatgtgttggtgatccatgctgccaagtcaacaacagctagataggttaccccaattgttatacttgtgcgatttagatgaataaagagtaacaccggcttctgccaacaggagtaaggttgttaccttcctttgaaggggctga

SEQ ID NO: 50929 - DNA, 1375 bp, Oryza sativa
tgtggttgtactcattcttgctcaatctttcccctcttcagtaagagaagctttggagaagatgtcttaggtggagtcctggcttataccccagttgagcgcctgtggagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatgcactagcgttcgggaaaaggcaattttcccggtcgtgacaagctggtatcagagccatctcgactgtaggataagccaagtggataaaacctaaggacatattttataaataaaactatttgcgaaagttcctctttttctccttcccctaatgctatttgcaaaaggtttactcttttcttccttcaaatttcaactagtactagatggtcagctttgcgaagaagaagatgtcgccaattgtttgccgaagctccggaagactgcaggatccgctagcgaagtgtaggaagcagtgaagccagctgtgaagaaggagtgaagatcttggagaaccagtcgcagaacctaagccgccctctagggtagagtcgttagttgtgtgtttccttgcttgtgtgtgtagcgcgtggtttgcatcagtggggtgtgatgtaaccatgctaggttgtttgcttaagcaacttgcagaataagcaaaacaaacaatacatcaataagaagagttagttcctttaaggtcctgtctctagttctggtctattctttcctggcttgtttcctctctcacctcaatccctgtaacagatgtttaacagagaaaaaggaaagaatgtcagcgggtatgcctccagtaactcaagttttcaactcaatccaccactggcctcaagagagttaaccagggcacacccttggtccattccaagcatgctgcttagttcacagctaccattggttggaagtcaagaccaaaatcagtatgtgtttgatcgagcctttgccacccaggtcaatgagcttccaatgccagaagagcaggtccccttttgtcatgattgtagagagcaaggacactatgccctgaattgtccatgggtatatgtcaaagaagccccttcccttggtttagcagggcagacatcgctaaaccagcctcctcacaccaagtcaagcttgcagcctagtgtgcaaagtagagagctcaacggagagaatccattgaatcccgggaaatactttcctcctagcctctcgtaccacgtggggtcacatactaagcaagccaaaggcagaagagtaagaatcagaagagaaaagccccga

SEQ ID NO: 50930 - DNA, 1501 bp, Oryza sativa
agttatattatggctatctaattaacctacttgaggatggtgagatgttactatggtattctctaagggggggtgttatacaacgttttctactggtggtataaccaatctagaccatttttgttttctatctaatggattatatctatttatattatcgcattattgatggtacactactcatatgtataaatcaatggttgagataaattctattagtgtaatactacttataatcttgtagtattctaataccagtggagagcaccgtaaaggtactaaagagagccttcgggacccggcacgaaaaacggagcagcgattagcacgtgattaattaagtatttgcttttttttcaaaaatggattaatatgatttttttaagcaacttttgtatagaaactttttgtaaaaaaatacaccgtttagcagtttgaaaagcgtgtgcacggaaaaacgagggtggggagttagaaacccctgctaaagaacacaaccttaactagtgttccttagaaacacgcaccatggcatctagtatcattcatctataatggaggcaatatacttctagggtttccatctttatccacaaagatagctagcagaaccctatggtgccgaaggcagaagccgtacatattcttacaagctaaggaactcttcttgccctctctatctctctcacctgatgcatgtaaaagatgcacaagcacacagcactaagggggggggggaaaggaggtagaaagctagagagagagagaatagttcccttgtccaaatcttaccctttcactagctctctctgttctcatccccttcttcatcaccttatagtggatgtcattctccactcctttgaacaattgaacctcccccatgcattcatgaacccttaaagcattctcatcatacaccctgacatacatatctcacaaagaagcaagggaggaccaaaaaagaaaattaaagaagaagatcataaaaggagaatccaggggttagaaaaagatcaaaagggggatcaactccactacctctcttgatccatcatgtggaatcaggtacataagaactttacccttcttgagagagtgctgaactccttattactccctaattaaagtttgtttctttgtgaaaaattagcttgttgcttagctacttcttttcatgtgtaaagcaaaagggaagaatatgcaaaacaaatatatgttcttatcaatttatgatagatagaaagttacaagccaatatattctcatgctactcttgcacaaaccctagctcatatggttgtagtcttagctactatcatccttttgttttcctatctaattacttcttatatctattcattcatgttactagcagcatcaagctcaccatggccatcatcagcttcaccaaagtgtggaggcgaatcagctgccgatgacctcggccagcttgctgcttgctcctcggtcgccagacatggccgccgccgggatcctt

SEQ ID NO: 50931 - DNA, 1501 bp, Oryza sativa
ttcggccgcccgttcatcctcgccggctcgtcgtctcgcggcgccgcctccgtcatcgtcatcgctgcggcgtgttccacgccatcctcgcattcgtgcagccgctgccggctgccctcgtcgcctcctcgccggccccggtcgtcgtcgtcgtcgtcctctcatcattcccggtcgtcgtggcgttcgtccctccgtcgagccgttctcatccgtcgtccgcatcagtcaagcaagccgcggcagccccgtcctcgtcttcgtcctcagctccgcgtcgtcaagccttgtgccagccgcgtctcgccttcgtccaaggatcgccgccgaagtcgttccctcgccgttcgcctccgtcgtccccgagctgtctccgccgcgcccgttcgtcgttgtcgtccccacgcctcgtcgcgtggtggtaaggatccctctccctcgctgccccgtcctcgtcctttcggtgtcgcccgtgctcgttgtgcggttgtcggccccggtacccgtgtaccggtgtcggtagtcgttcacgcgtgcgggtggtgaccgtgtagtgtccgcgttagtgtgcccgctcggtgtctagtggagtccgtttgtcgaccactcgcctcggttgacacacagggtccgcttccatcgacccgtggaccgtctctgtgtacccggtctaccgcggtcctttaggttgacatgtggggtccgcatgtcaacggcgcagccttcctgtcttttccaggctagtgcttacacatattttatagttgcaaagcttaattataataatccgcaaatccccatataacagcattaaacttcggatgatcatatcttggtcatacgaactccgaatcgacccgttcaagtctcctaatgtttgttataacctaaagaaccctgtgctttctttttatgtattgttattgcttctttgtaggcttgtagctttgcttgtgtgcttcgcgtagctttcgtcgtcccggaggttcccgaagcgtggttcgtggtcgtcgccgaaggttcggaaggccgttccctctgagcaaggcaagtcacatcatccttgagcatattgaatcccagtttataaaattatttttatttaaattaatgcattatcgctttatttaaattcccgcgttatcactgttttatttagccatgcctatttacctttgttaaggcattattattgctattgttattattaccttgttcaccctaggataaacaaaaccccaactagtgggtactctattcatggttccactagtatgaatttaggtagatgcttcgctgattaattaggcaatattaggtggttttacaactttagacgttgggaattctcatatcatttggatactatggaattgttggtttatggtggaattggacatacacctctcttcctctttcaaaacccctaaaacctgttttcggtggggtttgggtgcatgccagttgtgggaagtagcaccccggccactataaggattaa

SEQ ID NO: 50932 - DNA, 1501 bp, Oryza sativa
gagtggagctggctttctgccgctctactgtcccactccacccaaaagacccatcgcctctttaatattttcatgtatttacgtgatatgttactaaaataccccttcacacccatctcctccggttctgtctctccttcccatgattcttcctcccttgatcagctagggctattttcatgtatttacgtgatatgttactgaaataccccttcacacccatctcctcccgttctgtctctccttcccatgattcttcctcccttgatcagctagggctaggacggctgggcggcgatcggtagaggcgactgatggcggcggttgggtggtgtggctgctgggcgattgggcaacgcgcgagggcagcaaggcagtggcggtggcgtgtgggctaaacgtcgatggcgtcggtagggtgacaatgcgcgggctgagcgacgacaatgttgatgtcgacagggtggcgcgcgggctgagcacggtatagtgcaaaccgtgggacccaaaaccatgtgttcgatgaattggagacgcaggacatggtggcgtggagctgaccaatctagccaaacacttttatgagctacggtgtgactagcttgagctcgagccaagcataggcttacgtgacttagggccgaacggcccatcagctggttggttttttttctcccgtagcacaacgcacgttagctcgattgattaagagggtgatgaggcacacagcacacacgttcttcaattcgcttgcaaattcactgcgccacgtagaccaatcaaaatctcaaagaacggctagctttagataattagatatgcccccacgttgttcaatagctatataaaatataaataaataaacaatatttcttagttgtatttcttttatttttatctgtgttcttagttattgaaatttgacactatgttacctttaaaaatgaattttaacattgcattattgtgactttgaaggaccatgtgaaacaataatacatgtttagttttttttttctcattgcttccatctccttgaacttgaagatgtgtgagggacacattcgtagttatatatgtgtggatgtacgccttcgatttattcgtgaaaattaaggttgatatggcccatcgatttatttgcggattgacacacttacacctagtgtagcaatagaacagattgtccgactgtttaatgtcgtgggcaggcaatacatagtaaaatgtgtggaactaaaagtaagtgatgaactagaataaccacatttaaacgaaatcgaattatatcgtcttcatatccccccggccccgccgcagacacacactgcaaacagagtactccatccgtcacacaatataagtgatttagaaaggatgtgacatatcctagcactacgaatctagacaggaagcctctctagattcgtagtcctaggatatatcacatctctctagaatcccttatatttttggacggagggagtagaacataaggtag

SEQ ID NO: 50933 - DNA, 487 bp, Oryza sativa
ttcaaaacaatatgcttgcaatcctgaaaaatcacgccatacaacctacattactgcggaagtagattttcgtcccttgaggggacatccccttgtttcgtgcatggtgttcaaaaagttatcaaaaaaatttaaaacaaattgtcaatataaatcaatatatgatatatcttttcgcaaatatacaagttaaaatttgacttatacaattcgaaacaaaaataacaaatttgaccgtgaattacacgttctattcatagtcaaatttgttatttttgtttctacttatataattagttgaatttgaatatgcatgtctgtgaaagtgacacatcacatattgatctatcatactaaatttttttaaaatttttttgatgactttttacatgacatgaaaaacaaggggattaagggatgaatagatttttcgcattactacaattttccttgcgataaaactaataaccaaatgtctggctcgaca

SEQ ID NO: 50934 - DNA, 749 bp, Oryza sativa
tggaaacctctattaagggaatccgtttcattttttgttccaccaaaaatgttttaactagtgtactcacaatgtttcactatgtatagatctaatgttacagtaaattgaaacattcttttgcaacaaatcacccacatattatagaaaccctctattaagggaattcgtttcattttttgttctaccaaaaatgtttcatctagtgtacttataatgttttactatgtatggatcaaatattgcagtgacttgaaacattctttcactatctgctgaaacattgtttttatataaggtgaaacaacgtccgatttaaacgattgaaacattttcgatctacttagtgaaacaattccgatatacttggtggaacagcgtgcaacatttaaaaataattcaataataagctaaatttttttcatcggaatatatccatgcgtggtcttgttttaaagatttaattgcaacggatttaatggtgcaatctaatcatgatttggataaataatttaagagaaaaaaatagtgtaaaatagttttgcatacatgcttgcttgataacgtcatgctgacgtgggcacctgatttttcccacccccgatcgggcgcccggcgcgtagtcgtctcgcattaatttcttctccttcgaatcatatagctcttcttgtactttctcttctttctcaatttgtcttgaaaattagaggcgtatgtttctgttacttgcccgactatttccttctagt

SEQ ID NO: 50935 - DNA, 180 bp, Oryza sativa
tggtgacttgggccggtctgacgggcggcatgccgccggtctgaccggcgttcacgagcggtttgaccgtccttgcgtggccggtctgaccggtgttcagcagagcgttgggggcacgctccatcgatttggagtccgaattatttacaattcggacgtttgtgccaggatacaagaaga

SEQ ID NO: 50936 - DNA, 1501 bp, Oryza sativa; identical to SEQ ID NO: 37057

SEQ ID NO: 50937 - DNA, 1501 bp, Oryza sativa
gtgctttgaggatagggtgcatggcggagaaaggagatgtatgatgggtagaatctggacgagcatacgcgcacgagagagagaaagagagggagggagagagttgaagatttgttaattcttcttgcttaatttcagcaaggaatactccgctgatctttattaggcaccaggtattcaggtaactagcagacttcaaatccaaaacgttaacagactgaaatacatgtttctgtcactcatctgtccaggatttattgtactatggttgtacgcttcccatcattttctttaagagcactcagcactgggttgctgtttcagtgcaaagatcaagtaaaacgcggtggggaaggcattaaattgttcacatttggagtacttgaagtacttcaatccaaaataatatatgtagattagctaaatgttttcgtgcacaattcagacccaagaactatcttactatttaagcagccatacagccagtttgtgggtgctacggtgcgcacagctatgaacaatgaactctagttacttacaagaatttttattaaatccaatcagatttgtaaatttgcatacatggcaagcacttacatgatttacgaggacgagcttctggtagtcattcaagcctgcaagccaggtgtggacaggatggaagtaccaaccaagagtttcatcccgctcatatcgcaaaaagtaattctccttcaacagttcgcctcgagagtactctgctggatccttcatcgtatcctcaaattctttgtttagcatctggaaatagaaagtagaaaaaaatattaacacaaattaaacagaggatggaattagctaacaaaaaagcattaaaccttgcaaaatctgatgcgatagcgtgcatgccgctccttaacctcaatcatttcgtcatgactcagcaaggaccatttgtctatgcgacgactgttgggagacaactgcttgacgtaatcaaagtagtcgtcctggctagtttgcacgtttgggccccaaagctcttgttcatctttgtgttgattgatatcttcttctgaggctttcagcggatcatcttgccttgtaactacgcccatgtccatagcatgcacagtattgttggtagattcttcaagaacctgatgcacagctgtcaatgaggtgcaggcatgtgcattctcattggtgtcaccggaaacacaagggtctagggccagcttgtccttctgtcctgtccacatgttcgttccatttccatcatcatcactgcccggaggatcagatggcagcatcccttccatcagcggcgattttcaaatcggtgatctgcgataattcatattagttctatattcctcagggttgtgctccaggcacatatttgcatacttgtagatacgctgcaaaccaaagtatgtctatgtctatcaggggcggatctaacatgggaacccctaaactttttgggaacaaccaaactgttattagtattaaggttaag

SEQ ID NO: 50938 - DNA, 1501 bp, Oryza sativa
agcgactcagaggtggcagcggcaccctcccctccaacaaattcgacgagaggggaggcagcggcagtggtgccctcccctccgtcagattcggcgggaggggaggaggcggtagcgccctcccctcctttcacattgcttgtgttgtttatgtttatgtttttgtgttcttattgttcttgtattttcttggattaaatgtagttaaaagtgcgatgaaatatggttggggtgatggggactaattgcccgatgcatcggcttgatcaagctgatgcaacgacccggcctttttttcttttcattcctgagacctcaaaggcacctttgagagaactcaaaggttctggttgcaaaatccagcacccatatgtggttgtcaactgacacatatccttttctatagtagtgcctataaatccttgatggatgcaagcattgttaattaaacacaccagcaaggcacaattcaagaggtgtacactgtacatcttgtttgctgctgtactagcgctggtagctagcttgagactgatttccaagcttgatatagggataccattcagacgtaaaatccatgagtggttaactaggaaatcgatcgaacgccatcaaattcagattcgaaaaggggtaggtaagtctcgtacgcgtgggtttacataattagttcgttttgctttgagtaatctgcatctcttgattgtttaggttaatctctattgtggctcgactaacacatgcattcattagcagggggcgacgatgcctggatggaatctgttgtcgaccagggtagtggtaatcatcagctccgtggcacatctcggcctcgtcttgtgtgccgaagtccgccgaaatagtgcgacaggctttcggattgtcatcctgtgggtggcgaaccagatgtcacgttgggccccgaccaccgcgctggccatgctggccgccggacgcacgccgcaggaggagcagctggtgacgctctgggtggcgttcatgctgctacacgctggtatgccggacaacatcaccgcctacgccttggaagacggcgttctctcgtttcgccagagtgtaaacgtgtttcttcagcttgttggacctgtgtcacctgcctatatcctgcaccagaatatgttcgccatgcctggcgactccatgctgtgggtctcctcgatcatctgctgtatggccatctgcaaatatttggagggggcgtttttcgcgctgcagcgtggcaacctggaaaacatgcgaagcgaaagcaagaaggaggttccaagtcgaagagtaacaagcctccaaagtctaaggcgtggcggcaaaccagataatgaccaaatcatgctggttgctcatggcaatctccatatcaccaagggtgccttcatcgataatttgcaatacgagcatgatgcccagcaacaagaaatactcccgaaaacatgggatgaaaacaagacactgtacaaggtggttgagatggagctctccctca

SEQ ID NO: 50939 - DNA, 1501 bp, Oryza sativa
agccttccattgatgataaggttagtattccaccagttatactaatattcagcctattttcagcactaccttacaagcaatctaatctcctacttaattttgcaaggccacaaagccaaagagtggacagaaaactttggaacatccatctcttcctgcagctggaccatctgaatctgaatctgaacataaggtactgtcacatctctttgcttccatataacatattagatactaacacatttatctatcttataagatcaaaggaacttttgtcaatacacctgatgatccacctattagcccttctgtgcctagcaaaagtgcaagcaaaaaaaggtacctatggactgcttgcctacagcgcatcagtgatagatgcttacaatattggtaatttaactgactgttataacctaatattacacaggaccaacactatagcttcagttccagctccacctgctaagaagctattcaaagaacattcccagcacacaaaggatcaaaggtaatcctcctatttcttgacagtacctaagcattttgacagccataatacaaaagcaatatatagctatagacaagctttaggctctaatttttttttccatgcagtgaatgagatgcttgtgtccagccatccaacagatattttgggtgtttgtacaaagcctatgtacatgctagaagaaaggaggcatccaaaataaagctacaaagttaaaagcaagactcttttgctgaagacctacatcctaatattaatgtatataagtggtcatgctggggtcacctttgctagaacatatgctatgtatttactaatagaagtactgcgtcctacatggaacattaggcaactatgacacatatctagctatcaaccctctatcctgccagctacataattgcaatgaaatcaggtttgcaggccactgctatatgaaatttagcatgcacttctgccatcatgcttgcttcttaaaatttggtgtgcatcttcatttatctagacacataaatttcattgtttcatgcccacctgtgtttacttttaatccatgatctacagttcatccgtgctcaataccagaagaagataaggaagcgaaagtaaatgttccatctttatgttttagtgctatgttcccccaaatttgcactgctcatgatttcatacttttactattgaaatttggttctgttgatcaatatgatgtattgttgatattctgcaaaaaattcaattttcattttatatgtacatcatagatagaacaagatatatgccagtgatctaatgtacaaatatttagttaaaaacttcataatgcatctcagttagcattttaaattttaataggattgatcttctgttgttgaatgttctttctttcttctctggcaaatctgaaacaattattgcaatgcatcaacctaataagtctttcgtacaacaaaatagcatgctgaaattagtgtattataggatggtcgg

SEQ ID NO: 50940 - DNA, 1501 bp, Oryza sativa
gactcctcgtaaagatcggcaaagtgaagttaagtatagttttgatgtggccaagtgtgataagatttttgattatcttttacaagagaaacaaattagattacctaaaggccatgtcataccatcacaagaagagttaaaacgtcgggcatattgtaagtggcatgattctcattctcactctactaatgattgcaatgtgtttcaacgacaggttcaatcggccatagatgaaggacgattgaaattcaccgatggctccaagatgaagcttgatcatgatccttttccagtaaatacaattaatttcaataataagaaggtgttgattcggccggagcaagccgaatctactaagggaaaggaagtggtcattggtgagccaaggcctaagatgatggtgccaaagaagccggaggttggtgtttggaaggagaataagggtgaagcttcgacttctaaggctcctaggaaaaccaaagtgacctttgatatgcttttggagaagtatgagaagcaaggtggtgagaggaatcacgacaaatggaaaagaccaagatcaccttctaaggggcgatttggtcattcactaagacggttgcgttcacctccatactttcatccacaagacatgtcattgggttcttatccaatgccgccgccgggttattcttatccttacttcatgtcatggggggcaacgccgccaatgtacaaccatatgcctccaatgcaattcaaccaagggtggggacgaccacggaggccaatccatgagcgcttatcttcaccaaacaaaagccaattttatggtaaaaatcgggttaatgaagaaaagagggaaggaaagcgcaccaaggtggaggaaaggacttcggaggtgattactatcaaaataggatcccatgatgtgcctataccttctggagatggagttgaaaagtccccaaacaaaaaatccgaagccggtaccagctcatcgcagtcggccggtctgaccacggccatgtagccggtctgaccgggcaatcaggccggtctgaccgccgactagacagcggtccgaccgaggcttcaggccggtctgaccggcgcgtctggccggtctgaccggtggtctacgaccggtctgaccggtggtctacgaccggtctgactgggctccagcgccggtttgatgagagggctacaaagggcgatgtgagggtttcatcgtcttcgagcaaggttaatagaggacattatttacctcctggaacagagccaaatcctaggtggatgcctaaagatttaacggctacacaaaagagaaggttgcaacgtcttcggacccaagaactaagagagaaaaaggcgaaagaacaaagggataaaaagttcaatgagttgcgaccaccaccggtatggaggcctaagtccatagagaaggcaaaaccgattgatgttgaggagaaggaagaacaatcggttgacgaaggaaaatcgtctccataggaagaca

SEQ ID NO: 50941 - DNA, 1012 bp, Oryza sativa
gtgcctatgggcgccgccggctaccataggggcgcgggcgcgccacctcccgccggtcgtaccgtcgagggcgtctttaagcacgcctagcggctgccgcgtggggcccggccgtcagccgcccgcgccctcgggtgcggctgacgcgtggggcccacggcgccggccggtgtaagccgggtgcacccggtccaccgtgggccgtgagactgccgcgtgggtcccactcccgtggacccggtccgcgcgccccctcccccggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaagttattttgatttaaattattgcattgtcgctttacttaaattcccgcattatcactgttttatttagccatgcctacttacctttgttatgaccttattattgctattgttattatttccttgttcaccctagaataaacaaaaccccaactagtggacactctactcatggtaccactagtatgattttaggtagatgcttcgctaattaattaggcaacattaggtggttttacaactctagactttgggaatattcatatcacctggacactatggaatggttggattattgtggaattggattcacacctcccactctattcaaaatcctcaaaatggttttaggctgggctcggggtgcatggttttgatagtagcacctcggccatataaggaccggt

SEQ ID NO: 50942 - DNA, 195 bp, Oryza sativa
gccctgcaaattttgaatatgatatactattttagtaatacgtgtggtatactaatgtacacaaataataagaggcatgagtagtgatttgataagtaccacttcatcaaggcgaagcggaagagagtggatgggacgaggagctcccccgtgctaggccgccgccaccgccgtgcccccgcgggtggccgacga

SEQ ID NO: 50943 - DNA, 180 bp, Oryza sativa
actgggatatcaatcaggtgcgtagttgatcagtgattatactgggaggtgtaacggatattcattcagttttatatatcctggatcagttgttgtccttgatctcttaacatgtaatttgcgttaatcttttgtccttgtggactaacatgtacccattcactatagcagggtcggcga

SEQ ID NO: 50944 - DNA, 185 bp, Oryza sativa
gtctctagctgctccccgacggcgaggcaaggctcgtccggtcgtgcttccaccgccaacggctttgccgcgctgtgcagcacctcggccgcctcctcgccttcgacatccatcgccggagtccgcttttgccgccgcctcgtgcctctccttcctcgtctaatccctccattctctttattaga

SEQ ID NO: 50945 - DNA, 1501 bp, Oryza sativa
aacaagaaaccaaccacgagcagtcaaaaaagacacaccgatttgaattcaaacccaaatcctccgatttcttcgttgtctcgctagtagcaagcagcaggagcaattaatggcggggagcagagcgagcagagatgtcaacacatcgccgcaacgccattaacaaacccaagggagcaaacaaacaaattaaacaaccaagtgacgagaaatggaaaaacaaaaaccaaaggaatttcctcgggcggtgttccagtgaaagaaaaaaacaatggagaaaggcgaccacgaagacaatcatggcctctcctcccgctgccgcccttactgccatacatacaaaacacatatactactactatattacctccatctcatgacgttggtcgtcaaacaaaaagaaatggaggaggaggaggaggaggctgccaataaaatcttgcaggttcaaatcatgccaggtgacagcgaagacagattatactggaagcacagtaggattggtgactgcaacacaaagagtgcttataaggaattcatgaagagagataaccctatcacccaccaggtaagtaggcaggttattgctgtgattaaacaaatttggaaacacaagataatccctccaaaagtaaaaatttttgcttggaggctcatcagggaagcacttcccagagctggcagactccgtcacaggatcaatgacatttctgaaaattgttgcagatgtggacaggttgaaactggtttgaatgatatctgacctgaattgctttattgatagatttcctgataatgcaccgatggctcacatcatttctttcatgataaataatggcaatggcaatataggtctttgcaggattctagcccttatgtggcatatctggaaagccaggaatgacttcaaatttcaagcaaaattcagagagccctctcaagtgtgtttttaagctgaggctatggcgaatagctaccacaaatttctatctaatgattgtttacaggatgaagagcccccaggagaacagagcaggaaaaaagagccaattccacaagggaatggatgctgcattgatgctgcttggggagagggtttgacaggagttggtgttttctttcatatgccaactaatcataatgcaatctttattaaggccttcagcacttctgctagctcgcccttgcaagctgaattaatagctttacagtttgctttggaggtagcaaaatgtcttgactttgcaggtacggttttcctcatggacaatgcaacgattgcagataccatcaagaagaaggatttcgaaccagactcaggacattggagcctacgaccgttatggtcccaaatgataattgactttccacaggattttatgaaggtttactggattccaagagagattaacaaaatgcttgacaaattaacaaaagaagctagacttttagaaagggcaaatccgatctttgattgccaaaacatttctcaccttgctta

SEQ ID NO: 50946 - DNA, 1501 bp, Oryza sativa
tgttgaggattaaacacatgatctcagagttaaaaccatataccctttacctttgaactatccagtgtatatcagactagctaccaatcgattgtacaattagctatacgtgtcttcgatcaagagaggaaacttaactcatgagcaatatgactatgctatgtactattttgctaaccaactttagtagtacaagtatgggacaacatatatatatgtacgctgtaccattttcttttgcgatagtacgtgccatgtatattaagagatatattgtgttagtagatctcttggtagactaagttttttgtcatattattttcagcttattcattggattattgaaatagattatttgctacacacattgaaaaatatttttcttaaattcttctattgcattaattagttagaccacttattttgaactatctattaagtttatttattaaattatttaatttatccatatacacgtaaataatccataacaatcatacgttcaataatgtaaatcaacattgcctaaataaaatattattccatgatacattcctctaaccacatgagcaagtagttataatcatattcatttcctacaacctagtctattaatagaataatatgtacaagttatattttaataataaaaggttttcaatccataatttccaaactgatttctctaccatctagttttactttgcagaatgttaccgagcctactttcattgttaactttattgtatcagcaatcaagttatcaagacaacatgctcttttgtgaatgaagctactggcgatggctttatcaaagtctcatcggatggctgtttgggttgaagttttacagccaaagtccatcgtctcgcttattgggctgagagctttcagccgaacataggtagggcctgcaagggagttggagaaaaaaaatcctcatcaagccatttaagtcaaataagccaatcaacggattttctttagttgaattgaagaagccaactttaactaattagccaaagcttttggcttaccgatgaggacctcaatgtactacaagtatacaacactaatatcatgtattcagagtctgttcgaaagaacaaaaaaacgaaattaaggagattactggaacccaactagtagtaataatcaaaatagtcacagatgatccggaaggacacaacgtgtagaccgtccgtgccaaccagttcctcctcctatgacccgcttggcgcgcactacccgtctagtcgaggtgggtcccaccgtcccacggagccactgacaggtcggccccacacctaccctggcccaccaaccgtcgcctcctcccctcccgctgccgcacgcaacgagcctttttcctcctcctcctcctcctcctcctctgcagcttgccttggactccaccatttcaaatcccctgcctcctccgcctccgcttcccccctcaccttctccggcgatcgccgccgcgtccgtacacggctgaggc

SEQ ID NO: 50947 - DNA, 197 bp, Oryza sativa
gaccgcgcgcccgaccgcgtggggcccacgcgccaggcgcgttgtttttctcccgcccggcttctttctctcccgtgcgaaccctagcttggtcccttctccaaatgcgcttgattcaattggccaattccaaaattaattggggggttttaatccccattggatcctcttcaattggccccaaattcccccttgat

SEQ ID NO: 50948 - DNA, 439 bp, Oryza sativa
aggtggaacagtgccgcaaacgccactgtttggccggcgaggacgcgtctccggtgcttcccgcgaaacgagggctgactgaggaataggaggtgctgcaagcccaaggagaagacggcgcgcccgaacggcgctccgccgagtaggaaaagccggctgagccggccggcgcggagaaaaaataaggccgatgccggaaacgcgcctccgccggtcaccgcgcaaaacgaaggcaagcccggggtgaagaagttgacgacgacgctgaagaagccgacggcgcgaccgcccggcgcacgttcaagcggcacaagtcgtctgaagcggcccgccggcgtggaatatagagaaggccgcggggaaaaggcctagggaccacgggaaggctcgggatggggttaaaacgatagaccggagtgaggggatcccattttatagg

SEQ ID NO: 50949 - DNA, 1501 bp, Oryza sativa
ttgtagattgggaaggccagagaaacttccaggaattgatccatttagaagattgtgggaaagatctctgcacaaattgtacgagcatgcatataaatgatagcttgtttgccaaatacttagtaaaatagaataaacaaaaatgacaagttgttagtaagggctctatttttatacattgtggttatgttgcttgctggtcggccagatggtattgaaccccttaactgattccaactaagatccctgaacacaaataagacaaggatcaaagctgccacacatgatataatttttgctaactacgaatatggtaattttctgttcccaaaaaggtgaagttgcagtgttggaattcgacacatacagatagccaagttggggtattccactgacatcaggaacaggtccttccaagctgcagttcctcaaactcctgatgaagatcatatccaatagattagtctctaactttcataattacttcctatcttaatttcattgaatgacctccttcggtcattccggcaaaaaaaactttcataattacagagagagtagaagtctgaattaaacctgtattcttgaaatgcaactttaccacttgatttgcaaagcattcaaaatgcaacctttctaagatgccagccatttgtgaacaagggaagctatttttggatgtgtctatcgagcaggttcccatggataattataatatcaagtaatgatagtgacttggatgcatttctaaaataagtaaaaacatgctaacatggtcatacttttgcacagcagagctggcctttgtgtagattgaaatggcaaaaaaaaaacatatacttaaacacctttctactgccataatatgcacactgatacaggtttgcttctgcaaatatgttttgttatgaataagccaggtcaaccaatgttagccaaaccattacctaaaaatattcaagagaaaaaaaaaggcgaatattagggaatgatctaatatcaaataaatagaaggggtgagacccggctagcccaccaccttgtggagctagccggaagacccctgggcggttctcctaaaaatattcaagagaccagacaatgcgtaaacatccaagattgacatcaaagttcatctcagcactatgctcagaatgtggaatcgcagacataggtaaagcgtactttcagaagtatagtaatttctcttagataatagaagatttattgaactcggtcaattacatgatacgattacactgagaacactcagcctctgcatgactaggatccacacagccaagaagtaactacactgagaggtggaattgcagatagaggtaagaaaatacttacagtttcagaagtgtggtgatattgccataagatgaaggaattgaggttcctgagaaattattgttgtcaagctggctgaaattattttgaacagatattattagagagtgctgtatatgtgtgtaattctaatatcagagactat

SEQ ID NO: 50950 - DNA, 1501 bp, Oryza sativa
agagtggattccttttttcatgtgaaaacatgggcaaggaatagtgttcctctggaattgaaggtagccaattcttcgaaatgaatgcatctgcagtacctaattcaaagaaatcatcaatcctctatttttcgtacacatttcctccattctgaacgagccctgatcactaggggtgctcctggcgtggtggtttcctgcatgagatgcaatcatttaactacacatcacgatccagcagttatggtcaccaagcgaaacgacatatctacgagctaaaaataaattatgaataaaacacacacatatatatatatatatatattaataatttaaaagtaaaggctgaaaaataattttggacgaaagaacaatataatcaactcaaatttaagggggaggaaagatgaggccgcaatagttagttgtagatgatttttgttcgccttcagtcatataagcgcccgtggcctaatggataaggcgtctgacttctaatcaggcgattgtgggttcgagtcccaccgggcgtgttttttatttcttttttttttaaatcgagggcgtgtattttttgtgggtttgaatgttttttatttctttttttttaaatcgaggtgttttttatttctttttttttcaaatcgagggcgtgtattttttgtgggtttgatactaatattctctactttttttttgtgctcccgaaacatcatcattacttagtagtaccatctagcaaaaaaagagaatgtaattaaagatgacggtaggggcgggttgagtgtaccacaaaaaaagcgaatttcttgaactacttttttcgggtaagaagattaatacgatgacacgacgagtgtgtcgtctttgccatcatcttgcgacgtgcggcgtcgtctaatatgtcatcatcgctctcgtgatggttgctttcacgcaatgttcacctaggagtatctcaatcaaactaatttagcaacatctaaaatattaaattaattttattaatctaaaattgaaaatatttgttttgtattaaattacaattacatttttacatgaatttaattaaaattaaagatgtttaactaacaaaaatatagatttataaacaagggagtactccctccgaaaaaaaaaactaggttttcgtgtccaacgtttgactgtccatcttatatgaaaattttttataattaatattttcattgttgttagatgataaaacatgattaatactttatacattacttatcttgttaatttttttaaatataacggacggttagaaacctagggtttatgggacggagggaggagtaccacataagcagccttgttcgttgaccattcgctaatccagctcctctctctctctccagttcagactccagccctcgtgggttccttccaccacttaattttcagaatataacacccaatacgcactacttctaggatttatcacccaattcgcactgctttcagaatacaccactgg

SEQ ID NO: 50951 - DNA, 1501 bp, Oryza sativa
tcaatgaatttgcgtgcgctgctgaggtcagagggagacagattggttgatggatggatggatggagaggggcgttgccaagtccaccatcaccaaaccccgaatttactacgacattttccatcaccttttcaatgttcttgtcatcactgctcgtgtcacccgtgggccgtggcgaaaagcagaaattattcaggatttgggatttgagatttaagagtttgcgttgtggcagctggtaggaaactggaagaggtcaatcgattcagttcgatgtagtgtactacttccccctatccctttcctacctcttcatggctttatttataatattatactgtactttgctcgctcattttcacacccaagcggccaagcccaacttaatccccattatatagttaatattcggttgattattatctctgcttgactaatactactcaggttgtccttttctacaacaatcctccattggtgtggcggatcgattgattctttctttctgctgcctcctaccagctggtgagttcatccttctttctctctttagttttctgctgagtggtatgcttgttgtatctatcgattccttccctgcatcggtgtttcaatcgacgttatgcacacatgttctttttccataataaacaagatagtacagcaggctttcttcaattctcccttcattcatggtatgatatgctatcgcagcatgattgcaagggattcatcagcaaacacgtacttcgttgaaattttagctttcatctcataacatctcttctttattgatctctaattgaaaaggttgaaatttatgttttattggtgttggtggtcggcagtcgcttctcagctgctgtttaaaaataataagaaaaaaaagatgctcctctgagttttcaaaaattcctagctacactggtgaaaatttatgcttaactttttttttacaactttactttgctcaaaatttaagcagtaatctggtgcatccctgactttatatggtcctctgtgcacttttgggtctggacaagtaaccgttgcccctttgttccatttcagggactggattatgctatcaaagggaaactacatcggtgaattctcaatatcctgccaaactgagcaaattttctgtgtagtagcatcatgcggcagtctcgactcttctatctttgctccattatcttcatgttctactgggtgcaaagaacagaagcacagatcactgcaccttgggaaggtaatatccatcattctagccatactttacctccctcctcttattgagactgatctctacagtctacatgcacatatctctttcaatctttgtgtcataagcgtggcctgctcacttgagacgcataggagagcacaagccatggttctaaatatattagttgttatggttacgttattgagtgttattgatttttaccttgcattatgaagctaactaggtgtaacatcggtacatttggtctgcagt

SEQ ID NO: 50952 - DNA, 1501 bp, Oryza sativa
tgaaaatttgaacttgacaaagtgtttatgaaccgtgatattatccttatgatacaaagtggaaagtggtactattagctgctaaaattttaaatttttatctattgttttagaaagaaattggaaactcggtttccaataaatattcatcattgttttcacattcaataatattctattctgttttgatattcgaggttttctattcatattttttaataaaaaaatgtaaacgaaaatgatagatatggttcccgtcttttttgagtcgttttcattcctacttgtatgttcatatcaaataaataccacacagtcttttcttgtcaaaaaagaagtcacaccaacttgccaaaatgtgtgttagctaaggtgtggcgatcattaaaagacgcgcaagaatatgttgaccacatattaagtcaaggtgacaagaaaaatagagagtatcacgtgtggagtccgctgcaaaaatgtggcatgatatatacacttgtgacagcgaaacaaacaacagttttaaaagttttaaaaggtttgacagtgtttggcaaagtactcactcaaataaacaccctctttaattaggagggcaattttactaattttgaatcttgagacgttaagatatatagatacaacctcatattttatcaatttttaacattggaaatgttaaatattgataaaactaaaactgttactacaagccgactggcaatttgtgcttgatatttctaaattcaaatttatttggttaggaattccgcgccagagtacaacgaccttatctttgttaattactccctctgtcccataattacatatcgtctgtccaaatttattatactaaaatatgttacatccacccattatcccttatattatgggacggagagagtatatgagttctcatcattttacaaggtgctaattattaatttattttttgtatattattgaagtaaaaataattagactcaaaactgattacaacttggaatttattaatttgaattttagaacaacacaataaactataaaaaaatatatttgagacttcaaaccgagcacctctttcacttagtaaaaacattaagtaggggtacttttctagtgacgatttttaaagtgtttataaaattgagaatttctatactctagtacttttagcatgaccaatagtatctctaaatgagatccaattctaaaattaagatttattttgtgaaagacttgctctaacagcttccctatataagttttcgaaaattggaatctccttctcctcctttcttgctctccataagtcgagagtcgctctcactctcaatttccgcacggaaaaaggaagggcgccacgtgcattagaagatatgctatcacactaagctattgaaataaagcgtggaagaattgaaaaaagtaaaaaaaaatgcatgctgtcagggttactgataaggtataccctctatccttggatgtacgctgggtactaata

SEQ ID NO: 50953 - DNA, 1501 bp, Oryza sativa
aggacaggtagccatattacaatagtaacacaatgttccctttgttaaaaaggttgatttgctaagatccttatagcctagactgaggacataccacgttggaaactatccttgtactatgagttccaaaaatgtatgtatgtaagcatttcatccactatacatgccatatcataattttctaagaaaaatccgtggatttgacatgcacttatacaagtcttatgaaacatggttcaattgcttgcttcatgttgtatggggtatatgattgcagattttaactaactatgccacaaggaatcaatgaccacatatttttagcatatgatcttttactacctaactttgcttttgtaaccaagatacaggaatcataaagaaagtacaatttggtctaatggaaggatatggtagtacacaaatgaagaaatctagtaagtgaaaaattgcaatggagctcagtgttagacctgccacgcaatccgatcaatgttaagcgtaaggaggagggtgcgcgcaccaagacgagccgacgcaagcgcggcctcacatccggcatggcctcctccaaccacaatcacatcgtatcgctcctcaagacttgtcgagactaatgccagaatagcagaaacccatccatcaattagaatcgttttcgcttgtttcatgtggtcgcgaatactcagatccccatcgaccactacgaggtgagcagcgttacctttggaggaggaggaggaggaggcgacggcagtggagaggaggcggtggcggcgcggaggaggaggaggaggagggcgccaggacggcgagtggaggaagcgcctgaagggggagaaggggaggaaggatgcgaggctggcggccggctgcggcggcggacggaggcggagcagcatggccgccgatgaggtcgacgaaacggcggcggcggaatttttcgcggctcgctgtggctcaggatgaggctggaacggaaagtcgcaatcccattcttgggccgcacgtgaatgaaatccagatacggcccagaaaatatgggccaaatcgggtataacgtatcccacatctttgaaaaccggtgtaaagttcatgtgtataaaattggtatattcataccaaagttttatgtacaaagtttacatgtataaagtttcgtatatgaggttgtatgtataatttttttccagggcaaacaaagttctgtttgttgccaaaaaagaaaggcccataaacggtttaagaacaaatgcacaaggcactaaggcagacaacatttggaccggacgagcaccacacatatgcccgatgtgaggaggtcaaagccattcgtacgtctagctatcacaagagcaaagtagtatattgtacagggagtattatcgatcgtacaagtacaaacttgacaccatctacaaaactaatttttaacttataaacttctcatacactatatagagtttgtagcaacaaaattataacatatgaaaatatattg

SEQ ID NO: 50954 - DNA, 1501 bp, Oryza sativa
cgatgaggacctgcctgactttaccctggcctttgactgcatgctccatgatatatctagcttaggcctagtttagttggcaaaattttttattttaagatatccacgtttatatggacacatatttaaaatgttaaatgttgtctaataacaaaacaaattacagatttcatcttggaaactgcgagacgaatttattaagcctaattaattcgttgttagcaaatgtttactgtagcaccatattgtcaaatcatggtgtaattagacttaaaagatttgtctcgcaatttacacgtaatctgtataattgatttttttatctatatttaatattttatgtatgtgtttaaacgtttaatgtgagaaggtgaaaagttttattttgagaactaaacagagccttagccggttcttccattctgcgggagaggagtacgcatgcattatactgatcagctttacgggatagtacattttactttgttcagatcgtgtgtatggctgtacatgtacagtaaggaaccagtagagaacatatgcacttggctgataagcaaactgctctaactcgaagctttggcttctctgccgcaggcgtgacactcgccgctcgatcgatatctctcgatgtatcgagcgccttcgtgtacagcttaattttaacagctgtaaatatatgcctggaccaggcacatcttttactggggtctcctgctacagagtaaaaccttttttctcctctgcaaatctctgcaaccacatcatggacaaaagcttctctctctctgatttttgtgtgtctcaggtgggagaaattggacattgtgccattcccaataagtggtttcgctggaatgccactccgctgaatcgattcgctaaaaaatcatccccaagcggtgcccaacattttctttgccacattcgccatttaatctcttttgctgctgttttcgcatttgggctgatgaaaatgcccttgtgctatgtttcttctatctgaggtgagagaaagcggattgagccgctattaggtctgagagagaaaggggatccccagatccagtcgctcctctgtcttggtcgtcgtcgccggcggtgccgtcgccatccaatggtgctagcgcgtgggaggtaggagcatagtggcattgatggattgcacctggcacgagttagtgtccgggtaagttcttctaccgatttgtggcttgcttttgtgattacgattggtttgaattagttagaggtgcgaatcagttagagagttctctaacattcgtccacatttgatttcttcaggctcgtggaggagcctgcgcttagcttaagtgtgttagaacccgatgttggtgttggcggcggcagtggtggtggtggtggtggtggtgaaggtgataatggtggtgttttctttgtttctcctgctggggtcgtggaacaagttggggaactagctaggtctcctgttcttgatgtcccatatgttgctattgac

SEQ ID NO: 50955 - DNA, 1501 bp, Oryza sativa
ggaaacagtcttgacgacaaggacgtattcgatgtgagcaaaacaatgggtgccgaatccctggaaacagtcttgacgacagggacgtacccggaataaagagaaaaatatgagcaataaggctcaagaaaagaaaaagaaaaaaaattctctttgttgttttgtgctaaaggttatttgagaaagagtgataaatgcaataggtatatgtgtttagtgtttatttttcaacctatgtgcttgttaagatgttgcattagaaatcgtatgaaatcatgaattttgcttgttgattcaagcttaattgtaaaatctttggttcatggttatactttaatgcatgcttgttctgttatagatgggttcatcttctttttattgcaacacataacttgatatgctatatgtatgctaagttcttatacattaatgaacataattcctatgcttgatgaaatcattgttaaaagggggagaagtaatatgaaaatttttggttcaattgggaatttctttcttttaaaaagggggagaagttttcttttggatttttgagcacgatgtgtacttttgtacgaagtgtgctttttaccgcttttgtttttatttttccaaacaccaaaacatttttgatgaggtttgccaatgtgttcatcaagggagagattgtaagatcaatgtgtgttttgattcttattctgtgataaacaattggtatccgtgattattggttttgatatttggagattatcgttgaagtggttttggagataatcaattttcaggtgatgatcggattcactgttattttatgtgaccagtccgaccgggtggaggttgccggtcagaccggtgctatgtgtgcggtcagaccggccagcccgcggtctgaccggccgacactgtgtcggtttcggtttcgagttgtttctttggatatccgtgattgtttcatggttatggcttctagatgaatactatacgtatgtaatactgttgtttgctactaatgagtcaagttggagatagcttggtctcggaatatggtttctttgtttgtttcatgtgtaggtgactcgatgcctcgggagagtatttgcggtgatggatcgggagtcggcttggtggtaagacgatgtccgtggtggtcagatatcatgaaggatactaaggctagagttgatgcacgtggttggtgaagattccatatggcatacaatggtggtattgtttttgtgtgtatgggatgcgaagtagaatttggaaggagttcaaatttggtacgattggttatgtaaagtttctttcttatattagagggtttcctaaggtgtttaggactcttagtatgagtttggttcgtggctttaggctgcctacctcatgtataaatagagggggagcgtgagtcttccaagtattgctttgtatcgcttttgtatagcttttgagagctagtttagttagggtttcgagtttggtcgagatttttgtaaggagt

SEQ ID NO: 50956 - DNA, 211 bp, Oryza sativa
ggtttcggcctagttcccaagtcgcgcctgtgatgattggttcaagtcctggcttccgctttccttttgtaatgcagttgtgagctcgggatctgtccgcagcccaacatgactgtacttctactctataataaagagacctctgttgctgtgatactctgtctccctgtaataccagcactgtttcctaggactggtatcgattaacagg

SEQ ID NO: 50957 - DNA, 1501 bp, Oryza sativa
attcctgaaaggaacttcacttcccctccaaacatgattgttattcgctcctttgatgtcaacaagcctggttcagaggttgatgaaattaggggtggtgtagctggtggcagcattctcagagtatgtgttctctcctgtaacataattaaatattttaatcagtagttttttatgttaagtatgagctgaatggtaatgcttcgttccagggagttttgagggttaaccagaacattgaagttcgcccgggaattgtaatgaaggatgagagcggcaacatcaaatgcaccccaatctattcgaggatcgtttcactctatgctgaacagaatgaactccaatttgctgtgccaggaggtcttattggtgttggaacaaccatggatccaactttgacacgtgccgatagactggttgggcaggttctgggtgaagttggatcccttcctgatgtctatgtggagcttgaggtttgccataactcatttgtttcttcagggttttagtgaacgaatgtcattacttacatctgaacctttcacacagatcaacttcttccttcttcggaggctattaggtgtgaggacaaaaggcacagagaaggctgggaaggtctccaagctcaccaagggtgaaatcctcatgcttaacatcggatctatgtcgactggtgctcgcgtggttgctgtcaagaacgatctcgccaagcttcagctcactgcccctgtctgcacaagcaaaggtgagaaggttgccctcagccgccgtgtcgagaagcattggcgcctcatcggatggggccagatccaggctggcacgacgctcgaagttccaccatgcccgctctgaattgtgtttctccaggcagaaatcctaatctttgagagaagatagaagagatgtggaagggcagagagctcctaggcactatttttgtgaggtggatgagaaaacatgaatttgatttggaagccatgtcattgcgtgctatcgaattcagctatgctacaaaagttttgcttacatctgcattctgaattatggagaatcgttttttcaccatgttataatgaatttgaagtggggagaaacctactaattgatcagaattgcattattgcatttctcactgaatccaatcagtgatgtattattgcattgaacatgttgcaagaaaggaacatatcgctctggattttctttttctatcttctcctcccttaaaccagttgtgacttgcgacgcaaagaatctccatacgaacatgactatttactagcatatcatcaaaagtttcaaaatataaaccacagtaaccagctaaagaatacacaagaatgtaacctttgcacaggtatcttctacagtagcagtcaggagaaacagttgttcgattcaggatgagcccccatttctatacgcaaccttacttaggctaggcactggaatatcaaaagctatcaaacaattgagatttttgaggcagttgaaaaactaa

SEQ ID NO: 50958 - DNA, 1501 bp, Oryza sativa
gcagcgtagagggcgtctcaggccgccgcgtcaccgtttcccgtcgactcgtcagtcgttgttggtattgctattgctgcgatcctatcctcctatccattgcgaccgatgatgcactttctttatggcttcttctctatcctgccctgcatccgatgtggacaagatcctccttttttttctttctttcttgcaaatctgtcgactcacagtgacacggcccattctgtcttctcaacgtctgaaccacctcacagttggtacaatgtacgatctccgtccaaaggtttagaactgtttaaatttcaactttttttctttaaattttaagagctcctttgaatcgtatgaatgagaaaacaatggaatagaaaaaaagataggaatagaaaaaagataggattttgataggaatgtaagtgtaaaacagagattgcaaaacacaggaaaaacacatgaatggccgtttgattggaccgcaggaaaaacataaaaattagaggagagataaagattcaaaggaaagttttcatgaggttgtacctcatgttagaattcctccaaaacttgcatggcattaggcattccatatgaatttcataggattccataagatcaatttctttgattcaaaggactatataggaaaaattcctataggaatgaaatcctctaaaattcctatgaatttcctttgaatcaaaggggtctaaactttttcgttacattgaactttcctacatatcccctccatcacataaaaaacctaatcctaccaacgaacctagacacattcatagccaggattggcttttttatgggacatagtagtacacaaacttccaacttttccatcaaatcgttccaatttctttaaactttcaattttagcgtggaactaaacacaaccttactatctactaatagaggatgtgatattttttacttgtccaaaatctacagtactaaaaaaatatttcagtatgtattctagcaacattttagatcgaagttgatagtaatgctaagtgaaaacggacgggtacatcggattatggcatttttatatcctaacatatatttttttttaaatttgaagttggatacgggtaatgtcggataatatatcactcatcatgtatcctgtcaaattatttcctatgaatcagattcagtaatggatatctatttgcatctctaattcatatatattaaatataagaggcaattaaagtgttaaagagatacatcgagaaaaaaattatacaatattacatatgaactcgtaaaatagtgattaactaatcttttatcatatttataggtgaatttttaatagattttatatgttttatattatgggacatatggacggatataagtctttctgtatcttaacatatatttttttttacggattcgaattcgaactagatagtatcatgtatcaatatttttctctttcatattcttcatacgagcctcgggttgtacggacagg

SEQ ID NO: 50959 - DNA, 1501 bp, Oryza sativa
aaatgtgggccccatgtcggtgggttccactatttttttttgtgtgtgaatgatatgttggtcccacaattttttttactctaatgccacgtaagcgacacgttgaggacacgcaggacgaagactgggtcaacaccgccacgtggacgttatgtcagcctaaaccgcttccaaaaccacccagggatatagtttgcaacagtcttttaatagttggaggagtcgatatacccggttttgtggttggaggtcatgaatcatactcaggtcacagttgagggagtcaaagtatactttttccgagcaatctcgataggatttgccaaaaactaatgggctaccattcatagcgctgggccgaattccgagcccatgggaaagacgcgaaggatatggggtacgtatcaggtgtccctctgttgggcgctgtagcaattagtgcgaaaaaaatgtacccaggtcctgatgaccgtacagaatacaagaagcgctacatccacctgggaagctacacatatccgagcgtccgcgaatatatttctcggtttcttcggctttcttccccaagtccggctcgagtttcatctctcgacctcgccgtgctcgtgctgttgtgcagcggtgcaggtgctctcttccacttcctccctccctcccttcctccctccatggctccatctccactggcgtttccgccgcaactaaccaaccccttcgatccgattgcaggcgttcgatcggtgacgagacgatcggagacgcgccgatgccgccggtgcctgtggagcacgaggtgggcgcgagggtagagtgcccggaccctgattcaaaatgtatatgtccttctcttcgatctctctcgtttggctatttcttggctgctcgtggttgtgtatgcgcgcgtgccttctgctttcccccctgtttgcatttggtatacatgttcgattcaaagagagagagagaagctcaacctgaaatttttttttttcagatggagtaaacatggtgagagaccggcttaaagacagaactgatattctgttcaaagtaaggatattggtttgattgattgcactagtttgatttaccacccggccgtatactcatttttttggttttgttttgaagctgaatagtgtggtctggatttcacccagtagcacgtcacttcatgagcttttaggtatgaagatatctatacttgtttttaacttcttttttcgaggggactactttatttttttaacttcatgatccattatatatgacgcactaacattatttttcaaaaaaaattggaggaggagttgcgtccgatttcacagatggacatgccagcaggtgtgttccgcttcctttgttgtatttagaatatgtggcccattataaaatttgctcttttttccccatgaatgtgtatccataattgctgattgatgtatttagaatatgtgttttatagtttttctggcaggttacaaaagacagagttggctca

SEQ ID NO: 50960 - DNA, 1501 bp, Oryza sativa
ccaacatcgggttctaacacacttaagctaagcgcaggctcctccacgagcctgaagaaatcaaatgtggacgaatgttagagaactctctaactgattcgcacctctaactaattcaaaccaatcgtaatcacaaaagcaagccacaaatcggtagaagaacttacccggacactaactcgtgccaggtgcaatccatcaatgccactatgctcctacctcccacgcgctagcaccattggatggcgacggcaccgccggcgacgacgaccaagacagaggagcgactggatctggggatcccctttctctctcagacctaatagcggctcaatccgctttctctcacctcagatagaagaaacatagcacaagggcattttcatcagcccaaatgcgaaaacagcagcaaaagagattaaatggcgaatgtggcaaagaaaatgttgggcaccgcttggggatgattttttagcgaatcgattcagcggagtggcattccagcgaaaccacttattgggaatggcacaatgtccaatttctcccacctgagacacacaaaaatcagagagagagaagcttttgtccatgatgtggttgcagagatttgcagaggagaaaaaaggttttactctgtagcaggagaccccagtaaaagatgtgcctggtccaggcatatatttacagctgttaaaattaagctgtacacgaaggcgctcgatacatcgagagatatcgatcgagcggcgagtgtcacgcctgcggcagagaagccaaagcttcgagttagagcagtttgcttatcagccaagtgcatatgttctctactggttccttactgtacatgtacagccatacacacgatctgaacaaagtaaaatgtactatcccgtaaagctgatcagtataatgcatgcgtactcctctcccgcagaatggaagaaccggctaaggctctgtttagttctcaaaataaaacttttcaccttctcacattaaacgtttaaacacatacataaaatattaaatatagataaaaaaatcaattatacagattacgtgtaaattgcgagacaaatcttttaagtctaattacaccatgatttgacaatatggtgctacagtaaacatttgctaacaacgaattaattaggcttaataaattcgtctcgcagtttccaagatgaaatctgtaatttgttttgttattagacaacatttaacattttaaatatgtgtccatataaacgtggatatcttaaaataaaaaattttgccaactaaactaggcctaagctagatatatcatggagcatgcagtcaaaggccagggtaaagtcaggcaggtcctcatcgtccgagaagcctcgatctacatctcctccggtcctgcaggctgcagctcaggtcaagatcgacctgcaaaccgccaagaggtgaaaccaatcaaaccatcccattcccatttgccagttgccacaagcgcccatggcaagtacca

SEQ ID NO: 50961 - DNA, 1501 bp, Oryza sativa
tcctacacttttgcagggaccatgctcaaaaagtagtactcaggacaatatggatttcaacaaagatgagtactgcaaaaatcaaaggagggagttgtagtcatctttaattcattggtcttttgtttttacttgaacgactagaggggaggcccctgcagcatcgttgttggtttgttttaatagaggaatgaatattgattcatcttctaagtttgttatcagttatgtgcttaagaagagtttcccaattgagagcactatgtcaacccctatgctgacaaatgaagaggttagtacatactggactactattttatatcacttaaatatttttcaatctaactaacaaactaatccaaaaccttccaagaacaaagttctactccatctttcaccgcctatgacatgtacaagtatcctcaggtttgttggtctctcatattttctattcatatctccatctaagactacatactatctcaggtttgttgttctctcatattttctattcatatctccatctaagactacatactatctgctaatgtcaaatcaatttcagcgcaactgttgacaaaacaggaacatccaaagacggtacagctggtaacatatcaactgaaaaaaggtgaaagatatttcacttccatgcttaatcaaatacatgaatataatcctaaaatatatttacagcagctgaactacaaagaaaagcatcgattttagtgaagattccactgaggaaactagaaagtatactgtattttataacaccatgtatatactgcgtataccatttctcatcattttaatattttgtgacaaacaaatatccgctcaaaccctcccttactgtacttctttcccttttcagtaacaaagaactttgattaaccccatcctcaaaagtcagaaggaagagtatgtactacgttgaacatcccccagaataacaaaatttaactaaaatactaattgcaatatgttatgaaccatttcataaagcatagtcctccagtcagcagtgccgaatgacctggctcacaaaaagggtaattcttcttcacaaaaccaatgtctaattaactacattaccatgcaagcaaatccaattgtttaatactaatactaattcatcttcgaaccaaattttaccggtcaacccatcctcctcgagctaaagaccacatatgatttgatataataacatcctttgattgttccaagttatttgttattttgtcaaacatgttctgttatcatcattgtcatgcctctacttttcgaaactaacatgtaagacatcacgtaccaaaaatgtcattaaaaaaccggtttgcatgttcaataaaaaatggatttacacagaaatgctacttaactttgaaatatttctacttgcatacaaactattattcttacggtagttctaaaagtttccgcagcaacgcgcggggtatcatccagtaacagtttgtttgttcacccaaaagcccca

SEQ ID NO: 50962 - DNA, 1501 bp, Oryza sativa
ggaaaaataaaaacaaaagcggtaaaaagcacacttcgtacaaaagtacacatcgtgctcaaaaatccaaaagaaaacttctccccctttttaaaagaaagaaattcccaattgaaccaaaaattttcatattacttctcccccttttaacaatgatttcatcaagcataggaattatgttcattaatgtataagaacttagcatacatatagcatatcaagttatgtgttgcaataaaaagaagatgaacccatctataacagaacaagcatgcattaaagtataaccatgaaccaaagattttacaattaagcttgaatcaacaagcaaaattcatgatttcatacgatttctaatgcaacatcttaacaagcacataggttgaaaaataaacactaaacacatatacctattgcatttatcactctttctcaaataacctttagcacaaaacaacaaagagaattttttttctttttcttttcttgagccttattgctcatatttttctctttattccgggtacgtccctgtcgtcaagactgtttccagggattcggcacccattgttttgctcacatcgaatacgtccttgtcgtcaagactgtttccaacgattcggtattcatattttttttcatatttttttctttttcataatgagcaattaaagctatttgagaaataacaaatcaataaatcatatatataaagcatttatagatcaaaccatatgctagcatcaacattgcatatttgctcaattcaagtagaatttaagtgtcatgcatcatctcccttaaaagcaaaatctaaatctcatgaaaagactagaatacatacaagctatgctagagacaaataaaccttcaaagtattgctagcatgcacaagaaaatactatatgtataaaacaaagctctcgttttgcaatttttttttcattgtcatattattgcttgataaaaccatgaggtacaaactccccctcaaaacatgccaaaaggattcacgaataagcattaactccccctcaatataatctccaattctccccgaacaaaaatcaagaagaaatcaaagattttgaaaaagacatccaattgccaatgatatcactaagattctcatgaattgacatgtatatacttgtattaacaaaaactactacctcaaacactagcattgaaaagctaataattaagaaagtagaacaaaaaatatgtcaatccaaaagtaaattgatgttaccttgaaaagcaatcatcatctcaacattgaacgctcatggggagtatgccgccaaaatacctacgaaagaggagatgtcgaggccttcgtgttggggttagaaataagaaattttggaatccaatactgagtcacacgaccagtagaaccagtaggtacatatgcacttacaaaatcagaatcagacttacctgataaattaccttcttgcttcacaaaagtctgagttgaatttcgcgcaaaattgcc

SEQ ID NO: 50963 - DNA, 1501 bp, Oryza sativa
tataatatgagcactgcatttatgtttctgttaatggttagctggttgatgcataatcttcgagttacacttggaattgctaagaaggatatatttttggttctagcagtgtaaagttcatatagcctgatgttctgcacttatctgataactgtacttaatttaccttcaggcagcaggatgaggaacttgatgagcttagcgaaagtgttcaaaggattggtggtgtagggctaaccatacacgaagagctgtctggacaggtattgcccttgtcacacggcaaattgatggagatgttgcctaatgagccaaaaaatgttcactacagggccattcagtctcttttttttttttggctgggagtgtagcactctaaaaagaacatgtcagctgaagtaactgggaacgtcttgcttttttacaggaaaggatcttaaacgacctaagcttggagatggaaactacttcaaacagacttgacttcgtgcaggttagttgcttcattataaagcatgacgccgtcgttgtttcttgtattcaagatagtttaaatttccacaagttatttgttgatgtgcactagatgcttatatttatgtttcagctagcaatttttattgctgaatcagttaacaagcctgtaccatgtcatacttatttgctgcattcaagttgtgtagaagttcctggaaattagagtagtgccctgaaattattttcctctcattgcctggtgcagaaaagagtggcgatggtcatgaaaaaggctggcataaaagggcagattatgctgatcctcttccttgtggttctgttcattatacttttcgtgttggtgttcttgacataacgcactagtgttccaagcctcgtgttttgcggctgtacctacctactgtaagctgtggagaacagaaaacaaatacacgagttgctcatatctttcaaatcctacctgattattgctccatctctattatgatctttttatttcatacgccctatttttttctccaacaaaagttggataaacttttaatactcgtggcacgcttttcaaactgctaaacggtatgtttcgtgcggtaactttctatatgaaagttgttctaaaatatcagattaatccatttttcaagtttgtaatattaaaaggtcacatgttattagcaccttgttttccgtgaaacatttaatctttatcttcattttcaggagattcgaaacactaccagtctacctgtgattaatatatctttcacataaataaacaaatgatcatgtcatgcaaaatcatgcgtataccatcacttgccctcatcactgaatttatttcactaagattgcatacaagcaaggccataagttgaaagcatacagctgctaatccactaatccaggctaactagtagtagtcccagagtattattttattatctagaaaacgaagctgtctgcaacctcgaggacggaccacgggaggtcgccggcggcgacg

SEQ ID NO: 50964 - DNA, 1501 bp, Oryza sativa
acttttccttttcaacgtttaattagtttttttttcttctcctttattcattccagatatatttgcccaaaaaaagcatctgaacagttggcaccgagaaacgatgttattagtaccaaattaaactagatggatgaagattaacatagaggagtagttctattttgaccaaatcaaatgtgatgcatatgtacccaataattagaaagtataatttgttgaatttatgtggtttaattttgtttttagaaagaacataaataaaaaaaagcaaacaagtgatcctaacatgtttgataaatatatacattcttttgctatggcaatgttataatatatttcttttaccaaaaaagcatggacattttgtattaaagaaaaaaaaggatagaaccctaagtgcacccacaaacattcataccaaaatatgttaaaatatttagttgattgaaataccaaaattaacataacaaataggattttaccaaagaaccagacagtaaaacagatttagaacttcctctctagaagagagtagtaacgaaatccaaaagaaaacaatggaatgaattcagaagtaataactaattaagagagttgcatagaaacccaagattgctcaaaacatgtatgcaaaaaaagtttttaatttacttatgtagtgatagtttgtatgaactaaaattctactccctccatcccaaaatataatcatttttggcatagtgcaaagtcaaacttttttaattttgactgttaataacaaaaaaaaaaattaacaagatcaacaatgtaaaattgatgttactagttttatcattaaacaagctatcataatatgcaacatttttttaaaaacattttacttttatagatattgttggtcaaagaagcatctcgaagactgtgtcgaagttcaaaaatgtttatattttgggacggatggagtaatagtatgcatgtgaagtgtcatcttaattagtaaagcaccagagctagctagctaagaaaagtattggttcaaatataatgcatacatatgtatgaaaatgcaagtatttgatggactcatgcatgcatgtgctcaaagactgtggactaattgaggtgctaacaagtttaaatcaacaaggtgtcaccctaccccttagcgtgttactattagtcagaagtagagacattggatggtgtgtttgtaaataacatctgggcaactaatttcttttatcacattgcataaaatttggagacaagtaatgaagtaaacacgatgtaccgaaatgttagaattaaggaaataatgccatgacaatataatgtctgtctcaaaagtaaattaaagaggaaggaaaatagaccaaatcatatacagactgcaggatgtaaatgctgatcgaagagggtcctttataagcatgcagtacacagattgggacttgtacacacagtggaagcaaaagaggaaacattgaacgggaaagcattattgattcaagaaaaa

SEQ ID NO: 50965 - DNA, 1501 bp, Oryza sativa; identical to SEQ ID NO: 43104

SEQ ID NO: 50966 - DNA, 1501 bp, Oryza sativa
  unsure (1)..(1501): unsure at all n locations
gatgcacatgccactgaagcgcccgtgaaacagccagacgtacgtgaagaaataaactagctggccatatagccttagtcggattgaacactcaaaggttgagttgagcgcaggtatagatcgatcgactaactgatcgacagcgaatgaaaccaaatcttattcttcttcttctggaggaactcaggcaattcagcgattgaattatcctggctttgtgaagaaagccaaagaaattaacagtcttaatccgaaccaaaccatatatacagtatagtataacattcatagtctatattacaataggagaatactccatataaccatcgatcgggtggtacacactgaacacacagtagcatacatacatacactagctaagctagctatctgcctagatgcgtctatgcatccattaacttcttattatatactcactccattctaaaatatacgaatctaaaaaacatcaattcagattcatagtattagattgcgtatgattcaacgttaagttgctatattttaagatggatgatcgaacgaactatcttgtactagtagtggtagtatatgggccgtaggtagctactggtagctggctggtggcctcctcctgctgttggtggtggtgcactgccggcggcgccatactggttcggcggccggatcatcctgtggacgatcttcacctttctggtggtggtcggtttggacataatgccatactttagcatctccttctccctctcgagcttctccacttcgggctcgcgcggccacctgcccttgctgccgtggtacccgccgatgtcgccgtacgccctcctgccgccgccgccgccgccgtgcccgtctctcctcactatgggttcgtcttcgtagtcgtcgttgtcatcgctggtgcgcagccgctcatctctttcaacgacgttctgttcgacgatctccggcacctgcaccttcgtctccaccacggatggcgtccgattgtccttcatccacacagtcatatcatacagatgagatcgatagatgaattttggttgaatttgatcgtgagatcgaattgaattacctaccgacgctacaatttngtcgtcctcctcctcctccttcattctctctatcatctcaagctgggcgggggtgggccacctggtcttggtgcgggcaagctcgtcctgcatcctcatggcgccgtgaccgtgacccttcctcctgcaatcatcgtagtcggtgcggacgtggatcgcctcgatcgaccttctcatcgatctttctctctcgatcgtgcaccactaacaaggtgtggtgtgctcttcagctttggttgatgtgagtgccggtggaggggactatatatttgtagcgtctcgcgagtgagactaaggtctttttctttcttctaatacagtctcagtttttgttagcacgtattttaaattgtgcatcatgcaaaaactttatatatatatatatatatatatatatatatata

SEQ ID NO: 50967 - DNA, 1501 bp, Oryza sativa
aacacttgcgcatccacccaccccaaccgaccaaagctcgcccctttgccctcggtcatgagcctcgccgccgagtcgccgtcgccgtcctccccgtcgtcgtcgagcggcagcgacgacttcgcggcgctcctcgacgcggagctcgagctgacctccgccgccgactcggcctccgccggagacccctccgccgccaccgacgacgacgacgaaggtggtgacgaggaggaggaggatgtggtggtggtcgtggaacaagaggacgccatcgtagagcagagcaggtacgcgcctctccgtactctcacctcgtcccgaggggcgaggagccggtcgagttgggtatggcggcggcttgaggcgctcgggggctctgtgctcctcgcgctttcggtgttggacggtcggtgacggcgagcagatttggtccccattcgaacctgttagggttttactgtttgattgggccggttagatgggtgctcgagggtcttcgctcctgttccgcttgaattgcgatggttgctggattcagttgtgcgaatgctgatggcaacgaatttgatcatcatcgcgggggattttttctagggtttattgaagtccgtactgttcatgtagcctgcacttcatttcattatacctacaagtgatttgcttatctgcaattgtgaaattgtgaatgacagtccatccaaatagtagatcccatgagattgctttctacgatttgaatagataccacaacttccttagttctggtatggtatgaaaattttctcatttgtggtagcttaattgcctacctatggctttatatgctgaaggcaggcaatacgtattagcatatgttgatcctataataagctggccatccaaatatgcttacgctgtagtaagaatcctatatgttggtgaactaaatgcgctatagttttaaggaaaaattggttgtataccaccaaaatatcactgatcttgttttataccactggaattttgtggtacactacaatataatcataatatgcctaagttgccatttcaatgctgctcttggttccctatcacccattaggggttggagatggcttcttatcttctgtgcggtccgtgcctttgacattcgttgggtaaacattgacagtcttgggggtgcattggtgagtttgaagtgacttggcactgaaatgagttggggagggaagaaccagctgtgggaatgcagggaaattttctttttgcggatgagggcaaaatggtcaacatgacagaaaagagcacttttgatggttgtgtttaaatgaaatggggtgctatttgagtgtcattaatacatactgtaaaaatttaattccgatagtatagaactaaatggttatttgatggtatgatagaaaattttcctttcatttattggatatgctaaagcttggctgaacatgcaatccatgtccttttgtttagaaaatactaatagtgagctgttttctggatt

SEQ ID NO: 50968 - DNA, 425 bp, Oryza sativa
aataatcccaattcccaatccctaagtcaattatagacggacaaaacatcgtcctcctaggtcgagcactgtatgaatatttatggcacactacttattctatactcaaccagatagatattcttgtacagatgctggaatccacaatcactcaccacatgacatcgcacaataataatggagcaatataatataatgcagcaggcaaatcacacctttagctatcggaaacgcggcccagtatcacggcccacccaataggcaacagccgaccactacgcggggcccgcgaaggtcgattgtaatgggccatctattcttcgccctgtggggattagtttgggccaatagaccaccacgcggcccgtcatcgggagtgggcccgaagacactcagtccgcgtcgcctcgcatctcccctgcagc

SEQ ID NO: 50969 - DNA, 1358 bp, Oryza sativa
aatcgagtagtaggcattgcaacggagatcgggtactatgcgtactgtactgctccttcgtgttcatgactttgcaagtactgtactactcctgcggctgctgatcttaaataacggcgaagatgaagaaatgaagtactactactatgagtaggagtatatatgaaccgaaacttctttgctgtcctgtcctgtggcttgtcgattgtgcctgcctatttattggcgtgttcctcatggcctcccgggtaggtgcatgcatcgcgaattcgcgactaattatcatcacctccaagatttgcaatggaacgacgtgaggagtgaggagaaagaatatgaaagatcctttgggtagcttgaggtcagggatttgcaacgcaacgtgatgactgatgagtgaggatatctcatgcttgcaaatctgcacagccaagccaaggccccgtttggtttcttccctgaaataaaacacacagacggttatgcctcgctgtcatgtccaaacagaaacttctcgcaatctcgctcgtgagggaaatcaggaaaatctgttctccggatagttcacctaaagtgacagattttttcttaactgctgagacattagttattgcattcggcggtttcctgacgttcacgttcatgttcatccaagaattgcagtttggttgaatgggacagcacaggccactgaaaccagagcgccagacaccagtgcatgggcaagagaagtttaaggtggtgtttagatccatggattgaattcctcgtcacatcagatgtttagatactaattagaaatattaaacatagactaataataaaactaattgcataaatgagagctaattcgtgagataaatttttgaagcctaattaatccataattagcacatgtttactgtagcatcatatagattaatcatggattaatcagactcaatagattcgtctcgcgaattagttcagtgttatgaaatgggttttgtcattagtttacatttataattctaatttgtatcaaacatcctatatgacaggtagtataattttagcccgtgatccaagcaagaaactgggagggtcagacagttaaagaggcgatgagatggcaggtggccgctgttcccggtgtcagcaccaaccgatcgagccggttggtgatgcgacgggagtgaggtgagtgacagagtgatactacagtgtaccggtacagtggagtagcgttcgcgatcgagggatgtggacttggaacggtgatggatcgtgtcgttgttggctcatcaattcctcacagtcaccggctgcgtggccggggcgccggccggggctagccgctagcagaatcggcacaagga

SEQ ID NO: 50970 - DNA, 1501 bp, Oryza sativa
tttggtatttcaaaggttaagcaaaaattaaaatattattttaatatatgttcgttggtgtagtatccaaatgtaacaaatggttcacggatacatgttaatgtattcaatatttttacatataattttccgtgcgacatagctctaaatactattcaaatttatccacgtattatgtacaataaaacataatactaaattaattttgctagagatgacagcaaatttaaaaacataatagtaattaccaaatttaaacacataaaaatataaacatgcttacctctatgtctcctatttatttctcgtccttctccgaacttgtaatttctaaatttaatgcaccacgttcactcttataaccttgaaaataatgaagatatgttaataataaatcttgcaaaatccatactatttacaacaattccaaccgtcatgcaaattacctctaaattttgttctatcatttgtcttattcactgtcaaatggtactttgaactaaaaaaattcttaccacattcaattattcgcgtggcgcggctctaattactagttaaatttccccccttataatgtaccctaaaacataatactaaaaccattctatcttcatactaaattaatatattttttactcatttctctatctcattcagatatcgtacacacaactaaagaaatttcgaaatatatacatttctccccatggcctaacacaataaaaaaatttatgcacgtcttttgtacaataaaatataatactaaacccattctatattcaaactacattcatactatatatttattatatttattgacttctaacttaaatggtatctaaaatttctaaacataccatataaccgaactatttacatgtaatatatgcacactatctaaattattacttatccaatacactaataattacatctaatacataaaccatcactaaatatatacttaataatatttatattactaatttacctctatttcttctcttgttgcaagctcatcaaaacattaacatggttcttaaaatcccagataattacctgaagtggacatttttttccccacgaagaatagatgcaggaaggatactaaacgctgtagtcaaaacgtaccaaaccacaaagtcattaccccgttcatttgtcaactcattaactactcttgtgcaagtgaacattgatccatccatttctactgctgtacgaattacatgctccctccgtaaaaaaaaaatatttcctccatcccataatataagacataatcaaacttagcactgtcttcaaaactaattcttgaatttctcatatgctataaggtttattacaacaaaattataaccataaatttaaatgtgaatattccaatgatattaattttagcaaataaattttaatttatattataatagttgttggtcaaatatttttaaatttaaattttagaatattcgcacatcttatattatgagctagaggaagt

SEQ ID NO: 50971 - DNA, 1501 bp, Oryza sativa
taaacagttattatgatagattattacaatctataagccagattactataatttggtaagtcactttaaaggtgcttttttaattattgagtagctaatagctaacaaataactaataatccagagaaataaacagtagcagcttattctatgtcggcttattataatccaacttatagtaatctagttctatagtctatattacaataatcttaaactgaaacaaacaataccttagtttacattgaatcagttcgaatctttttttttttgagaattagttcgaagcacgtgcttttattaaaatcttaatccaaaccgggaaattggtagagtagcgtctcttctaaatactatatttgagagcaatttcttatttgtcgttcaaagattcatgcgatctccctaatctcacgtgtcaaagtcacaagggtgacaactaagggagtgtttgaggagaaggggattgagaagattgggaagatacgcaaaacgaggtgagccattagctcatgattaattgagtattaactattttaaattttaaaaatggattaatatgattttttaaagcaactttcttatagaatttttttttacgaaaaacgcaccgtttagtagtttgaaaagcgtgcgcgcggaaaacgagagccaatctcccctatcacccctaaacgaacgatgcctaatgagctaggagagcgagcagccaaaaccatggcggagctaccttttgcgcgggcgcgcagagcaacgaggaagccgcgcagcaacacgtgcgcgggcgcagctgagttcgggctgatatgaagaagctactcttctcttttcgtcctaaaataaataaattaaaaatatttaaatttataataatcaaatgtatcatatttttatagattatttattttgagatgtaagaattgtttcttccatctaggatggcaattttacccataggtccggtatacgtgaatacccgacccgatgggcatggacgtgggtgtgattttttatccatgggcacgcccgtccgagacccgaagacgttatgggcaataggcgggtttcattttttacccgtggataacccatgcccgactcgatacatatgtattagctaattttgactcatttattaattcttataccatttctctcggttcatttgcgatgctaactaatattaagttgtgatgtaattcaaattatcattgataaccgataatttggtaaattattgattttatttctctttgttaaattacatatctttcaagttattcatgtgagatccattggatacccgccggacatacccgcgcccgctgggcatgggtacgggcatggagttttgcccgctaactctagtggatagggtttaggcatgcaatgtcgggtatcgggtcgggcatggttttgctctacctatgcccgacccgactcattgccatccctacttccatccataaggatatacgtacacaacagagcatatgcatat

SEQ ID NO: 50972 - DNA, 1501 bp, Oryza sativa
ttgggggaggaaaccgacttaggtggtcaagggagctcggctggcggtcgtgctcggagctagcggccaagcagcggcagtggaggtgcggtggctgaggttgggaaaaagagaaaaagaagggggaaagggaagcttgaccatgccgttttggggagggagagaagggggagggcgagctctggctccgtgttttggaagcacgcgcacagggagtgggggcgggttgcagcgcgcgacgcaggcggcagcgcgggcacgggcggcgaccgggcggtcggccaccgcgtaggagcgcgcgcggagcaaaatcgaatagcggcggcaggagagttcaaaccgcggcggcgggaaccggcgggcggtgacgaaaatcgaaaggcggcgacgggagaccgacgccgggagagaagggagagagagagaactgagagagagagagagagcgaagagagagagagggggagggggagagcggcgctctctctcggctcggtgggggcacgtgcaactcacgtggagagggaggagttaggcagaggggagatgggccgaggggaggggatccagcccatccaaaattatgaggacgcaaaatagacttttatagagaagacagatttggagagaattcgagttgggggtttggatttggatttcgaatttgatgcttggtcttagggaaacaaggtggagtcaaggaaggaactcaaatgggaatcaggaacaggtatttcgcaaggatttcaagagaggatttgaatttcgggatttgatttggagtcttgaattggaagaggaaatttgaggtggaggattttgatttcaatgagagggaacaacgggatttgaattgagatccacggcacgacttagactcagcacacaaagaatgaattttcgcaattaggattttgccgaattagtttttaacgtctcacgaaaagcggagcgttacaagagtccatatagaaacacaattaggaaataatagaaatttagaattaaaaaataaggaaggttagaagtagagtatagagtgcatataggaatttaaaactaactaaaatttggaataaacataataaaattaaaagtagagtttagagtccgtataaaaatacaatttacaaataactaaaattcgaaattaagaaaaacatgggaagttgagtttaaagtcaatataggaatgcaatttagaagtaactgaaattcgaaattaaaaattaaagaatattgaaagatgagtttagagtccacatagaaatacaattagaaataataaaaattaagaataaaaataaataatattggaagaagagcatagagtctatatagaaatacaatttacaaaaaattcggaattaaaaaaaagaaatattaaaagacaagtctagagtccatataggaatatatatatttataaacactttgatattaaaaataattaataactaacacgtatataaaatacaatatgaatattacacattagtag

SEQ ID NO: 50973 - DNA, 1501 bp, Oryza sativa; identical to SEQ ID NO: 43112

SEQ ID NO: 50974 - DNA, 1501 bp, Oryza sativa
aatggatcatctacgagaagtcgttgttcatcaggagcaggagggttgccgtggagggtatacagcatggcttttgtgccgcagccggatgccatgaggaagaggaagatggcgagggcgaggaggaagacggcaagggctccatggtgggagcggtagtacttcaccatgaggacgccgacgccgattgtcgtgacagctaggcaggccaagaaggccaccagaccgtagtcgttgtcgatcccgacatcccgctccgccatggcggtgaagtagtaatcgtcatcgccgtcgccgccgccgtcgccgccataaccatcgtagttagggttctctagatcgcccattatttattgttcttcgataataattaattctgatatatgcctctctctgctaatgtactagctagagatcacgatcgatgtatgtgtggttgttgattggtactatttgtttgtgcggattgcaattaggttcgaattaggctcggattatctcgttcaattcggtcacgcatgcatactctaagtaaaacagtcacggatcgatcgggtaccatatatgcttaaccatataccaaattaaataaaggagaaatataatttctaccaacacgggtgttatcgtctcctggctgggctgccctctctcccctctatggcacatggctgcatgattggtggccatcttctagggcttgtttacctgatcatctccgtgccagcttcgactccctggtcctcctagtctcatggcaactgtggagggaacgtaactccagggtccttgactctgtgctctcttcggtcgcagtagtcctagaggtcatccttttggagggccggctgtggtcgttagcggccgtcacttactttggggaattgttgggagcgtagagtggctctgctcccttccgctgtttggagtagagcttttcgagttttttttcctttcctttctttgttttttatctttgttttcttccttacttggcataggccggtctggctgagtgagtcgtgtatcaaaactctattcttctaatatattgacatgcaattcttttgcgcgttcgcgaaaataatttctagcaacaattaatcaatcaaataagtaaaataccctatacctctgtttttaaatagatgaaatcgttgacgttgggaatacgtttgaccattttcatctaattcaaaagaagatggtttttcatccctagatatacccttttaattgcaaaaaaaggttgatatacattaataagagatattgacttaaaaaatatataatgaaactacaaattgtaacaaggtacttttataacagatatatcgcataaaaaatatagaagttaaatttgacttatttgtaacaataaaaaaaataaattaaactaaaacttgctaaaacatacatctagaactatatttgttccttttggttataacttagtagaagttttcgcaaacccgcattacacgtcaatatatattagaag

SEQ ID NO: 50975 - DNA, 1501 bp, Oryza sativa
ttttactcggggtggattttaaatttttaatcactcgagagaatattctctcgtgtatctttttcttctaaattcgatacaaataattatgaaaaattctaataaaactagcgaaatgcccatgcgttgcactgggtgaagacaaaaataaatagtaatgggcgtgtgggagcataatgccaccaggttaattgagatccttatagtcaaatcgaatcttttcggtgcaagtaagacgctaacatgacataattattcgttgctctaaatccattcacatggattataagaaagctattaataccactttaaaatgaaattatgtattatacatactaaagtttgaaacccaaaaagtatttatttttgtcatgtattattatgagtcggttgcaatgcatggttatatttttgtacttgatattgataaacacttttttttacatactgcaagagtagtaatagtacaagaaatgtttttcgctagctatcagataaatctcactgtactccaattgcataatcgctttcactcaaaaaatcagaaggaaatcgtacgatgaatggaaagaaaaaaaaaagtggtgtatcatctcactctaaaaaaattagaacaaaaacatacaacgaatgaaaaaaaattgatgtggatgagggaaaaaatctggatgtaaacacgattcattttgttggtgactacatgtttttttaaaaaacaaagacacgtgattgttttctattttctaaaagtaatttattttgtcagtaaataattcattttgttggtggttacatgtttttttaaaaaagaaagacatgtgattttttttttactttcccaaaataatgaaattgttcctttttttaaatccaattcctagtagacacagatccaaacacaaactttatttagtgttaataatctcaggcaagcctcctatttaggtggtattattcgtgctacagtgctcggttactactatatcacgcagaactatgttgtgctgggctgctgcttctctgctctgtaggctggctgccgggctgctcgctaggtttctcttttttttttccattctcttttatttgcggagctcagagatcgtcgtaatgcatccggattcacggattagcggcgaaataatcacgtgggcccaccctttaatgacggaagaaaaaaatcaaccgaaaaccttacttattttttaattaggtatagatatagatatagatttgacaatgtagagtatagtgatatctatcggtccaccaaaaatcaagctaaaatttgacatacccactaagattaaaaaaagagagacaaattttgtatacaatatgctactattcataagtttgtcttttctatatgtcgatgtgtgagttgagtttggatctaaaattttgtggagttgtatagatatgttgtacgaacattatcaaattttatataatttttttataactgtttggatgatatttttttaaaataaccgtttgg

SEQ ID NO: 50976 - DNA, 953 bp, Oryza sativa
ttcgtgtttacaaaatagctttgagcaactaaatgtctttaaatgctgtttactgcaaccctaacccttacattataattcccttgtactcccttgcatttattctgcatttgtgggtgtgtcttgttgagtacggtggttgtactcagtcttgctcaatttttccaaagcccagaagaggagctccttggagatgaaggcttcggtgtctagctcgtgcctgccgtcaagcgtctgtggtcgtcgccctagtcttccgctgtttctcgtttgtctttgtgtgtgctgggccttcgctgcccatgtaataagttaactatttacgcttccgcttgttaaactctgatttgtatcaacttttggtgtaccttgcctcctgggacaagaattaatgcacgcacgtaaggaatgcccgttgggttatttccggtcgtgacaccctcgttctgggttcccaatctggaaaagtccaatcccctctctaagtgggcaaggtcctccttttatatcttaaggggataccacatgcaccatctccccctctctttcttccaatttgacttctcttcattaacagacggagatttgcatcgccgccgtccgaatgaccttctgacgggacggcccatacctacctccacttccgccggaggcaggcgcgacgtgggaagatggctgtctgctgatgacttgaccattgtcagaccggtcacaaatcggtcattcttgtccaccacgtgtcagtttaacaatctgcatgttcgcccttcttcatacaatatcttgcctgtaatggttaggatgaagcctgacatatatttgaccggaaccaacgtgccatctccaggagctaacacgccggctccagctagggacgagtgcttggaggctctcgtcctgacaggatggggcgaggcgtgcgtcaaaccgcctgtagccacctaacccatgat

SEQ ID NO: 50977 - DNA, 1501 bp, Oryza sativa
gggggattatttatatagggcaagggtgagtacgggagtactcagcaagccatgggaagtaagtgtttaatgcaggcttcaaggaaaggctgatgtttttgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccgggcctagctgatcccattagctgcagatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccataccatactgtgccaggaagcccaggggtcctccccgacaccaccccagcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttgaaaattcatttagttcgcaagcaccgacccaggtgtcgggttttccaagtcttttgtaaaactccagttttacccaagttgttactcggattttaagtttgaaggcgaccgtcgatactggcacagggtgcacgaatatcgaggcgcaactggatggttacaaggggacatggtatagcaattaacaatggaaggatcaaatgtaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcaccgcgggtcttcgggctccgatactacacgcgaaacgggacaactcaacaaacggcgaaaataaagccctattaatgacctctaagcatgccattagaaagatctcgagatttgaggaattttggaagttgaacggagtcaaacggatttacggttggaaagatattgaatttctaaggttatttgatttttggtctaaaggaaaaaggattaaattaaatcctttttgaaaaagaaaagaaagagggaggagaagtagacttccctcgggcggctagggcgtggcccgagagaag

SEQ ID NO: 50978 - DNA, 1501 bp, Oryza sativa
atttagtattatcaatattaatatatttgtctataaacttaatcaagcttgaaataatttgactttgagcaaagtcaaaacgtcttataacctgaattggatggagcatttttttgaaaaatagattaatatgattttttaagcaattttcgtatagaatttttttgcaaaaaacacaccgtttagcggtttgaaaagtgtatgtgtaaaaaacgaagaagatgagttgagaaagctaggaaagaagtcagtctaagctcgtcggcatagcacttaatctgctttacctgagtggtggccggtcctggccttgtacaaggggctgacggcctgaggctgaaccccgtgaaacaccaccacctcttcttcaacagttcaactcgagcgggggcgatggaaaaagcaatagcaggggacatgaatattccaactttccaggacatctttctgaattctgatggtggtgggcaatgtgagactgaaaaaaatcgatatgggagagagagagaggtcagaaatggagatggaggggatgataggtggaacccactctattttttttaatgattgggatgtcacgtgaacaccaagtcaacgaaaaaccgcttttaaaaacagttgatgtagtcattttaaacggttttgatagttagaggggtcgatttatctagttttatggttgaggaatatgaatcggattcaatttatatttgtgtgagtagttaaatttgcttgtgtttttctttcttcatcagcttattcttatttttcaatgatgataaactgatcagcgtagccgccggcccgtcgcccacccttaaacaacgacagctaatttatgcatgcatggattccgatggaggagctgtgtgcaccactcattcgtaagacttctttcgaataattcaacggaagaaggttgaaccatttgaagcgaatcacacattattgatctttctctccaaagaatcgtgctagctcgttggaaaaaaggggaaaaaaaaacggcgagcctagctataattcaatttgcgagattacacatatgtgaaaaatcgccaagttaagggtttttctttatacataactaaatttgctactaatccttatatagccgcctatgagcatttgtgcattgtactatgcaccaacctccacttgtaaagtttcaaccaaaaagaaaaaaaaagccatccacttgtgctgccaatttgctcaatcccgacaagctcgctcgatcgttcgccgcatcagccagtctcagtccgctgcaatttgttcgcgcatgcgttcatataatagacctatcatagatttttcgacgattccaacgacctcgtggaaaaatcgcagatgcacgcaccaaatccatcaatttcatcacgacactcgcaagtagtgcgcgtccgctataaaagcgatggaaatcctcggaggacggcacacggttgatcgatcagtacgagtacgacgagagctaagtaaacttagctatatcgat

SEQ ID NO: 50979 - DNA, 1501 bp, Oryza sativa
agtatgaaccggcacatctaagaaagagatggcaacctagcaggtgagaccatatgggcaaagaaagattgtccatggtagaccagcattatgacatccaacaccgatgtggaatgtaggagaaaactagaggaaatccggaggctttggaatcctatgaaaaagctgcttttcagctgtcaagaaccagggaaggacaatcaactttagatctcattgctacagagtctgaggggagaaaacacgctggatggaacctagacaaaactttgatcgatcgctactagccttgtccccaatcaaaataaatcattccccttcattttgtttgaaggcagaattctgcactttattgcggcattctatgtttctgcagcgttcaatattttaacgaagcattatttttttccatgtactattctgttcatgaaaccagaaaaatcaaacccacattcgttctgttcatggatagcagaagtgggaagatggaccattgtgttacattacgcaaattccttaaggctttcagaacgatcaaactcgagagataaatgggaataggaacaaaggtaaagcattaaggagtacccagtactgacctcttgctgcttaactgccatggcattagaagaacggcaggagttagctggaatatgggttggatggcatcaatgctgaactggtggcttccgtggtccagactggtacagtacaggataataaaggtgatagctcgaccaagagagcaaaacaaaggcaagaagtcagtgcctggaatgtgcatgtcccagccaaattgccaatcacactgttacgtgtagtagtctgaagaaggtattagtcacatctaaaaaattaaaagcatgaaagtcaggtggcaagggagtgaccagcaaagaacacctgaagaaccgactcatatctggaataaacacctttactttatgcccggtttgccttctcttttccatctttgagattgataatatctgaaaattgcaacataatttcattagatatgaatatatgagtccacagtccacagaacacatagctcttagcaatcataccatagaagaacgaaacaaagtttgcgtgtttacaggttgcagaatatattacatgaagtacatttactgaaagattataatactacaacatgtgtgtttgctattgtaatgttctttcactcaatatgtaacaatataattgttgttggctcaaaactaaaagaacaatttcaaagcaaacaattacataattttttttaatgtaacaatctggtggaaaatctgtcacatattgttcatcaagtcactctctaacgcaaggagtgcaacacatcgcatcaccttccttttctttctttttcatacttcaaaagggaatccgacacttcttggtgcttcaaggattcaaaagtggttttcgggagctcaaaggcgaacttgcatacgctcggtcgctccgcctccgggggtgacgcgggcggcgaaacagg

SEQ ID NO: 50980 - DNA, 1501 bp, Oryza sativa; identical to SEQ ID NO: 43101

SEQ ID NO: 50981 - DNA, 1005 bp, Oryza sativa
cctcccacccccaccccaccctgggaccctaattcgtcggccctctgctggagtttgggttagccagcacccgagaagaagagggggttgccagagttggagaagaagagcacgaatcgtgaagcacatccagtgatctaaaatttgcaagatttgaggttgtattttcagtcgacagaagtttagcaattccgtaaaaaaaatgcattagaaccacaacgagatgataaaatttgtaaaatttgacgactttcaaacaaaattgcacgagaacagagcaacttaggtaaccctcgaattttgttgtggaaatcgtgaccttagcctcgagcagggtaaatttatcttttcgattttcatttttaaagtaaaaacaacttcccaccgttttaccaaaaacaccatatggaaaccaactaataccgaccggtttcacaaagcctgatcagttctgtgaaccctggtctcgagaacatttcatgatattttcatcggctgtactatgctatctacaagtaggggtagataacgatccagctcaactcgttaaggctcagctcgtttgagctcgttgttttaacgagccagctcggctcggctcgcgagttggctcgttaagctcgttaacaagctatatctcattaataccatattaataattttaaatttaagattttattatgtattaacataataataaacactaactaatatagtactcactaaatatgaatagttttgatgtaactaaaagactaagcactagtcaagaaacactaagttcatgaagatatggtgatattttatactaacgagctaaaggagcagctcgcgagctagctcgttaagctcatgagctaaaaggctagctcgactcgactcattaaaactacgagttcgaattgatctgagccgagcttgctacgagccgatccgagccacgagtttcgagctttttgtccacccctatctacaagtgaaggaactttcaaatagcagggcaaa

SEQ ID NO: 50982 - DNA, 1501 bp, Oryza sativa
gcgaatggattggtgagcacacgtgcaattataatcaactcttgagcaaaccattactcctaccattgccctttgatcgagtagtctaatggatgaaagtaccctagcgtcgtagactctcttctcgtgtctgtcctcttggccccacctgcctccctttgatgttcctagctggagggggacttcgctggctgggcctggtccaccgtgcaaccatcactgtccctggctgtttgaccatacgcgggcccctcagcgacctggaaactcccgtcctagacccggtgcagggactagtgagcatttgctgcccttttgcttttgtttgcttgcctggctttctttgcgcgtagccctcgcacatttttggattgttttaagaatagttctttgaagtagaaatttttggaattatcagtaagagagtagcaacatgctaccgactagaatttagagtaatttggaggcaaggtttcatttttaagtgtattttgatcatgctaattactcataacttaagtcacaacactttgttctttaccaataggctatgcaaatgagttgaattaattgtagaatgatttaatgtattgccatatgagtgaaatgggagcttaaattaaatacgaaggtacatgttggtataaagatgaaaacatgtcttctagatatgaattaagttttgcaagttgcagtgtatcctcttgaacctatttgtattgaatggttcatacaaatgaaaaagaattctagattactatttagcgcatatttattcatagcatgcaccttttcatataaaagttttcataaaaaagttcttgatgaaagtttcttataaaagtattcccataaaaccttttcagatgaaagttttctagttaaatgtttttcagatgaaaattttctagatgaacgttttcagaaaaagcgtacgatgagaatgcatatgcgctaaatagcagtccttatgaaatcttggttctccgtgaagccgagttaacggtagtgttaaaccttcgataagttttaccactaccaattttacatgtgctatggttggttcgaagttcttttgctgctgaatgttatatgtgtcgttcctataaaatccaaggtttcatttgcaaaaagagcaatagagcacgcagcacacactccctcttcttcttcagcaattcactccagttcactttgccagcttgtctctctgattttattatccttttcttttcctcacgcagggaaaaaggcacccgttgtacacctcacctcacgctcaaaggcaacgcaagcacgcagcttttctttcttggcctcgcctcgcctcgcctctgcccatctcccctcccactcgattcctccacctctgctccgaatctccctttccgcgtgcgcgcgtcgattcctccgtgctctcaccacccgatttgggggccggtctgagatggggcagtggcactgaccggaggaccttcgccgacgtcgtccatggcgcagc

SEQ ID NO: 50983 - DNA, 1501 bp, Oryza sativa
atattaaatgcaacagcggcttcttcctgtaccaaaaacatcaaagaatgacagcactgatattccctgttttctcacctgccactcaatgctttcacagctggtatgaagctcctttgtcaaatgaacatgttctcctgtgtttgacggtgttttctcccatcgatggaaagtagtttgcaacttatcaatctgtcacagaaatatctttatcctcagtattagaagaataagatagatgcatgtgtgttgatggtgtgatatgttttcgaagttatgaaggaaataagcagcacaataacacgaaggggctatatcttcagcgataacaaaatctagcatagtaaaatgcatgaggatgaaatatgtttctgaatgtgtgagggagttaacaatagagatgcaaggaagatgtatattcaggaatggtagaatagcacagtgaacagcatgatggtgcagaatgtttctgaaactatgagttaaacagaaaagctactccaacagttcttaatcttaaggggtcatgagttatgagcttaataggaccaattagtgatggagtctgtaacatggcaattcagtgataatataagtgtatcagctaccaacttaacacaaatctgttcaaggtctgttcaagaacataattacaattcttccatcattacatcaaaaatgttaaaaatgcaacaccagactgttgtcaatttcccacgccctgtcacccagtcccattcctcaagcccattggacacaacatgtcatcctagcatacgttggaactactctaaattggatagacatttcttacagtgtaccgacaaatctgtactcttaatccttttggtggcatcgctagacataaaagacatcccaaatcacaggtagcatctgaacagaaacaggacgatcggcataatctacaaaatcggtcagaatcaagcaactaaggggtatgtctgcgcgcaaacgctcgaatttttggttttgatccatatgcatacaggacgacggcaactaatttcgcatttgctggaagcggagaaagggacaaaggagagaaagagcaagaattaccgagtcctggatctcctcccggacgatgtagaacggatcctgcgccgagctcatgctacctcctccaaaacgtcttccaaaacgaatccggatttggagggattggatttcctcccaaaccctagaattcgctcgcaggagagctgcgaaaccaccacgaggagtttggtgcggagatcggatgcgtcaccttgcttcggttgcgcagaggaggtagtgggccgtgggccaggcaggttggtggctgctggcccgtggaccgtggactcggtccacgaaaaccagtccacgcatctacgtggtggaccgggtgcaccacgctggcgcacctggtcttcttcctcccgaatcgccgggataagggtaagccagccacaaaaccctagaaggcgcgcgcgagattccatggcggccttcacct

SEQ ID NO: 50984 - DNA, 1501 bp, Oryza sativa
ttattttcagtttattcactggattattgaaatgtattatttgcttcatattttaaaaatatattttctcaataaattttctttcaccgcattcccttaaagggaaaattggaaccataccattataattgtgcaaaatttgagatatgtcatcctgacctacatgttattgactcatatggggtcctacatgtcattgagatactgatggcatatcttaaactttaaaaaattataatggcatggttccaaattaccccttaaaccactagtccatgttgcatgttgtatggcttttccttagtatcctaccactacgggtactacataaccatacaccagtcatcatgacgaagtaaatcctcaccgtttgtcgtgattatcattaggtcccgttcggtagacttcaagatgaagattaagtttaggttcacgaaacgagagagtcatcgatgtttgattaaattttttttagataatgaaaatggttacatctccggcctctgcctgtaggcacacaaccaaaaagttcagtagtgaacagaaaataacttaaaaaagatgagatgggacaaacccccaacttctaccgataatatgatctactaagataaagtttttttaaaatcacgtagattctatcatgaaattctgtaggtactgcgccatccaaactggaataaaagtttcttggctaccaattccaaacgcgtagcaccattgcgcatagtgtcttggtgttcctgtgaaagcatcatacaacaagagtgaagccaattggaacacatgaagataacctgcatgatgttagacattcttttatgattaaaaactatatcattacggcaacgccaaattgaccaacatagagcactagcaccaaataaaatcaatttttttggggtctaggcactccccttagccagttaccaaaattatcttttgcattgcaccaaacaaaattatcttttccattgtgggcgctccccttagccagcgatgtttgattaattaaattttaattattttatactcatgaaatggatttatctgatgttacgttttcgcgtgatgcaccatttaaaatgcgtaacttatatatatatatatatttgtttggtgctccatggtgcccgggcaccattgttgaaattgagtatatacccaattcaaatgagtatgaaactttttcaattacctaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtccta

SEQ ID NO: 50985 - DNA, 1307 bp, Oryza sativa
acattgtgaaacggagggagtacataataaaaagtcttctgttggtacagctaaagggtctggcggaaattctttcggaactccaaatccgttttgggctgaacacttgcgaccctatggtcattcgtgttcttttttcaatttgaatattcccatacataaagtttctttgttgaatattgctatgcatttccttatcaagaatataaacacatataaaatttaaaatttgtccaagaatataagcacatccccatatgctttctcatccaaaccaatcatgcacagtcatatctcatttaatattttcacatattttcacatctcaatcaatcataaccattactcatcttgatcttaattaaaagaactccaaatgtgtttatattattagagagggattataaagtttctatattgaaaatttccatgtatataagtcgtccgtgtgacttcatcaatctcaacatacgctggtataatattttagatgtgctcataaggacaggatgtgtgtattcatgaaagtgagtatgcgctcgttacgagcttctacgtttctactgtgttattttaaaaaatggtttcaagcttttttttattgggccgaatacatgcatgcaaatgggtcgttgcacattggacgtgggttagaaacatgtccgcttcccaaatgaaaaaggtaaaaggtcgcacacatggacgacaagagattgatgtaatgcaatattttttttaaaaaaaaacaagcaggaaaaaatagtttcttcaagaaacaactcaaatacagtgttgcaacaattcaactaaacgcttgtaaccataaaaagctgcaacaaacattaatcttactatgaaaaggatatctattgcgtatatcttagaacttggaagaagaagataaatagagttagagaatatttgtttatagtccactaatggatcgatacgttttaaattggcacatactgtatggtttaagtatgtactccgtataaacatatctttctttttttctttaatttttttttcatcgagtgctctctctgatccagatacgctagattggacggcccgagcatctccaacagcctctccatcagactctccaagttaaattttggcaactttagcagaaaatagtactccaacagactctctattcagatggccaagtaaaatgactggtcaaactcctctcccaactagccaaatttggccattcaaacagactagccaaatgtgggccccaccatctctctcctctctcatgccatcctccctctttgtccggcacagttgggaca

SEQ ID NO: 50986 - DNA, 1501 bp, Oryza sativa
ccttagcaacttttgtcactaccattattttgataacacaaaaattgatccaaacaaaataagcccataaatctaacatacaaaagttaagcttatttggtttggaggaaatttaacccatagaaatagagaaaaaaaatgaaggagcccctatataataaatttcacggtagcgctattctgagcgctagagcgcggaatattattccgagcaccgcacatcgcgtccagagtccgcaaaatctggtgttcggttgcccacgttcgatttgtgtagattagttctatttgaattcagggtaaatcaattacagatctataaaatcagtggtctattgaaaataatcgttgtaattggtttatctatgtttccaatcgaggtagttacgatatggtgtgcaacaaactaagaccaaatcttgtactaatcgaattactgtcgatgtaaatgaaaattgatggtgcatgtgcctgtagtaattggattaacgacaaccatgcttggtgaaaccttgtagtaatcgagttactgtcgacataaatgaaaattgatggtacatgtgcttgtagtagttggattaagaacaacattggttgatcaaatcttgtagtattcatattactatcgatgtaaatgaaaattgatggtgcattaacttatagtaattgcattattgctagccttggttgatgatttcttatagtgagtgcatcaagcaaggaaaaaaaaggaaaaataaataaggagggagttactggggcctaattagtttaccccaaataatacgtgaataatttttttacttatatattgaatcactgcatcctaaatcacgggacaaaaaaaataaagattttacatgcacatcatagtaaaagcacaagaataaaaattttacacacacacaacaatacacgccatccccagttcctcatgatggcttaatggagtttttgtcctactagagagagcaagaagacaaagcagcagagatggaggctggagccgaggcagcaccaagtctggccgctgcgacctcagtaggagttggatccggcgacgaagccaaagatggaggtcgccgttgtttttgatgaaacaaatcacagtttcttgccgatgttaccaaatcgattgaccatcacgaacatgatatccgccatgtaagggagaatagagaagcacaccaagatgagtgctcaacccaatcgaagtcagactgcatagaatcaagaaggataaagaatttaattaatcatagattgtatacaatacttgcaagaaaatcaagaatttcattaggaattgctgagagaactcatcgtccccacgacttccacctcgttcgccatgcgccagacgtctcttcagcatcgatctgaagcagatgctgcggcagcgaggcctgaagcagtgccttcacctcaagcgccgccatcaaccggctgccaccgccatcaaccgccacgatgtcgtcgtcgtcctccatggtgcgtcgcc

SEQ ID NO: 50987 - DNA, 600 bp, Oryza sativa
aaaggttacgactaacttttgcgtgggtgtaatctttgcgagaatgatcttgataattagtttctaacattgaaattgaaagggtacgacttaactttgattaacacatagagtatattgggcacaaacccaaccaaacaaaaggagggttacttacgcctcatgttctcacactaattctggcccactgagcagtctactgggccagagccaaacgcaagataagcgggccaaaacaatccgccggtgcccccgccctcgtcaaccaaccctgacctttgacctagtccacgtggaaaccgtagccgactcgtcctcgtcttccagctcagctgcagccggcgcccgcgcgggcggagcaaaccacggcgggggcgaccacgccgacgacccgcgcacacgccggcttcttcgtcctcttcttcttcttcttcttcttccacccccgcgacccgccgccgcccccgcgcagaagctcgtggcctcctccgccgtccacgtgaggcaggcagggctaactccgccgcggggcccacggagcagtgggtgggtggggcccgcggcccgcaccgtccctcggatcgcgcggggcccacctgg

SEQ ID NO: 50988 - DNA, 1501 bp, Oryza sativa
ttatagacaaatatatagcaaaattgtctctctttcacgcgatttccatctaacacatcaagcctctttgaccccttccctatctctctctatatttttcgtcggcctgacatagggggcccaaggtcgtttgttgccatccccacaatctccggtgagcgaccaaagattgaaagatcttacaataagggagacagatccatttgtcagagtggaggaaggatgcaggaggtaggccatatcttattttttctttttggagctttttgtgaggatgttgcaagctattattttcccatgcatgttacgccttggtgtaattgaatgttttactatattttaattgtatgttgcgcactttaattcttaggtgttgcgactagcttatttaaatattgcatttggttgaacatttttctctaaccgctgaaacatttttaccgaatattgaaacatcttaaatatttttattgtaacatttcggtgaaacatctaaaacatttttgtacggacgtctgggccttgctcctctccggactttcaaggttagtgctgtagaactctggaactaacatgcggctgattaaatgagttgatgggcagcttaattacggcccgcctgtttagccaattgatactcagctcacatacggcctaattaagttagattaactagataaaagaacatccaacacaggggcccagctcccagctagtagtactcagtactcgtctcgatgctacgaaaccccaccttacagaagcgtaaaactgcgtaagcccatcaggactgggcccacatggcagataagcatggcccgagttcgtagtaaatcccccaagtcctgcacggggtgatcacatcaacagtgtgttcctcaaggagcgttgtcacgctacaacgtgatggtggcgcgccacggcggagaaatggcactcactgtttcctcgtgacgtgcgccaaaacaggctcgccacggcacgccccttgccgccggggaaatgaatgatccagggcggcagcagagtaccagaccctaagcttcagacgcggccccatctacagccactgtttcgcaatgcttagaaagatggcagcctgaaataattgaactcgttcggccgggccaacccggcagagaaaaaaagggattattgaactccaaaagtgatcaaatgcggtggagcagagctctcgtgagtctaatcccgcaacgagaacgcatatgaataatggttttgcggcgggtgcgttctgcaatgacaggccaacggtcaaagcatcccaactcccgcctcctcctcgtctaaaaccactcgcttccaaacaatccaaaccttccatgccatttggcatttttggctttgcttctcttctcttcctttgctttggctcttccccaaaatcacaagacccaagaaagaaagagagagagacaaaacaacagatcatctttgcagcactgtattggcactgtaccgctcgacatgaacggcgagg

SEQ ID NO: 50989 - DNA, 1501 bp, Oryza sativa
tgattgacactttttttctgtgcgctctgagatgatcatttaatattgctttacagactgacaaaggtgatgaagaactgtgcagtgtatatgtgccaaccaatcatctatatatcggtgacatcttcttggttaggtctgaggagattataaggccgaatttgtccattcgagaagggataggttggttccttttccaaattttgaagttaccgtttgtgtgctaggtcttttctcctatccaattcagtgttttatcctagtacatttctcttattcatctaatcttatgctctttgtactttttacagaaatcattgtttctggaggaatgaccatgccgcaggtgattgcagcaccaggacaaacaccccataagggtcagagcacccgtttaaacagaatgatgagtgcgtgagtacatcaggtaaaatctgcagatgcgatcaggcctgtaaacctgtcccaggcggttgccaatagatttctgatccatggccatctcaatttcagcagctgttctgttgaatatacatagtatactgatattgccacctagcttttgtaggtctgcccagagttgctgagagagggcaaatcggtggatgacaaagctggaacaaggtgattgagaagcagcattgctggtagattaggcagatcaaaatacgaaagtcagtgttgactagtccgcatcgcttaggtttgctcgctgagtgaaaagttgtgtaatctttcaatcacgctccaaatgtatatcagtactgtgaccaatagtatttatactcctttcaaaagaaaaaaaaacgatagcatttgtaccttgtttacttcactgcgtcctggttcttttatgcacttcaactaaggtcatctggaggctgtgtaccggtcttatgcacttcaactgaaaccaggttaacgcttggtcatcttgagcatgtttccatcgagaaaccaaaaactgatgtatcgtttggtccttttgagtcggttcatattgagaaattgctcggtatacaaacaagttaaacaaactgaaattttttttaaaaaaaaattgtcgaaattttatctgtagtggttatcgacgaaataactacgtgaacggtaattcgtatgtctacccctctttcttttctttttttcacttgctagttctggttagtactccctttccaatttgataatacttattattttggacaaaaacagtctcaaaaaataactttttatttaagactaatctatgtggtcaccttatttctaagacattttaaaagctatttttagttaaagattttaaagttaaataacagtcttacaaagaacaagtgttatcagcattgagagagggagtacaaagttttgtggtgtacctatcgggaaaaaaaatggttttgtgatgttgcactttacaagttctgattagtacaaagacagaagagaagaaattcgtaaacaagcaagaatggcccttctggcctaatcaaacacctcc

SEQ ID NO: 50990 - DNA, 1501 bp, Oryza sativa
tttggcataacaatttatagcatgttgactgttgacctcatcctgtcagtcgctcggttcatcatttcaactgcttgtgcatcacccaaataattcgactggctaaggtttatcagaaaatgtgtgttcgtctattttttctggtagaagatttacttcggaaatagttgtggtccaaatactgtccaaactcttttccaaacgagtgagaagagaaatggtggccaaatggaagatgatcacgtacaccaaaaaatagtaatcttatagatatatcatcaactagtagtgcacaagctcccacgttaattaaaaattttgatcaatttattgtctacatgcccaattaattaatgtttgaatcctaatacatgcatggaagataaaattagaaccagataataaaagcaatgatgtactcactccttcccatgtttatccatcatataatggaatttaaaatttcttaaatcgatcatcatataaccgcatggacacagattttatcaaaatacaattaatacagcatgaaagaatgtgtacatgctaagatgtaattgacatggtgttttaatcgatacatacattatgggagaatgtgtgcatggtgttttgattaatgtgatttaaattatacttggtcctcgtgcataaacatatatgatgatcaatttaggaatgaggaagtatttagtttgtgtgtttatatgagcgtttgcacgactgtactatgtttttaaaaaatactgttacctttctactccctacattctcccatgatgtattaattgtattctgataaaattcgtgtccatgcagttatatgatgatcaacttgaaaaattttggattccattatatgatgattaaattgggaaagagagagtattagctttttcaaataaatataggggggggtggttcagcaattaaaatggggctaacctacctgtaaactctaaacagaaatctgtgcctaaagtgaaaaccacttatgtcggacaggtatagaaactaaaagataattaaaattgtcaacatcggtttatccagccaagaggaactagaatgcaaaattactttacagcaatgcagctctggcgaaacgttgacagatttggccctctcccacacgaatgctgcatatgttggcttgtagcagccatcgtttctagcaaatcaagtctggtgttatcagacttggacacatgcgtactagtaatattagggagtccctacagagaagtagagaacgaccaagattttgcacttttgctggcatatgtgaagacataactcccgaatatacttgttggctgtttatctccaatgtatctactatctagcaatatgcaggctcattttgctgggagaaaatcgcgagctataaatatgcatgcaatgcagcgttttctcttgcaagagctgcttagacaggagtagttgctacgagtacttgctaggaagaaactgcagtgtgctctgttccaaagagtagtga

SEQ ID NO: 50991 - DNA, 1501 bp, Oryza sativa
gcaaactagctaaggactcagatattcgagatcacgattgtattatcctaatccaacaggatcaggcctccgccgccatcgcctccaagtgatctcagttcataccctctcctctgttcgttctcctgtttatatcagtctcaacacctcatgacagctgtcggaacagcacaactcacgcacgccatcgcgcaggatggacttagttacttgacccactctggcccgacaacacgcacactgggcttcttatgacgacgcccccagcccaggataggcgcctcctccctgtcgccctgtagcgcgtcatctgccttgccgtccatcttcagttcttcagattcttcagacttatcgtcagccctccctcttggagcctgagtccttccaaggcttggcctgacactgcacagcgcctgtcattaattatatctgcagttattaagctccccaggcatgtgtatgtcctagctcgcctagttgactcgaaataacttcgacttagagtgacttaatccttatccttccagatgatgcaaagaaccagttgaagatttgcatgaccttctttgatgctcccatctgcaaaaatcacagtcgatgtccaaaatcaatcaattaaaacccatagttattgttgactggaacacgtacagctgtaaaaaaatatattagagaattaattagatcgaatgctccaaactggaaatctagcagcatgggcatttgccaatttcaaattttcaatttgcattccgtgtcatgtaattgcctgatgtgagttttgcctagatttgaggctgatatctagcaaggaacctcggaaaattgcaatctagtactcccaacgttccagaatataataagttttagagttggatacggttattaagaaagtaggtagaagtgaatagtagagggttttgatgggttgggaagagaacattggtagataagttgttatattttagaacaaattctgagaactaaaagttgttatattttaggacggagggaatatcaattatatgagccatgctcataacagaaaaaaaacactatacatattgacatgcacatttgcttcacggtcaagacttgaggcacacacgaaaggcagccgacatatcgaatactgcaaaatactatagcttatatatatatatatatatatatgctaatccgtctatcgtgcattacagacaaattatctgtcatgcaagttgaagaagcaatcatagatatatcgtatatatttttcagatgttcatttgactccatgcacaacactccacagaatgcagaattctacgattctatatctgctatcaaaatagcacgaaatggccatgtggccaaaaacgacattacgatatggagggctatatatatctgcatgcgacgcaggcattgcattgcatcgcatcgcattgcatctgcaagagtagtagtagtggtgctctggtagtctactgctgcttgatcgatcgatcgatcgcca

SEQ ID NO: 50992 - DNA, 270 bp, Oryza sativa
agtttatctaattttaccatctctgttgaattgcaggaggagaaaaatcaaaagaggcttaaggaggtaagtttgattgtctaacataattgcttctgtatcttttttactttgaaacttgatttaacatctgtatggtacagtatcataatatgtccttaaaagtttcattctgcttgagagctgagacatttaattgagttgcatatatgtttccatgtttaaagtcgtagtgtggtttattggacatttaatacaatcttttggaaa

SEQ ID NO: 50993 - DNA, 1501 bp, Oryza sativa
agaaatttgaacttcagacagattttgcatggctgtcattagtaccccctacacatgtttggtcagttggcaaactgaatttttctttgctcctgcttacttattgacttaagtgtttgttagtgttaccgaaaatagattttttttaaaaaaaagaaactgactttatatattaacaacttaaaaataacagtactgtattactgttctgcctaattcttgtgactgatgccagaggtaattgaacaaaagttgacccaatctgacgtggatgcatgaatgtgcagaagttcagcttggtgccagcttatttgaggcccaaatctagccaggaactgcggaaaattctatcaccaagaatcaaatatagccatgtgcgtagccatctcccttgaccattagagaagaaattcagttcatctgcaccatctttcatattattttaagacagattgatctacagacaagcattaccagtgttataaggattgagatcatctgacttaaaatcacgtgactttgagtcattgatatgtgagccttctttgccatggacccacatatcaatgactataaaatcacctgacttaaggcagaggatctcaacccgtgttataagggaagtaatttcatccttaagaagatatatcgttcctttttgcatgctatccaaataatcatgaaaaaatatgaaaagtttttttacaagatagagcatttttaatatatcatttcacacaaatggaagtttaaatttggcatatacaagttataacaaatatgtaatagtatgcatatttagcatcatttttgttttttttcacaacatatgtaagttaaatttaaacttgtatatttgtgaagtgatacatcacatattgaatatttttttcatggctatataaaagacatacgaaaacgagagggatgaaaaatccatctccatgctattagtgatggtgaggtgatttgcaacttgcaagattgttgcccttcgcataaactgggtaggtctgcaggctttagcgacatctactgatgaacactttgaaacaaaaggaactgccaactgccattatcaaggaaagcaaacatcttctttacattctccatgtccacttaataaagccaaacccaagcaagcatgcatgctctgttctatattcaggcttatcagacaggagtacatgaccaaccaatattctcaaccttttagcgatgatcgtgatttctctcccataaccatatcgtaccagctagcagggttgccgtcgtgtggcttccatgtccatgcattgtgatagtaaccatactaaaaccatgaacaaaacgcatcataagtacatcacatctctaaaaaatatgcagcatatggctgacatgctaccaacagactgtcacgggcgcaaaaatgacaacacatttagctctcacatataaatgcacatatgcaacacatgcaattcaggccattgcatacacacacagagttgtttgcatt

SEQ ID NO: 50994 - DNA, 1501 bp, Oryza sativa
gcctatatgcatcacgagagggccgggatctgcaatctgctagctgctgatgtctgaaagctcaaggctgcatacagcgccttcgccgctggattgatcagagagagaatccgcttgagtccaggggctcagatcagcgtcttttcgagctcagccgggttaagttgtggcagaatatgcatggcagtgctccggcgtgaggtgttgcccgtgaggcgaccagcatggtactaatccacggatttctggctatatatgccgctacatatcaactgcaggattagattgctattgtcccatccaatgcaatgcaagaacggagagaatcacacgtagagtgagtgactcacgcattcgattagtaatggacagaacatcaacggtggctaaatctagcaatggcgtgcagtgaagttgtgctgacaacaaatagtatcacacttgtgttatctagatactattaaaattatcatgatcttgacgggttccatgatgccgaaagaaaaaaaaacagcacttacactcactgttttaactatgtatacctccgtcctagaaagataacttctaactatgtatctatgccagcttcgagatacatatcagtgggggaatcaggtattacaaagtacaaccaatgcaatttgttaaatcttcaaacttttcattaatttttaaaaggatttacaagggattaaagggacgagcctagcgctcaagccataattatgttaggcttgtcttcgtcactgttaatagttgattttttttctagtacagacagtaattttttttttcgcgaatgcccagacagtaaattcactttcaaggaattgaatcagaattaaatcaagataaattttcggttactacagtatcataaagcagatgttcttagggaattaccttggagcaacctccctgctagtgtcaaatcttccagtcagaattcagaaactgcagcaaataggggttggtagaattcagaattcagaacaccgaaagatcagtcacaaaatctcagatcagtggacgagttctcaaaaaaagatcagtggatccagcattgcactgaaaacttgctcccatcgattaaacgctctcgcgtcgccctcccccgggcgactcgggaggcgacgccgccgccgtcctcctcctcctcacgtctcctccccccgcctcaccgccgcctgagcgggcaccggcaaagccttgctcccacaagctaggacggcggcggtggggcctcatctcgcctccacgcgctcggcgggtggggggatgccttgagtggcggctgtggtgcctagatccgcgccgggcccggccggatctacgggaggggcagctggcggcgggggctgaaggtgacggcggcggcctctggtgttggacgcgtcgacgctcgtgctgacggtgtcgacggcgaggtcctccagatctgcgggtgccggtggttgcagcgcgtccggtggcagcggcggcggtggatgccgacggc

SEQ ID NO: 50995 - DNA, 1501 bp, Oryza sativa
gttctcgaggtcgaagaaaggaggaggcaggtcgttgttagcgctgtccatgctcgccgtggttgagtccctcctcccgagaccaaccgtccatgacggccctcccagctgcaaccacaagaagaaattaattaattccttaattaatcgtcgtgagtttcatgtcgcacaagcggccggtgcggcggcgaggatgatgatctagcttactgcgacgacggagtcgcgggcggcgacggcgaggatgtcggcgcaggagacggtctggctgcagatgccctcgagctgcgtcttgatgctgtcgacgacgttgaagcctctgagagaattcttgttaggaagagcattctgctcgccggtgaacgtggccgtgtccgccagcagtacggacgcatcgcacccctgataaattgacagttactactactttgtcagtcctagttgcaaaataaaataataataataataataataataataataataataataataataataataataataataataataataataataataataataataataataataataattgttacgagtactaatagtcaattgttatcaactcctactctctctttttacttgagtcaaactagagatggtcaaagctaagcttggaaatggaatctcgtatcagtgtcagtgacgagtccaaagctagccttttgacgttagtaattctgtcagtccaactgaattgacagtgtcacataacttagctaattctgaacacagtgcaatcagacgcaaaacgaaaactgaacatagatttattaattactgcagctaaagttagccatgagatcgatgagatcagggacttgcttggacaaagcagtcatggaagtgcagcctgagcagtgacgcccccatgcgaggctcgttgttcacggcggccgtcacggcgctcttgatggtggccagcgccctggggcacgacgtgtcgtagaacgtcggcgacagctgcgccgccgcggcggcggcgaggcacaggagcacggccactgaaagagaagaagccatggcgatcgatcgatcgatcaagcagcagtagactaccagagcaccactactactactcttgcagatgcaatgcgatgcgatgcaatgcaatgcctgcgtcgcatgcagatatatatagccctccatatcgtaatgtcgtttttggccacatggccatttcgtgctattttgatagcagatatagaatcgtagaattctgcattctgtggagtgttgtgcatggagtcaaatgaacatctgaaaaatatatacgatatatctatgattgcttcttcaacttgcatgacagataatttgtctgtaatgcacgatagacggattagcatatatatatatatatatatataagctatagtattttgcagtattcgatatgtcggctgcctttcgtgtgtgcctcaagtcttgaccgtgaagcaaatgtgcatgtcaatatgtatagtgttttttttct

SEQ ID NO: 50996 - DNA, 1501 bp, Oryza sativa
gtacaataacttcaaaattgagcgtccaagtgtaagggcaacaacaatgtatatggcaaaagtagtccatagagatgggacccacatatatgaactttaactattgtaaccttcataatgtatatggatagcaaatagtattagtaggagagaagagatagagacaaataatatattttattctctatgggcagcccatatacttatgggtagcttttgttatttcttttctatggactagtttcacaatgttgctaggtggctgaatcaaatattatattgcttatggactacttttggagtacattgtggatgccctaataacttagcaagtgagtgcgtctggtacacgaacttgagaacttactattttggtgcagtaactcggctatctatatgttattttggtcaataaatgctagatgagtgtaccaacttgagaacttactattttggtgcagtaactcggctatctatatgttattttggtcaataaatgctagatgagttttttttatgatatcaatatgaaaatatgccatcacatagcaatactgtggatattccattataattttgaatttaatctataattcaagaattatgtttctcatccgatttacaccatcatcttggattttttttcttcaccttttaaaatctcaaccggaatacatattatttagatattaaaatttaattgattgttagttactagagcgactaaattgaagtatgcttctacaaattccatgagtatattaaaaaattaatacctaaaatttgaatatttatggtaaaaaatgatcaaaataattaaatgttgttacatatatttttaaagttattgtactataatcacacgcaccttgcaagttgtagcacccgtatgcaatttagtacaatttgttaagtttttacactaaatcgcacctatctattaattagttgttgcactacaacgctcacttctcaagttcttgtactaaattgcatctatctaccaaattgatataccatggatataatttactcttttagaagcactggagctaaaaaaatatgaagtaaatatcttcattttcacagactttgttcactactccctatagattgttttttcaagtacaagtttaaacaaaaatcatcaaactctacccacggatccaaatacgagtttagtgacactacccctacccggttttaaatttgaaggaaataggatatagaagtgccatgatcacacgctgtaagcctgtaatcgctggtaggggagctcttggagacaatatgggccgagcacacgatgacccaggtgattttacggcccatatagaaacacagatgggctaaaacttccgcccacgtcgaaccaggcccggcccacatgaccacaccgcgccgatgcggctgccgcgtggccttgccttctttgggagtcgcgccattggtagcctcgaaaggcagcaaccgggaagagggaagagagatgggagagaac

SEQ ID NO: 50997 - DNA, 1501 bp, Oryza sativa
aaaaaaattaagtgctatgtgttctttaaagttttcatattatagtattctttaaccattctttccatttaataacaactaactttatatttttatatttttgttctaatttaaaccaccctattctatccatttccaaatccgataactccaccgccgctccacctccaagtccagttagtctacaactacttcgcacactaattctctctctccttttccccctcttcgataattggggaaccgctagatccagcaaagaggggtcggctcatgcttttcacacactaattctctcgctctctccttttttttccctccgacaattagggaatcgctagatccagcaaggaggggtcggctcctgctttcccgagtccctgcaaacccgacaccatcggcctttaggacaaccgtgacaatagcgtgcatgacgaccgaggaggagaagatacatgtcgatgtctagagggtacggttgcgcatgcgaaggtggagagggggaatgatggtggctcatggagaaaaaacgatggtagtggtgtgtggagtgataaccagtggttgtcggtagtttaaggagtttgctgtctgacataattcctaactaagtttgttgtatttttttttttcaagtactatcgacatgtgagctacaaaatcatcctaaagattgaataacatagctagtggtaatgtgaaaaaaatgagataaaaggtggactggtgtctggtggagtactcgagtatcttccccgttccttcccttggcgtaagagaacgagaaatctcccatctctcagtcgtctcccccgcttccttgcgccaagacgagtcgcggctgagcaggagaggggcgccgatctccatccggcgagcagagcaggggaggggatcctggtgagcatccacatcctctttctgatgcatctctctcccaccgggagttcttttgtgtggaatttccttgcgtttgttaaccctagcttctcttctagatctgggaagaagctcttctcttaatttcagagccttaaccttaatacaagtaacagtttgttgtttgttccccccccccccccccccccaaatttgggggttcaactgaaaccccatatccctagttggatccgcccctgaaaaagtataggctgtttactctctccacaactcccttgtttgctagtatgatatgtttttcacaaactctgatttagtcgttgcgagctatacttggaattggcctattattcgctgttcttagcatatattcgcacgctttctcaccaagattcttttcttctcgcaggtatagattgttgattgcttgtgcgtgaacacaactaaagcagtaattcttaccgtgtcagcgtgatctgggactgtggccaattgtaccataagtggaaacacagctgcgaagattgtcggtggtcttcgctgataatatattgggcaggctaagtttcaagttcagtttgctgaattcagcgagcctaga

SEQ ID NO: 50998 - DNA, 1501 bp, Oryza sativa
cccatgcgaggctcctgcgccaccgcagctctcacgccggccctgatgatggccagagctctcgggcacgacctcgaatagaatgtagccgacagttgttgcccggagactgaacctgcaagtgctagacacaagagcaacaggactgacagacaagaggccattgtcaatctacaatgcaaacaactctgtgtgtgtatgcaatggcctgaattgcatgtgttgcatatgtgcatttatatgtgagagctaaatgtgttgtcatttttgcgcccgtgacagtctgttggtagcatgtcagccatatgctgcatattttttagagatgtgatgtacttatgatgcgttttgttcatggttttagtatggttactatcacaatgcatggacatggaagccacacgacggcaaccctgctagctggtacgatatggttatgggagagaaatcacgatcatcgctaaaaggttgagaatattggttggtcatgtactcctgtctgataagcctgaatatagaacagagcatgcatgcttgcttgggtttggctttattaagtggacatggagaatgtaaagaagatgtttgctttccttgataatggcagttggcagttccttttgtttcaaagtgttcatcagtagatgtcgctaaagcctgcagacctacccagtttatgcgaagggcaacaatcttgcaagttgcaaatcacctcaccatcactaatagcatggagatggatttttcatccctctcgttttcgtatgtcttttatatagccatgaaaaaaatattcaatatgtgatgtatcacttcacaaatatacaagtttaaatttaacttacatatgttgtgaaaaaaaacaaaaatgatgctaaatatgcatactattacatatttgttataacttgtatatgccaaatttaaacttccatttgtgtgaaatgatatattaaaaatgctctatcttgtaaaaaaacttttcatattttttcatgattatttggatagcatgcaaaaaggaacgatatatcttcttaaggatgaaattacttcccttataacacgggttgagatcctctgccttaagtcaggtgattttatagtcattgatatgtgggtccatggcaaagaaggctcacatatcaatgactcaaagtcacgtgattttaagtcagatgatctcaatccttataacactggtaatgcttgtctgtagatcaatctgtcttaaaataatatgaaagatggtgcagatgaactgaatttcttctctaatggtcaagggagatggctacgcacatggctatatttgattcttggtgatagaattttccgcagttcctggctagatttgggcctcaaataagctggcaccaagctgaacttctgcacattcatgcatccacgtcagattgggtcaacttttgttcaattacctctggcatcagtcacaagaattaggcagaacagtaatacagtactgttatttttaagttgt

SEQ ID NO: 50999 - DNA, 1501 bp, Oryza sativa
cttcgtcggcgaggggggtgtagaaccagtcgctcttccaatcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactctagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggggttagggcgcaagcggcgaagacaaggggaataatagcgagaggaaggaagcaaatctcttcctcggcgactttatacccttgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcatcatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcgggggggggggggggggtcgggcccgagggtgatacggccgcccttctctttgtctccccgaggggtcggaccactcccgtctcggccccgagggccgaggcgccccgaccccttgtgggttttgcgccgcgtatatgaggtaggtgagcgtagcagggctcacctaaccacatttattgcggtttggacgagcgcgtcacgccgcatgtaacgcagtgcagcgcgctcgtttatccggtctgtgatcagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaaga

SEQ ID NO: 51000 - DNA, 1501 bp, Oryza sativa
agtagcaccccggccactataaggattaagctcgggcctctgttgcaaagcactaccgtacttccacatgtctagtgggtaaggcttagtttgtggctcagtctggttataaacaaaagtacacggattggagatgtgtgaagtcgggggtcgatggacattctccagggcaaatgaaggctacacgagctgcggcccggtagtcgagatgtcatggcagagggttggtgccctgctgctagggggctcaatcctgcctacctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctctaggatcgtctttataaaatggctttgggcaactaagtgacttttaaatgctgctttctgcaaaacttaacccctatattattatcccctttacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggaaattttcccggtcgcgacatcacttctcattatagacccttaacgtgtcattcttgcactcatattctcctgccaattgactgatcaccaacaaataatcccccatgatttcgatagcatcggcctcaacttccttgagtaactgcaaccctttgagaactgcctcatacccagcttgattattagtcgcataaggtttaatagtataagcaaactcaaatcatgccccccgaggggaaattattactaagccgataccacaaccatgagtacaaactgactgtaacatcccggcctagggcttaataggattaatagaatactcatattaacaagttacaacttcttttccggaagccaatcatcaaagaactccgaggttaagcgtgattggtctggag

SEQ ID NO: 51001 - DNA, 1501 bp, Oryza sativa
cacaatccgccggtatatctccattccagattcgatctgtgcaagcgacacttcttacggcgcgtgactgcagccacaatgcgaaagaagaagggatcggattacaccatcattactcgtactatgggggaatccattacgcttctcctcctcatagtgggattccgccgcgtcgtcccatcatgctgtccaacgattcgatccggcaaagaaaagcgaagggacaaagaacgaaattgttccacctgaattatagggaagtaatgctctttactatgctcgcatctacaagccactctccagtctccactcaactgaatagacagagagatgagattttattctttgcttccctatctgaatatgcagtcacaccatgtttagtttttaaataattctttaaacttccaacttttccatcatatcaaaacttttctacatacaaacttccaacttttccgtcatatcgtttcaatttcaaccaaacttttaattttagtgtgaactaaacacaggctcaatatcatttctcatgtcgaataaactggtggaaaattaactcgcaaacacatagtagtactgaagaaacttcatcaagaagtaataggactacgagtaatgctcccttaaaaacacctgatttgatggcctctccaattacgtgccacccagcgacgagatcacgagaccactcgccctgcacaaggcaaagtataggcatcagtgcatcaccatcatcatcagatagatatgcacactgtcaccattatgggaacaatgagaacggggcactactgatttgcacaaagaattactccaccatgcaccacatatattcaattattttccttcactcgtgctctccaagcatgccacaacaacatgttccatggaagaaagaaggaggatttcatttcggtttccagtatgatgtgcattccagctcaatcacattctcccatcaccaagaaaaatactcattcttctcatccagtcacactcatcatgggtccgtccataagtactcatccttttactattttaattgctcctcctagctgtactactcattgttgtcaccacagaaatgtatcttcttcctctccaatggaaagagctcagcttaaagagagctaagacacccagctttattcaggagataaaaaagaaagaagaaagcacaggtacatgtgcaatgattctcccattagtcacaaacactgtatttcgcgcggcaagcaaggggacatttgtaaatgatgccatgatgatacattgtggttgtggcaaaccttattaaaatggtagtagcagtagtagtacaaagtagtaggaagagtaatctgaaaaagaactaggaaggctccatcatgtgagacaagtccagaacaaccggatgcaagcatgattctgatcttatagaataatgcaagcacacatgcacaacagcacaaatagttgtaaaagaacagccttgaacccacccgggcacaaaataagt

SEQ ID NO: 51002 - DNA, 697 bp, Oryza sativa
aagcgcctttgtaataatgtaaatattatcgatataataaagatgtgtcttttatatcatgtttgtgtggtgtaccccggcttttcctgggacggggattaatacactagcgttcgggaaaaggaaattttcccggtcgcgacaagctggtatcagagccatctcgactgtaggataagccaagtggataaaacctaaggacatattttataaataaaactatttgcgaaagttcctctttttcttcttcccctaatgctatttgcaaaagggttactcttttcttccttcttcaaatttcaactagtaccagatggtcaggtcagtgaagaagaagacatcgtcagttgtctgccgaagctccggaaggctggaggatccgctagcgaagtggaggaagcagtgaagccagctgtgaaggagtgaagatcttggagaacccgtcgcagaacctaagccaccctctagggcagagtcgttagtcgtgtgtttccttgcttgtgtgtgtagcgcatggtttgcatcagtgggttgtgatgtaaccatgctaggttgtttgcttaatcaacttgcagaataagcccaacatacatcataacagcaaaaggcatagatctgttaaggtcctatccttagtttctaatctgtctctccccttttgttttccctctctccctctccaaacctttgcaacaga

SEQ ID NO: 51003 - DNA, 1501 bp, Oryza sativa
attcactccttgattttgtagtatccaatgtgatttaatttctccttggtcttggtgtcaaaagtaatatgtgtaagttttgtggatggagggagtagtacggaatagatagagtattttttttatatttctcctactccctccgtctcaaaaaaaacctgggtttccgtgatcaacgtttaactgtccgtcttgtatgaatttttttataattagtattttcatagttgttagatgataaaatatgattaatattttatacgtgacttgtctttttaattttttttcataaatttttcaaataaaacggacggtcaaacgttggacacggaaacccagggtttgtctttttttttacggatggagtacaaaatatgaatagtgcagtaatttacatgttcaccgtgcctgcaacggcacgtaaaacgggaccacacagattaccccttttaggttgtgtttatttcagcgcaaagtttggattttggttgaaattggagatgatgtgactgaaaagttgtgtgtgtatgacatgttgatgtgtgatggaaaaggactgatgtttggatctttggatctaaacacagccttaacagttttacagcagcaactttaggcacaaagcaacacatgttaactttctctcacatctgtccttttccgtgcagtgcagcctgtgcctgtgcaggcatgctctccgttatccgagaaggggaaaaaggtgttggaattaatagatgggctaaggcccattcgaagattaattctttgaaaaatcacaaaagcccacctcatgggatggtatgcatatggagtttagtaccaccttacttattctaggagagggggacctccttaaaagggaggatgcccttctagccacttgaagcatgtgtggtggagagaaggggggaacacgcacgcgcttgcctcgcctggcagggcaggcggcgcgcgtgcatgacgtacgcgttgaatggtccgaaaaattggctcctcacccttgcgcagatgcagcctccttttgcagttttgttttgctgcaggaaaattcggatttgttttgttgttggaaacattccgaaaaatccggtgcgtgaaaacggcgtggagtccggataagttacacggataagttcctgcaccgggagaaggcggcaataaggtttttgggaagcgcttcgcgcgactgctccctgttcgtccgcgacggctcgccttcctctccattcgcgtgttgcgcgccttcgtcgacgctcgcaaccgcgagtagttcctgccgagcaaccggtctttccgccacctcggtacgtgtttgacatgttgcacatatttgatctgttcatgttttactgcttagtttacatgtgtagatctaatgatgcgttaatgatattatacatttgtaatgtcatgatttatttatggaatatattaaatcattatatgcctatattctcaacaatccaaaaaccttattataagcgctgtgattttacta

SEQ ID NO: 51004 - DNA, 885 bp, Oryza sativa
aagaccgagccacgcaacccgtggcatgcaaccctccaacgcacgcacagctagctaagctttagagtactcctagctagcaaccgcgcgcattttctgacctgtccacttcaattctcaggctccatctgcttttattcatcggtttcattaattgtttctgttacatactggagtagtaaggatagatagacacatctagttctatcgttttgtttactttcgtgtttattaggtctgtccacattgctttgtacgtgtttaatttgttgactaatgcatgtttctctcatcgatcttataggttcattgtatacgcaacccaaatatttcagttcagaaccgcacgtttgtcaaccatgcagataccattaaacaatttagagcatcgatcggtcgccaacatgcatgggcaagcagcagatgaaaactgagtgcatatgcagggaaaaactctgaaagactctctctgcagtacgttagtaaacggggcaaactccaatttaactagctagttcttgctcctccaacaatcctggcctcctgaaactaaaacgtctctcacgttgctagctagcataattgacttgctactatatatatgaacagttcgcatgtgcagaatcttttcttcgtcctcttggtttccctttcaattcattcatttcatttcctagctagctaaagacaccataacatcacgtgggtacgcgaccgcgcaggataccactataaagacgtagagaaagcctctcatcatcagtactcatcaccttcctttgaagcagcaggtcgtagctagctagacacccgcgctcgctcgtctccattgaagcgagaaataaagtagaaagacacagacacacttgagtagaattttagaga

SEQ ID NO: 51005 - DNA, 1501 bp, Oryza sativa
cagcagcacgcgcacacgcggcggggtgggtgcttggacgttcgggcgtcgggaggggtgggcccgggtggcagtgagagaagggacgagccgggcgagagagatggtgtgttgcgtgctaggagcaagtgggcacaggggttgttttggtggggcccggttgtccagaggggttacagatacaggtgcgaggtgtgtgtgtgtcctgtccaatccaaatcggaagtaacccgtcgtcgtcgtcgtcgtcgtcaatttggagaacccgcggacgcggcatgggtgtgcagcaactgggaggcgccggcggcgggcgcgggggcggccggcggagccgccgaggtcgccgtgaggcaccaccgcgccttgcccaccggtgcgccgacgaaggactccgggctcctctccgcgtggtaagtaacgtgcctacctgatctccgctatggataatggattccgcgtggtgaagtttcttgatctcctttcgtgccatgagcattgttttgggggactgcctctagggtttggtaactgaataccgttcgaagggcattttgcaattgaactgtgtggaactttgatttcaaggagtacatcgatagttaggtaattatttttgaactgtacacgtatagtcattgaggaactgcagtgatgatttctcatttatagattcttttgactgacaaatctggcacttgaaaagtatttttctagtagctgaagttgacaaaaattccatggaagaggctagtagagtttctgatgcttacctcaatatgccggatgccgcccatatcaccgagcatttcctgtcttcaatgccaatacttactgtgttcatgttgatcataacatatctgttcgcgaaaacatgtcttgttgccacccacttcaattgtttagtttgggacttcttaatgctgccatacttcacatccaatgactccttgatccttttctggcccactatcatcgcttggcacgtgaagtttagaaagtaaatagttagagcttctgcacttcatgagctcctttttcggtcgctcgcccttgacacaatctggctggtatggtctagatcctgaagtgtggcgcatttgtagaagtgtgttggatgtgtttggagaggttttctttaatccctccttgtacttttcttatctcttcttaatgaaatgacatacagctttcctgcatgttcgataaagagaaagtaaatagtatttgtttgtatcaacaattataagttataacctgtaacaagtctagtttcagcttcttctgtgctaagattttcgtagcttcaaaggaacatttctcgtataaaactcataatgacatctgctgcacaagtgaaaatgggcatggtggttaggttctagttcctgttttctcttaaaaatcacattgttatgcttgttaggcagcagttaccatattggcttctaaccattatcgtgcatgatctgaaagtggcaccatgtcgccttttcagatg

SEQ ID NO: 51006 - DNA, 1431 bp, Oryza sativa
cccacaaaccctaaccgatcgagagggggcgcagccagtgacggaaaacgccaccgccacgtcacgcctcatcgccgggacatctacgaccgccactgccgcagtcgtcatcgccgatgacctcaccggcgccgcatccgcgacaaccgcgcgacgatgacgacgatggccgacgcttcttcatcctccaacacctcaaccggtcggtctatctaaaccctctcccttttcaatctctattgttcaaacatctacccaaatagaaccacccgacctagatctaacctaggtgatcctagagcaaagtttaacattggtatcagagcgttcctagtgattagatcggttcggggaaagaaatcaaaagaaagaaaagcacaagatctgcacggatcaaaagaaccgaaaaccctaaccctaatcttacctcgtcgccggccgtcgttgacgccggcaacagaggggggaggggcaaagaggcaccgccgaagagccactcgacggccgtgcgcgcacccgcgggtgcacgcgcgtgccggtgagagatcccgcggcggcgccgccacctccatcgtcgctgttctctctctcacttcacgtgggtggagggcgagagacggtggggggagaagagaagagaaaagcacgccggccatggcgcgccggcgcgaaggtcgccggcgacggcgacgccgctccatgcggtcacgcgagagagaagagaagagaggctagggttcggccggccggaggctgaggtcggggttttgtccctctgatctcggcgcccggccgttggatctaaaccttagccgatcggacggccgacggcggccgggctgaaagcggcccaagaggggcgcgcgcgcggcggtttcctggcccaggcccatgttgcggcctgggggaaaagggggagcgcccgcgcacgccaaaaggccgtgggccgaccgagaaaagtccgtttgaggtccctcgggggccaaaaatgtagaaaagagaacggtagcatttttctttttaaattttgtcaattttcatgcaaatttcaatagagtttgaatagttttatttgcatgttttacctctgtttaaatttgaaccaacgggagaattttcacagagagtaaattatagagttttgctactgttcatatgatttttatatagatcttctgctacaaatagatgaaattgatgaaaattagtgtttctaaaattaaatttcgaaccaacgggagaatttaattttaggaacattaattatgtgctatgatgttgtaattttctgaccaacgttgataattgcaatgttatagttatggttatatgtgttatgtctaattctgcccaacggtgatgtaggcttaatgcgtaatattttaatgttaattttgttctcaccatacatgattatttcaggtggctact

SEQ ID NO: 51007 - DNA, 1335 bp, Oryza sativa
  unsure (1)..(1335): unsure at all n locations
agtctggccgacgtattgcatgataattcacagccaggactcatttgtatcaacttatggatgacaccaacttttccattcaacgcagcaatgtgaatgggcaatgatccctctaaatctgcacaatagcctgacgatggatctttcgcaaggagagttttagtggcagtaatactgaaaaagggcccagcgataatggggttgtcgactgaaatatagtcgaggagccggaccatcaggtgtgataatatgccaacgcattcgactaacaaatagtcgaggagcaggtgtgatgatctgccaaagcatccaacggccaaatagtgaagtggggtcctgccagattcatctgggatttttatgagactacattcccaattcaccagtatggtggtcagttctgcaaatgacatttacattattaatcaaccgtcatacatttgattgttcctatgtgaagtaaccatgcatgcacgagtaacgtagaagaaaaactgtaaaacgatataaagaaatataagagaaacaagagcagttgatcaaaagagcaaaaatcccacaaaatttcacattcaccgcccagttggttttaaaatttaatggactgtctctattcttcagtcacgcaaatatcccacaaatttaaattacatttgcatggcgctatgatctgcagctacagtaaaaagaaccttatccgtccttgaaaaaaattttgcgaatatacttattttttttataatttacgtttatatgcatgtatgagaagtatttgcaaaaaatatacccgtcccgcaggatgaaaacacggtatcatgacggtcccgcagctccaaaactagtgaccgacggtcctacggctccgtgatggtcccacagctacaaaatgctggaccgtcgaggtaccacgtatannnnnnnnnnnnnnnnnnnnnnnntgcaaatctttctcatatatgtatataagcataagtcattgtaaaaaaaagtatatccgtaattgttccatgtcccttgctcatctccaccagatgtgcacatcaggcgctctactagatcgggagaacacatgcaccgctacctcaaaggtgctactctctccgtcccaaattacaggatgccctcttttttagaaaaatcaaactcaataaattttgactaataatcatactaatcatatatatgctaagtattatgcatgttatatcactatatttgtattttaaagtacttttatgtgatccttatttcatatttgttgagaacataacctggaataaattaatagcaaagtatatcatcgaagatcatattaaaatatataggcgtcacaat

SEQ ID NO: 51008 - DNA, 1501 bp, Oryza sativa
tacgatctaatccctgaacttaaatggacatatacagtaatgattaaaatagatatgcttgccttcttgagctttcaccataactacggagaaacatcgaaggatctcaaccaaacagtgaccgtagtaaatcataatcataaacagtgtttttgcctgataagcacgtgtggcagacagagcataaagtatttaactgatacttttagacaaagatttaactgatgcttgtcagacacatgcaaacatattattactgagacatacttagtgattcaggtactgcgtattagacacgttttgaagacaaaagtgcactacatcatgctatgtacaaaaagaatggtaagtttaaaccttagaggaattgacatgtaagtctccaaacataagaaattcatctttaggtcccacaaattattgtactctgttggactttcttaacttgtacctatgactataagcatcgctgttgtgaaaaataagaataatcacatttcttctgtttcatggtcatgtcatcttaccacaactcttgcattggcacaaccggattttttagttctccatcaactccattgacactttgtaacctggttttcttagggactgaaaattattttgacgtgaaatagcaagatagactcatagcgcgctatattagggacagaaattttattagacaaatcaaaatggagttgaacagaagctgaattttttgcatctcatatctagaagagcaagtgttgtctgatgatagaatggcttctctttttctttttccttttttggcaaagaatgatagaatggttagcaagacaacattccaattgttgatgatttgcaggatggacctgctaattaatcaaatggcaaccttatcaaccctgaatatatctgagccaaaacctttggaaagttcaacccagcatagatactgacaaccactgttgctttgttgttggcatcctttgagatggttctctgaatccacttcacaagatcccatttgtccatagtaaaaataataattgtcaccaagagtccaagaccaagtgggcatcaagtgagctgtctacatttcacccttcactttatgcaaaagagaaacccttcctagctccccaaagggcatgcccctgccccctcaatgcaaagaatttgttcttcatcagactaatccaatggccctatcttgcaccaaattgccaacataaactcaatcaaacatgaaaatttcaaatccatgtgaaatgatcaactaggcaaaacaacaatatttttttttgcaaaaacacccccaaaataaatattttattcccctatatgaggacacctcaccactattgcttgcagaaccacagataagagcattgaaacggtcccctccctccaattgtcccaacacacatacacacacatatctcatcttgttgtttctgagctgctccaagaagcagagctctgtccatggaggaggagcagagcccgaggctcgccg

SEQ ID NO: 51009 - DNA, 329 bp, Oryza sativa
agagcaagactgagtacaaccaccgtactcagcaagtcataccgaaagagggggtatgatgtaggatataaccaaagggtagctagagcggttcatttgcataaagcgagcatttataaacagtagttgaaagcagtaaaacagttgtaataattaaacaatatttaccatccactgtccaacgctacaccacgttgcaacagacccaaccatcctcttgaactaatcaattccattagactaaactagggtgagactaatcacggtgaatctggttgaccgcccataaccgcgggcatggctattcgaatagtattactctgatcaga

SEQ ID NO: 51010 - DNA, 1211 bp, Oryza sativa
gtgtacgacatcgggttcgagttggtgtgcttcaagatgattgccgtgcatggatagagtcatgggaaggcaattgtatctattaattaggatattttatgtaatttccttagagataaacttgggcaaaagtctgccgcaaagacttatggtatcttagagtttgttagagataagagtagtgtccaatatggacatatcttgtaattctcgggtataaatagaccccgagccctatgtaattattaacacacacgttcaatacaatttcggtgcatcaccaccctttttgctttagttttatttcgacgagttcttgctttcgggttgagctgcatcggtttcaatcttcaacaagaggtaaaacttgttatgacggcttgtgtttccgggattagtgcttccatctctatgatactctaatcttgtttatgtaattcgtcgagttatcatatatcttatataatctttgacaatatcattatctaatctataatcgctaacatctgttagtagaaggcggctgattaggttaaatagcaacgttggcttagattatataagatatctaccactctatgaaacatccagcggcttgattgtctagatattgttcttcttttcatacttaatgctgcatcagttgagtttgatctattaagtcgtgcttagaaccataatctctagcctgccttctggttgccgattagggtagtatcggagtttcagccgatcttacctgatttaactacttttaccttatacgcttgattgacatgttaaatctgcctttatattaagatcttgttgcatttaaagtatattaggcttctgtttggtatatcttacttgctttaatatcttaatatagagtggtatcggagtattagccgatacatgctagatctacatgatcggctacgctatgaacatatataatcttgttgttaatatgtattttgatctaagtgatttatactgtctcggcatggcgtccgatctatcccagtcacttgatttgaatatatatcgatataaggattaaatattgttgatatctacagccgatcgagtaaatttagttccttgttacttatttgtgatcgccgatcgattcacatatgacatcggctcagagataaatgatatgtcatcggcaatcagccgatcggctatcatttatagatttaaccacggtttctttgtctttg

SEQ ID NO: 51011 - DNA, 1501 bp, Oryza sativa
gacaaaatcaaatatgcagaagaaaaagttataatttatttggcttcagtcctatcacaaatgtgttggacttgtcattaactatgaatatttttattcaaaacaaaaaatttgaaagcttcaaatattaatgatacttgtcaccgtttaggaacttcaataggcgattaacatatatagcccaacccgtctcttcggagaaatccgataaattagaacgccacaaggacacaagaaaatggtttggattaagctatatcctttttacaaatttttgttgactctcttaggttatgctctgagcaattcatactggcatcattgattcttttctaaatgtaaatcattctagaacgcataaaaacgctatattttttctcttccaccctgcttaccaaatggaaccgctccccttaataattaaactactattttttttttgctgtagtataactgaagggcaagaaagtaatttgatcaacattctttgtgcgcgacacaaattcaaggctgattattatatatgtaatttgggggagggggtacaattcggtccatattaccttgcagttcaattcctttcttcttttccttccttttcaagcttttatcacatgaatttatttgtccatctcatctcctttacattctcctgaaccatctggaaaaatgaatcatgctctgaagataagagcaaaatgaagcttaccaactagaaaagctaagaagtggttgaggtccacaaatctgcacactgctaccactgatagcagcacacatgcagaacaaacacagccgtaccaccgtctattttgttttcgcttttgctagttgctcttctgtctcttcagggctcccaaagggacatttggacacacatggataagagctcatcattatcaagatctagtactcatttgccctttacctgttcttttctgctttgtctaggcataagccaactcacatgaaaagttagccctttaggattaaaggaagatataaacattacattgaaacaaacatggatgcatgttgtatttgggaatcaatcagccactgatttggaacatcaaaagatacaaggcatgattggtgccaatttaaaacccaattttagaaaataattaagggctttttcgttgcttttgcttcttaggatttgccttttgtgtttgagagcaagagaaatgaaaagattgagaagatacacaaaactaattgagctattagcgcacaattaatcgagtattaattattttaaacttgaaaaataaactaatatgtgtcgacatttgatgttgcgattccgatatttgcatagtatggggatcgttggtactaggatatatgcgagattgaggtaaaagagacggagacgaggatttttatacaggttcgggcccttgaattgtcaggtaataaccctacatcctgttggccgaagccggtcgttgctcttattcaccataatcacactagtataatatttggggtagcc

SEQ ID NO: 51012 - DNA, 292 bp, Oryza sativa
tccaattttttttcacatcattccaattttaatcaaacttccaattttaacaatccttatctttgattctgcttcgactccatcttcatctccgatgctgatattaccaaatttggtcattaacacatgcctcccaagtccgggatatttggtaatgttccggatttgccgtataccgactccgagcaagtttcgcactctgccgttttccaactgctattccagcgctttaaatactaaccgttgtccccaagaaatctcacaccgtgacttccattttcaccgcttaagc

SEQ ID NO: 51013 - DNA, 198 bp, Oryza sativa
ccttaactgaattgaaatagcacaacccatatgatgtacggtaatgcagactaagacaagtacagtaatgcagacatgatagttttggaatattcattctatgttcaccaatattgtgccaaataccattgtcatacaaaatgtttgggtatttgcattgtttgtgatcctccttccttgcaatcaattatttccagg

SEQ ID NO: 51014 - DNA, 1501 bp, Oryza sativa
gggtggcctgacgcgtagaaactctggcggcttggactgagggggagggggaccaaactgctgctggtgctgatcagcctgctgctgcatcctctggtgcatttgctggtgctgctgctacatctgctgcatcatggccgccatcatctgggtctgatgggccatcacttgtgcaagcattgggttctcggggagcggtggcgaaccattgccggaggcgctgttggggtgtccaccatcggcgcgttcttcgccactgctgccctcacccgctgtgcggccgccattcctggtgtagaccatctgaaggaggagcagacggaggggaagagtagatgctcaggaactaagctttattaaatagaaatttaaactgcaattgttctgatctaaattaaaacacttaaaacagcaagcaaatccttattaggacagccatatcataggcatatgatatcgaccgtcgactgacccacaagtgaacaaacctaaacacacaaactaacagacaattactaagcagaacgatatgctaactgaaaatgagcctaatgctcggaacggctcctgcggtcagtggagtcgaaggcgtcctcctgctcgtctcctggtccctctgagcggctcttggagtcctgcaggtacgtctcgccactgcccggctctaagctgctggaactgctgttgcggtcgcggctgccactgggagtagcaggcaaccaacctccattgccactggctggacccctaaaggctgaagctggagcgaaggagagggcggacacgggggctgacactggagcaggagctagagctggagctgcgagaggtgctggtgatgcggaaggtgctggaggaggtgggttcctgggcgcaagctgagtgcgcacgggtgcagtggtagtcttgccgggcgtggtgcggatccggacccctcctggagctgggagacccctcagctgagcgttctcctacttcaggcgcgttatctcatccttcaaggctataatcctcacaagttttccatcattcaaggccttggatgccttgtccaggtcagagtgcatcctgtccatccccttcatcacggcacaaatgtggctgaaggtggtgtcgttctcgccagccgtcgggtggaaggtactgaagtcgtcatcatctgctcggcgagggtggaagcggtatgccgtgctgcggaaggtgtagctgtggcggtcacgaagcctggccatcatcaggtatgccgcctcctagcaggcgtggttagcggtgcctccagatgcctcaaccaccatgttggcgaggtaggtacccaagatgccaagtagaatgtgcattaaaacccccgtccaggaccggccggggtacacaaacgataaagttgacatacagatccacgtcttacaaatattataaaagtcttacataaatgcagcggaaaataaaagataactagagctaagccttgacttagattgcagcgggaacaccactccacagg

SEQ ID NO: 51015 - DNA, 275 bp, Oryza sativa
atctcatcaaccttaatgatggatcggctgctcaatctccaaggacctcctctaggcagcattgacaacataaagctggcgaaccttcaggagcaaagcatttgacagatggtggggcgaatggaagctgcacttattccatcaatcggcttttatgtatatgacagacctctttccaaatgttgtccctcaagtaagtcttaactcacttgattttcatttgaataactgcctagctgattaatccttggctaactttccttttgacttgcaga

SEQ ID NO: 51016 - DNA, 309 bp, Oryza sativa
atgcaagacacagcttcaacacgagaacctatacactagacactatcaagttttgtattgggagataatagtgtcttcataatagatgaagaataaatatgattggtagagaagaaagatgatgtatttattaatggtccactttaagaaaccatgagttgtagagtgtagtttctattgtgatgtcttattgacatggcaccatagacactgcttatggacactatgggttgggactgtccttagagaacttttatgacttttcattcaaaaaggtaaaactccaacactcctcaatcacagatacca

SEQ ID NO: 51017 - DNA, 493 bp, Oryza sativa
cagagtaatactattcgaatagtcgtgcccgcggttatgggcggtcaaccagattcaccgtgattagtctcaccctagtttagtctaatggaattgattagttcaggtggatggttgggtctgttgcaacgtggtgtagcgttggacagtggatggtaaatattgtttaattattacaactgttttactgctttcaactactgtttataaatgctcgctttatgcaaatgaaccgctctagctaccctttggttatatcctacatcataccccctctttcggtatgacttgctgagtacggtggttgtactcagtcttgctctacttttccccaacccctgagtttgagtatgcgtcagatggtgtgttttccgaggagtaggcttcatccgtgccgtcgaggatgcctgtggagtggtgttcccgctgcaatctaagtcaaggcttagctctagttatcttttattttccgctgcatttatgtaagactttt

SEQ ID NO: 51018 - DNA, 1501 bp, Oryza sativa
ggtggggttccgattacaggcagacgggcggtttagccaacacgcgcgctgtgagccagtagcaagaagctatctctatcatcaaaaacccgcctgttcttggcggcgactagaggtataaaaagaggggaagaacgaccatagggtcgtgctccaaccataggacgcgcccctaatgggcccaacatggatacacagcccattgggccaaaagaggtgacgcagcacaatggacagaaaatagtcgggagtaaaatgacaattgcggccgctccagaacagatatggacatgtggctggatccatttgaaagtagacttgataagctttccatgtagtacttgcacgcccaaatcggagttcgcatgaagtcgtggcggccgtcagaagttggcgctgccctgcagtccgaatccaccccgcgcgaatcctcttccctttggatcctctccatcgttcctgagtaaaacacgagtgcacgcgtctccggggtataaagacgaggaatatgaactcaagaaagaactcacctgataatttagttgacgtgcacgagcgcgggtaataggaccatcatgctgtatatggggggacgtggatgtatcgatggtgttgatgtcctcatcaggtgcgatgtttttgaccggaataaaaatgttcaaaaagcaccaaagcatgatttttggacatgttggagtgtatcgggtgtgttcgtggcaaaaactcacttcgtgattcgctcagcgaacttttgtcaaataatgtcaatattggcttattttggcccacacgggtgcgatgtttttgatcggaatgaaaatgttcaaaaagcaccaaagcatgatttttggacatattggagtgtattgggtgcgttcgtggcaaaaactcactttcgtgattcgcgcggcgaacttttgtcaattaatgccaatgttggcacacgagggtgtgatatttttgaccggaatcaaaaagttcaaaaaacgcgaaaacatgaattttggacatattggagtgtattgggtgcgttcgtggcaaaaactcactccgtgattcgtgcggcgaacttttgtcaactaatgccaatattggctcacaagggtgccatgttttctactgaaatcaaaaagttcaaaaaactcgaaaacatgatttttggacatattggagtgtattgggtgtgttcgtggcaaaaactcactttgagattcgcgcggcgaacttttgtcaattaatgccaatatcggctcacaagggtgcgctgtttttgaccggaatcaaaaagttcaaaaaacgccaaaacatgatttttggacaaattggagtgtattcgcgcggcgaacttttgtcaattaatgccaatattggcacacgagggtgcaatgttttctactgaaatgaaaaagttcaaaaaacgccaaaacatgatttttggacatattggagtgtattgggtgcgttcgtagcaaaaactcacttcgtgattctgatgtgacca

SEQ ID NO: 51019 - DNA, 334 bp, Oryza sativa
ggttcgctcaattcatcacaggtatgctcccatacatcttttgtgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 51020 - DNA, 1501 bp, Oryza sativa
cagctttcaactgaaccattgatctgtgactttaatacaccatcgttgctcttctctctaacactgtccatcttctgccagggcggaagagaggtggaagagaggggttgctaaagataagaccttaaaccacttgactaatgatctgttgtgagtagatttttattgattcaagttgcttaagcaaacaacctagtatggtcgcatccccaccaatgacgcaaaccatacccctacacacaagcaaacaacacacgatctagaagctaacgaaactactcttctgggacagattgggtttaggtcatctctggggaaactcttctttaatcttcgcggaacgacgactctgggcagatcttttcgctctttgcacgaagcttgaggctcgacttgacttccgaacaggcatgacgctggcggtttgtcctccaggtttgacaactaaaagaattggaggggcagggaggagaaatttaaaaaccatttcgcaaagaaatgccgaagggcaagaggagacattttgcaaatagggttttcagaaaacttgtccttagggtttgaccatttggctcaacctataatcaagttggctctgataccactttgtcacgcccagaaatttagcccaaatttccagactattttgtgtattaaatccctgtccaggaccagccagggtacacaaaacgacaagtaatatacagttccaaacgtaaataaaacgtaaaatacttacagaagaggcacttagtcctcacaccgaaacaaaagcagcagcagcggaaaaaagcgatcctagcggggcatcagctccactccacaggcaaaactcaactagggtcagagccttggtcttctaacttcgtcttcagctcagaagcactacacttctaaaaaggggaaaataatagcaaggctgagtacaaccaccgtacttagcaagccacaccaacgatgcagatgtgcaaggggatacaaggatggtttgtggctatttgcataaaggcggttgtaaaacattttattgagcaaaacagtaaaactattgagtaattaaagtaacattacatctccactgatcaacgctacaccacgttgaacaggcccaaccaacccaccagaactacagtgtattgggtcgatttattaagatgggactaatcacggtgaatctggtcgaccgcccataatcgcgggcacggctattcgaatagttttactctgatcagaggtgtacaactgtacccacaagacacagccccacgacacgtttccgtgcaccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggctgtcgcagggcccgccccgctccatcacgcccacccttgcctggatgcgttgactagagg

SEQ ID NO: 51021 - DNA, 341 bp, Oryza sativa
tagaattttttcaaagttctatgcgaataggtcccgaagcttctcgccacaaaaacagaattttgcaagaggaatttggcgattttaaatttgccgaacccggcaaagcggggagaatcggatgtactttttttgtagatgttcgtggatatattataagcctaatttcgagtccgtatgaaaaagatatgactgttttaaggaaggtcactcgaatcagggttctatttcctttctagtggcggcaggatacaaggcaactaacaaaagctatcggcaacagatcaaacacaaatagaaagtgatttggtgggtgactgtgacggtggtgacggtggtga

SEQ ID NO: 51022 - DNA, 303 bp, Oryza sativa
tgcttaataaccactagcttagttgatgggataatacccgtattagaccttttagtatcaaaattaagctgcgtgctcgagacatctgcccatgcttcctggtcgtaattatccaactaaaatgcgactgaatggtgggctgtgggtgcatggttttgctggtcgcacccatggcagttaaggaccggttcgtgggatgccctgaaagaacttatcgtacttaccacaagccagcgtggggaacggctgggcttgtagtgtagctttcctctagtcaacgcatccaggcaagggtgggcgtga

SEQ ID NO: 51023 - DNA, 1129 bp, Oryza sativa
acccgatcctagcatactagatgaattgtacagcttgactatggcttttaccgattcagagtcaaaacagtaagtttgactttgtctttgaaacatcgacctgttaggctgtgatgtttatttactgcatccatgacctgccttattgataattgcgataacgatacaggaccgattgggtatcaatcaagcacccatcgttccccatcagatcaaagcttgaagatatccaggaaacagtaaaacctggaggattgatggataccgattgcctcaacttaactgtgagaaatttggcaacagaggatgctgaaaattttaagaacactgagtgtttgggttggaggcattacgttaaatcagattggacggtaagttggttgcgcaagagttggggggggggggatatacagtcttttttttttcacttatgcttatactcatcagccaaaatttaaattttaaaccttaaatttaaagttgattttgggtttttttcatcgtaatttatttttcagtctttacttttatattgctaaaatatgcataaaaaggtttatttacaacttattttctatttgcaaatatgccattttgtttatgcttaaaatcagccaaacgatggggccgataattccgagtcaactcttctagtagtgtcacaaatgacacctattttttgtttgttttttcctccacagcaactggtcgctagtcccacgaatctgaggattgcatattcgtgtgactctactctgtatgatgcttcaggatcacatctggtatgatcgatcttaattattatatcctaattttgtagggctgaaaaatacttgctaatatcttgtcaccaaatcggtccattgatgaaatatgacttcttacatacgacttaaattacagaatgcatgcattctgttaattaagtaaaatttgaacattatattgttttttaatatgtgtaggtattcatccccgtattacattgcgaccactggacacgaattttttttatttataattttttttattaaaagttttacaaaaataattttccattttgaaaattgacggaaggagtcgcctaccgccctctgggagggcggcgaaaatgacgtggcagacggcc

SEQ ID NO: 51024 - DNA, 1501 bp, Oryza sativa
gtataggattgaaaatcccatgatgcgattggaatttattgaagtactagtcccttatagagagttgtatcctgctgttacattctacacgtgacaaacgtctgggttagtacaatcatgtaacgcacaattatcattctataaggcaacttagtttgaagataaacttaccaagatcatcgccattccgcacgtttgcatcctcatgtttattttgtcctttggaagaccttgatgccaaccactctctcctctagggaagaatagagggtatgacaggggatcgtaacatccgtagaaaggctggatagatttcctcgtatggtcgttcccgtatattgtcacgctaggctcgaacttgcttctctcatttccctcgacccagacagctgttggtatttcttaacgacattactagaaatatttattcccatcaatggcacagaaatagtcctagcatatttatggttacagaagtaatccgcaagcgcacgaatataccattgtattattacacccggaaatattccaaggtatcgtatttgtttaatcccaagggaagattgtgaaaaagagagccatgccaatctatacatatatatattacttgccttcatcaaagtctaagcaggggttaatttaatataagggtagagtgacacgaagcgaagcttatagaattcctcatataaataattctaactaagtgataagagaaatagaaagaactcaattcctgtacttctagtatacactcaaactttactctacatttgctagtatacaattatgtggccaatacaccctaatagtgccctactggtgtttcgagagaccaccctgggttgccgagttccttacgacaacctgtcatggccgttcaactggggctaaatacaaaggagtaccctccccaggaatttgccttaggaatatatactaacgtagaagcaataaacgtactgagctatcaccatcagcggcccacctctactgtcccgtagcatatatgctcaattaatgatatttactaacctaagcatcatgcttacattaatgaatacttctatacgcctctgcagatgacatagagcaaccaacgaaccggacattaaacccacaccattgcacatctctggtaagctacccacacaattatatcggcacgaatgtaaagtaagagcagtactcatactaaagaaaataccgaaaatataataggaagagtatttcattaattccgaaagtattacagaagagaatagaaaagctactgaagccataccgaaactcttccgaagactccgagaactccgagaactattctatactacttccacttagcactaaattactaatataaagtatgagaggaatcttgagcttgcttgagtgtgttgagaagtgaagcgagctcctccttttatagggtcgttatgacggttgtacccatgcgagttgtccattttgcccctgcaaccgtcattgagagagcatctgg

SEQ ID NO: 51025 - DNA, 683 bp, Oryza sativa
atattgacttctatatagcttatgttagtgaaccattattttataatcatgtatattgctactgcctttggtaaatccccggtccaccatgacaacatagatgttgcaaagaccatcggtactttcataatgcaaatcggtaagatcgctaacatttgctccgatatgcccgtggtttttatattatctttactgttgatcttttgtagattactataccactatgccatgctctaagctttatcgtggtcatactagaccaagaaggtaaaacactctatatatgagaccctaatccacttattatagaatataaaaataagccaaacatgagatacatcgtaaactattaactattgctgatcacttcaacaaagctatgcggaaggcatgccctagctctaggtggaataaagacatcaccttgtggaggcaaataatcgtcaataatccgtttcttgataggtaagttatcttttaaaaatttgttcaaaccagtaaatttaattgtgtagtgcaagggtagctaactattcaatttccttaggaatttgtcaggtttttttgttcatctcttgatgtgtacatggaaaaaatgaagaactacatttgccagctattaatgtaagacctgacaatcattgatcattcatatattatattatattatttcaaatatttaa

SEQ ID NO: 51026 - DNA, 1103 bp, Oryza sativa
cagtcaatttcgcctaattgctctcatgccattagattcaagcgtgagttgttaaatgccactaaacctatatttacgactcaaagatgcatgtcctcgtaaagttctgttcttttttatttttttattgatttcacgtactcatgtatataatttttttcctttccggtatttaggggctccaaatgtttttattatttttctttcttgaatgtaattaatgctcgtaattatacattaatgtttctaatgtttttctttcttcatttcaattaatttcatttgtgatagtatatcctcaagatattatttgtgctgtcacaaacatatagaaaacctctctatgtctaacctgggagcgttttgatcaactcagaaacattagtaggcatggtggcatcattatttttgctggagagtatgcatgctagaaagctcttccgcatgtccatcgtttcctaacaagacaatgtgtacaaattaaatgtatgataatagtattctgaatatgcattccaatcaaaattaaatctctaggaattattacttacagttgaaaaccagcgaatcagtcgatggccatcccataatcgcataaaattgaatacaaagaacccaccgtcataactaaataaataaatcataggaagaaatgagttaatcacttgacacttagtaaaacatatatcagacaacaagatgattctagtaagaaacattgtgttacaggtcacacctgttctgttgcctaggcacttttggaaactcgtactcccaagagaaaaaacagaacgcaacatccatggttttgttaagagcaccacatacaatttttctgatttcctcatgacgcttcagactatcctgaccaccttcactggcatctggtagagagtccagaatactgagcttcttatcacacatgttgaaagcatatagtgtccagtggaattttttttatttttaattttttttattaaaagttttacaaaaataattttctattttgaaaattgacggaagtagtcgcctaccgccctctgggaaggcgatttttaaaaatcgcctcccagagggcggcgaaaatgacgtggcagacggcc

SEQ ID NO: 51027 - DNA, 313 bp, Oryza sativa
gcctgcaaaattccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggaggcgatttttaaaaatcgccttcccagagggcggtaggcgactacttccgtcaattttcaaaatagaaaattatttttgtaaaacttttaataaaaaaaattaaaaataaaaaaaattccactggacactatatgctttcaaca

SEQ ID NO: 51028 - DNA, 273 bp, Oryza sativa
gggtcattcagccagcggcctttgtagatctcctcatattaatgaggcagtgtccgcctgttcccctgtgtcgcgcgagcggcggctctcgccatcgctcaagggcaatcggtgttttagcgtccgggcgaaggcgcgagttgaagatttggtggagataggcctcgtccccactcagtagaagggtagatgggcagtagtgctcgccgtatccccttgagatataaccccaggcccttgcccgcgtaaggggaggagggccagagaaccaga

SEQ ID NO: 51029 - DNA, 1501 bp, Oryza sativa
tctcatttgcataaatagcatttaataaatatttcagaatttaataaaacagtagagtagagtattaattaaacaatattaatccaacgctatacagcataccctgttgcataggcccaaccgttctgaacaaccaatcccagttgcacagttctatctccaaaccaggaattaaccattccaaaccaggagctaaacaagttattaccaagtacagcatcatttattatggtgagaagtgtgaaactaatcacgaaagacattgttagacccgcccataaccgcgggcacggctatttgaatagttcaaactctggccagaggtgtaccactgtacccacaaggcacaacctcaacatcatgtcaaccatgcgtcgcgatacttgacaagtacccgaatagagattgtgacaataccctctatataatataattcaaagcagtgcactgttcccggatcataatcacccccttataaacaaggtatggactccccagcgacccccgttggcttatctccgccacttcacagtctggtgctctacgatgaaccatactatacagaaagtaaagccgttgcccacgctggcttgtggttggcatggtaaatgtttcacaaccgaaaatcgtgaaccggtccttaattgtcatgagcacgaccatcaaaaccatatgctcacaacccaccattatcaggttttagttggcaaattaattacttaaccaatcatgattaaccatcatgatctatcattaagttatcattaaataatagtgaagcataagttattctagtagtgtgctaatgtttctaagcatggctaagcaatcatatctaatatctagctgaactaatatgtaaagctcaactagtcaaattataataacccacggtatcaaagaataaagtaatcaagaacaaaaagggctataacaaaacaataggttatttccacccaatgacattcaaaaatatatgcagtagttgaatagaaacaatagctttaaacaggatcaacatgctcaaagggttgtttgggatctgtgtgacttgtcttgctggccttggaactcttcaaactcttctcctgcaaatttggactctccgggaacgtcggaatctaaagagaaaagagcaaaatcaccaaaacaacacataaacaagcatgaacagtacatgtggatatttttaacatgtagatctcaattttagaaaaatttagagacttgaaccaactaaatccgagctaagatgaattagttatgaattttcaaagattaaatcagattaaatcatttatatagattttaatggaattatgacgcaataatgaattatttttgaaaagaaaaaggggattattgcatcagcggctagggtttacggtggaccgggtgcacggcggcggctcacggaaacgaacggccgaggtcgatcctatccaaaacgaacggccgagatctaatcggttcatcgcgggtccacggcgaccggcaacga

SEQ ID NO: 51030 - DNA, 194 bp, Oryza sativa
ctcacttcgtgattcgcgcggcgattttttgttaattaatgccaatattggcacacgagggtgcgatgttttctactggaatcaaaatgttgaaaaagagccaaaacatgatttttggacatattggagtgtatcgggtgtgttcgtggcaaaaacacatttcgtgattcacgtggcgaacttttatcaaataa

SEQ ID NO: 51031 - DNA, 496 bp, Oryza sativa
ttgttttggttcatctctgtttttcagtcctttaatggaactgtcatgtcacagattgcaggttatggtttttggtccacttgttaggttacccaagacaggttatgattctggtcttatttctcagaaaggagcatagaagcatttagacagatcaaaaggccgtaaaagatgccaccctcaccctcaacaaggagatctccttcaaggaaactttcctcaggagggtcaacagttttgggaatgctctgcctgctaaaccaaaggatgaggatctcactttgtttgctgatatgcagaaaattgagaacgataatttcttactggaaccctctgaggattttgatgagtcaatctgtaatgctcttataaaccattctcgttctcgtcctttatacaatacttcagtttctataaactattttccgttataatactgcctagtgttaaaaatgttttctactgcaaattgccattaatttcctttgtaaaacaa

SEQ ID NO: 51032 - DNA, 1501 bp, Oryza sativa
ggcggctcgaacgcgcatgctcgccagcgaacgacggcgcggcggtgcaaacggagggcaccagcacgtagagggcgacgcggcgatccttaccgaggcacgaacggcggcgagcagcgaccggacgatgacggcgacgaggaagaagcggcggcgacggtcagctcgacgacgacggcggccttccaacgatcctcggcgacgacggaggggtggacgaggacggcgacggcttggcaatcacgatagcggccttcccgagcgacgacgacgaccggagcgacggcggtgctcggctaaactcgcggcggcgacggcggcgcacagttgaacgcggttagagcgctacgagcggcggcgagctaaggcgagggtggcggcggagagaggagggctcgggggtccttttatagcggctagggggcggcgaggaaggcccacggcgctagagctctaccggcggtggaaggcgaaggcgagggaaagttagggttcgggagaagaaaacgaatccgaatcaaactcaaatccgatgatttccaaaccgaattaggcgacgattccaaaagagaaaagatagaggagatcaaggggatcatttcccctctattgatttcacaggagaaggaaaggcgcggccgaattggaagggcggcggcggcgcggctcggctagggttcgggcgcgaggaggacgatgggtccgacaggtgggacccacctgtcagcggccaagggcgcgcgcgcgcgggcagctgcgggcagactgggccgactaggccgggaaagagagagagggcggttttgggccgactttcggcccaaagccaaaaggaggatttttaaaaccttttcaatttaaattattcatgaaatgcaattccatttattaaaaatacttccttggttcaaataaatcccagaaaaatctaggaactatagaatcaagcaaagtatttaataaaattttatctggcccacttttatattggaatttattatttaaaattagatcttctcttctaggcttttaaaattatttctaataattccagttaaacaacaatttatataattaaggctttttagggtgtgacagcatttagatgacattttgacttgtatatgagaaaaaagtttcgctgctagattggtttgtggatccccaaattcgagtgcttaatttggttgcaatctatcttgttcttgcttgtgttcttcgattcgcatgcagtgattagccttcttggcgaggtcaaccgggttttggcatggttgataaccagaggagacgtggtgctgccattgcggggatcagtagcgtgttcgttcagaagccggatcaagttgtgtcgtgactccgtccaaatcgactgtttaaaaatacctatcagaagattgggacctaacaccctcatcaaaatggaaaaggagggcccacatgttaggtgtaactgtccggaagctgccttaactatcaaaaccgccatgaggacccacct

SEQ ID NO: 51033 - DNA, 839 bp, Oryza sativa
attaatctgttgaatgtagtgcaaaagcccgcttatcaactcttgtttacatatcgcagataccatagatatttgtgaactatattttttgttgacttcatgagtttcattgatgtcccttatagagttgaatttccattgacgattacccaatatcacaacatcgtcgtcactgtctttggtatcttcgctttgttccccggtagtcatgaccgccttatttgttttgcaacataataatacaccgggcactttgaacctaaaaggtgtaatatcctcctgcgcattaaaaggtaaatttggtttataaaaaatagataagatatatggtcaactatttttttttaacaaatgcacctgtgtaatagatgagaaagtgaatctcctgtccaattctccataattttgagcatgaacagtccacatgaagaactgtattgtttttaagtatgagtaaaactattaaaaactaaacaagagtacaccaattaaaatatatcattcatcttatattaatattacatgaaaattttaatataagatgaatgatatatgttaattggtgtactcttgtttagtttttaatagttgtactcatactttaaaacaatgtagttcttcatgtggacttttcatgtctcaaaattacggagaattggaaaggagattcactttcgcattctattacacaggtttttaataaaaaaatagttgatcatttatcttatctattttttataaaaacaaatttactttttaatgcgtatgaggatattatatactttttatgttcaaactacctggtgtattattatgttggaaaataaataaggtggtca

SEQ ID NO: 51034 - DNA, 1501 bp, Oryza sativa
tttgctatgaacgcacccaatacactccaatatgtccaaaaatcatgttttagcgctttttgaacattttcattccggtcaaaaacatcgcccctatttgggccaaaatatgccaatattggcattaattgataaaagttcgccgtgtaaatcatgatttgagtttttgccattaacgcacccaatacactccaatatgtccaaaaatcatgttttggcattttttgagcttttttattccggtcaaaaacatcgcaccctcgtgtgccaattttgccattaattgacaaaagttcgccgcgcaaatcatgaagtgagtttttgccatgaacgcacgcaacacactccaatatatccaaaaatcttgttttggcgttttttgaacattttgattctggtcaaaaacatcgcaccctcgtgtgccaacattggcattaattgacaaatgttcgccgcgcgaatcacgaagtgagttgttgccacgaacgcacccaatacactccaatatgtccaaaaatcatgttttggcgttttttgaactttttgattccggtcaaaaacaacgctccttcgtgtgccaatattggcattaattgacaaaagttcgccgcgagaatcacgaagtgagtttttgctatgaacgcacccgatacactccaatatgtccaaaaatcatgttttggcgctttttgaactttttcattccggtcaaaaacatcgcccccatttgggccaaaatatgccaatattggcattaattgataaaagttcgccgtgtaaatcacgaattgagtttttgccattaacgcacccaatacactccaatatgtccaaaaatcatgttttggcgttttttgagcttttttattccggtcaaaaacatcgcaccatcgtgtgccaatgttgccattaattgacaaaagttcgccgcgcgaatcacgaagtgagtttttgccacgaacgcacgcaatacactccaaaatgtccaaaaaacatgttttggcgtttttgaactttttgattccggtcaaaaacatcgcaccctcgtgtgccaatgttgccattaaggacacggatagagatggatgaagtcgttgcgacgatggatatctctaaggcaaatgaaggctaaacgagctgcggctcggtaatcgagatatctaggcaaatgaagactacacgggtcggtgcccgttagtcgagatgccatggcactggactagtacgcgggtggtctcacccctatgcgtgtggcgcacccggtctagatcctgttgctcggggctcaatcctggcctgcctgtcccgggataccggctgtaggcagggttgggtcggtacttttgttcacggctaggatgggtgaagggttatgtcacatgtttacgacgggttccaaggccatggaatgggatgtcaaaagaagcaccatctatcgactcggctgacaaggagattcagccggaaaagactgtgccgtaggagtactgcgacacacggt

SEQ ID NO: 51035 - DNA, 1501 bp, Oryza sativa
ttgctcaacttgtagaaagcaaaaaaggtcttttggatgcttgcaaaaattgtgttactcttactcaggaggtttcttatttgaaaagttctttgcaaagattttctgatggtaaaaagaaccttaacatgattcttgatcaatctaagtttagcacacacaatcgtggtttagattttgattcttatgcttatcatgctagacatcctcctactgttttgggtgttgctaggagaggtgaaattttgattgaatctgagcctaagaacactgtgtttaaatctgctggcatcatgtcttctttgaatgcatcttcttcgaaatcaaatgttgtgaatgcaaaaccttctgttattgcaaaaccatcaatttcaaaaccatctacttcacaaacttgtcgtgaaaagtacacttgttctttttgtggaaaagatggacatttggttggtttttgttttagacttgcccataaacacaaaaaggaaagcgaaattgcttttgcaaaacgacgttggcaaaaatcgggttttaattcgaggaccacggttagaccgacactgatcagtcggtcagaccggctagcggttagaccgcagttgaaccggcggttagaccggttgccaggcccggtcagagcgcaggcacaacggcggtcagaccggcctcggggtgattttgcacgaaattcaaatcggacttttgtgaagcaaaaaggtaagttttctggtaagtctgattctgattttgtaagtgcatatgtacctactggttctagtggtcgtgtgactcagtgttggattccaaaatttcttatttctaaccccaacacggaggcctcgacatcttctcattcgtaggtattttggcggcatactccccatgagtgttcaattttgagatgacgattgcgttgcaaggtaacatcactttatttttggattgacataattttgatctactctcttgtttattagctttttcatgctagtatttgaggttgtagttttggttaatactattggatgtatgtcaattcttgagaattttggtgatatcgttggtaattggatgtttttttcaaaatctttgatttcttcttgattttttcggggagaattggaggttattttgagttagtgctttttatgaattccttttggcatgatttgagggggagtttgtacctcatggttttatcaagcaacgatgtgacaatgaaaaaattaataaaagagagctttgtttatacatatgatattttcttatgcatgctagcaatactttgaaggtttatttgtcttttcatgagatttagattttgcttttaaaggagatgatgcatgatacttaaattctatacttgaattaagtaaatatgcaatgttgatgctagcatatggtttgatttataaatgctctatatatatgctttattgaattgttattcctcaaatagctttaattgctcattgtgaaaagagaataaaaatatgaaaaaaat

SEQ ID NO: 51036 - DNA, 1501 bp, Oryza sativa
atgtcacaaaacacgcactacggatggtttgtcagtgacatgcaagctaatgctcgatgacctttatccatatatattgggcttggaagacaccggaaatctttgatgcaaggtgagatattgataggggtcgagatcaggagacacttttaatgtctgcacgcatctcgttgacggtcacatgtctctacgcgatgaaccaagcaacatccaccgtgagcaccggagctacggagttcctgagaaagtctcagccgagataaatccactcgatgccatgtgcctgcctttcgcactgcttcttccaatggtcgatgtcatatgtgttcatgaactcatcaacccatgccccaagagcctgtatcagaaataaaattattctcgtttgagattataatgtgatttcagagttgaatcaactcatgtatcggaaatttcatttcattttcttcttttctatctgaaccatccagtgggtaggtgccgactcaccttgcctcatccaatcgaaaagtcttacataaaaatagcaacaatgttaaaagctttgcgtcagagaataaattcggatctgttagaaatttgtcaatatattttttttgctaaaaactatcgattacttagatatgagttatgatttgtgcatttgtttgccctctctatatacagaagtttaactcctcacatttcacacggcaatcgttaaactctatgtccatgttagtaatacggactctagcaggagcattgtattctctacctcatccgccgtgaagatttttcgctgcccaacaagagaatacttgagcaactagactactgtacacagagaatcagagataacaccaaaagaaaaaactataatgtagttttgctgtacctaaaaaattacagtatagttacattatagcattatagttacaatgcaactttgagtagatttgtttgtaattttattttcaattttcaaatggaaaataaattacgttatgttttctagtaagctagtttgacgtagtaattagcaagttaatggcttttatgattactctatttgttatgtaataaatttgctgttaatcatgccgtctcaaaaattgattgattttggtaaagtaggataatcaggctgtacaattcaaatatagcacgtgcacagagaccatcctggtcgttgtgcatatatcctgcggtgggaaaaatactaacagttttttgctctaatttctatcaaagatatatagatagtccattttatttgcttttgtgttgttgattactaatctctgaccacctcgacatcgctcgaaaataaacggagagatttaaatcttgtggccacttcactgtcctgaataattccggatcctgacgtttaacactctgaccccccttgaccatgtctgcgtacaatctatcaccagcgacttcgcatcatcttggcaaaactcttaattttcagattaacttttgtatgacgtgaatgtatgatattatagtt

SEQ ID NO: 51037 - DNA, 1501 bp, Oryza sativa
cctcatcttggtggggcgcgtcaccttcccctgcattgttagttgcaagcaaagcataggtttcttcatctaaatcactagcggaggagtacccaccatcagctctcacgatcattacacgagtgcttgggcagtccttgcgcacgtgaccatagcccttgcagcgtaggcactgaatatctcttgtccttcctgatgaagctactgatgatgagctcttggaaggtgtagcagcaacccctcttgttggttcactcgggcatggtgtagagtttgttgtagagggacgcagcttgttgcttgaggacgatggtgctgctgctcgagttgacggtgcagcagcgttgggagatgtccaagagctagcacaacctgcagaaatgttagtcctgaagctagctcttcgtccctgtacttccctttcagctttacaagcaagatgaaacaaacgattaattgaattatattctttgtaggctagaatgtcctgaatttctcggttcagcccacccatgaatctagccataccagcatcatcattttctaccaatccacaacgaagcattcctgtttgcaaagcttgataatactcctctacagatttgtttccctgtctaagttgttgcaatttgtgtagcaaatcacgtgcatgatatgaaggaacaaatctagctcgcatgactcttttcattgcatcccaggtttggggagtgttatttggattggaacgaacaaattcactccaccaaatggatgcaaaatcagtgaactcactagtagcagccctaacacgtttattctcaggaaaattatggcaagcaaatttctgatcaatggctaactcccaagtaagatatgcatcagggtcatattttccatcaaagcaaggaatggtaaacttgatcttgcctaaagaatcatcattatcacgtacctcccgccgtggtggagcgcccatgccatggcgctgccggtgctgttgtctttgtggacgaccaagtacctcctcattatgctcagtgtcagcagcgtactccagttcttcccttgctgcgatgctgctattagcatcatggccatgtggttgcgcctagccgatccatcatgaccatcttggcccattctctctaacgtattcaagatacctgcaagagaagtgttcacagccacaagggacatctccaatgaggaaagcttggagttggtgtcaatttgagcagcctccaattgaccaaggcgatcattggcgaccctaacatcctcatcaaggccttcagcatgctccctcacttggcgctcaaaatgttgtatgatgcccctcgtacgtggtgaatgttgagggtgctcccccgatcctcctgtcatggttaatgggaagaaacaattcacaagaaatatgtcctatcaactattggagctaggtgttgtccatctccacttctaccaaacttgtgcaaacgagttcttacatgttcttactttgttatgtaaaaggcgttgg

SEQ ID NO: 51038 - DNA, 1501 bp, Oryza sativa
cccacggagaggtgtatcgatcgctaaggcgcaacagaacgtcttgtacggttgtagtcggatcgtcaacgtttctcccaaatcgtagttatcacaactcactgaaagatcgggccaacaacagccttgagtgtcgagaggaactcagggttcatcacgttgcctcaaagaaagagacagccgaccattggcctggccggttaggccgaaccagggtgttcggccgaacccctggtgggcccaaccggccccactttcagccgttggattccaacggtcagtgtggtcgtggcacaataaattttcattgaaaattttattttggtttgctctggaaaattcatttgaagaatttcctaaaaattcaaaaagcctaaatgcattttgaaattcaaatatgtggtgatacaaaaatttaaattgttgaaagcaaatatgcggatacatacctcctttcggtttagtgcactgatttttcacccgtctccggaggtgatggagcgggcatctttagcttttccttccacaccttttttgattttggtgcggatggcggcttcttctgagccggctgatctgacttcttggccggtacgggtgattttaccggcgttttccaataacggttcctgggcatcgttgtttccttctccaggaaattctgcataaatatcaccaagctgtccgttttgggtggctccacttcgaccacttgaatattctacggattcggcccgtactttattctgaccatggagcattgttccgtccttggttgaaactcaaacttttcctccttcccgttgatatggaaacggatactccccgttcccacgtcaatgttggctcctgcggtactaaggaatggacgccctaggatgagcggcatctccttccccatgtccatgtctagcaccacaaaatcaaccgggatgaagaaatcccgtatcttgactggcacattctccgctattcctgctgggtaacgaactgatgagtcagccagttggaggcgcatcggtgttggttccaacactgtgaagttgagcttgtcgaagacgtcttttggcatgacgctaacgctggctccaaggtcgcaccaggtctggtcgaattgttgtgccccgatcgagcaggtgatcgtaggacaccccggatctttcttcttctccgggagcttgtggagtatcaggttgctgcattgttccgtcagcttgaccacctccgttgttggcagcggtctcttgttgttgagtatgtccttgagataacgggcgtatgttggcacttgcatagcatccaacaacggcactttgatgtggatcttctggatcacaaaacgagcgaactgctcgtcctttcgttggggaaacagcagcaaccgtgtgtcgcagtactcctacggcacagtcttttccggctgaatctccttgtcagccgagtcgatagatggtgcttcttttgacatcccattccatggccttggaacccgtcgtaaaca

SEQ ID NO: 51039 - DNA, 1501 bp, Oryza sativa
ttctgtcggttagttttggagttcttgtgttgcatctagagtttgcctatccttgtgtgtgtttgtttttgccgtgcatgtgcgcgtgaggaagaagggagaagatgcacatgaggaagatggaaggagaagattagactagattagattgctttcgtttctatttggggccacgcagaaaaggaatcggtttccttccttcagaaattctcaccgagtcccaccaccttccatgcggcattccccccttgagtccgactccctctcctttcggttcaatctacaccgtgccatccttacaccttggtgaatttttgtttggtgttcgtttcgatatccgttcagaaaaacggaaccagtataaattcagcattccattttgtataattttaattttggttttagacttttacatttgagtcactgtaaattttatatttatgtttgagtccctatagccttacattgaggtcctcgaatctgattttgtaaaataaaatcaaaaaaaaagaaagaaaaataggcagaaaggtgcataaaaaaagaaaagaaaagccgcacccaaaaaaaagaaaagaaaaggaaaggaaagaaaagaagaaagaaagaaaagagaaaaaactgttatgtttgagagctgaacttcatatatcagagttgtgcatgagttgttcctagtgctgagtctgactccctccctctcacgtcggtttcgcctgttccgagttgtgtcaaacacgttggtgaatttttgtttcgtgtcggtttcgagatccgtttcgaaaaacggaaccagtataaattcagcattccatttttgtataatttttaattttggtttggacttttacagttgagtcctagtaattttcatatttacatttgagtcccggtaatcttgcattgaggtccttgagttgtttttgcagaaaaaaaaatacaataaaaaaagtaagtaaggaaatggcaggaaggtgcataaaaaggaaaaagaaaagaaaagccgcaccaaaaaaaaaggagagaaaaaaaagaagaagaaagaaggaagaagaaagaaggaaaaaaaatcagttgtatctttgagctgaacatgatctatcagagtgtgcctaagttaaaaaaatcagttgtatctttgagcagaacatgatctatcagagtgtgcctaagttgtttctagtgctatcctgtggtatcgtttgtgtctaggctcgcgtctctagtacattctagcctaggaccagcacggtgcttgactttgaactttttcattccggtcaaaaacatcgcacctatgtgggccaatatatacaaatattggcattaattgacaaaagttcgccgcgcgaatcacgaagtgagtttttgccacgaacgcacccaatacactccaatatgtgcaaaaatcatgtcttggtgctttttgaactttttcaatccggtcaaaaacatcgcacccgtgtgggccaaaatatgccaatattgacattatatgaca

SEQ ID NO: 51040 - DNA, 202 bp, Oryza sativa
cggcggctggacaacgacctgcgtggccggagggcagcgggacggcggcgtgcagaggccattcgcatggaagaggatgagggagaagaaaaggggaactttagtttgggttggcaggggcattttggtattttctaaaaattctgacaacacaatacacggtttgagcaacgtatctaatggaaacttaacgggaggggca

SEQ ID NO: 51041 - DNA, 1181 bp, Oryza sativa
tgttaacgaacacgtgaacgagaacgaacacgtcaacgtacgttgccgtgagaacgtgaacgagaacgagaacgatcgaacgaacgagagcgagaacaagaacgatcgaacgaattaacgtgaacgagaacgacaacgaacgtgaacgagaacgaacgtgaatgagaacgagcgaacgaacgtgaacgtgaaatgcaatatatatatgttacttctcatttatcctaatacatattttttgtatcttgcagaaaagacatgttgtcggagtcgtccctcaagccggagtagaagagctagccctagaaggaattcgtgcaggcaagtgacgtaataatataaatgattgttatatttgtaatgcaattaagaatattagacttgtaattagacttagcatataagattgtgtagtgttctaattttatttgagttttaatataagattattttattgcaaattagacttagtatgtaattattgactacagaattggttcgactcctagcaattgactattgtagtcttaattagacttagcatatacgcacgaaacacttagcatacatgactattttagtcttagcatgtaatattatttgagttttaatataagattattttatttgtaattagacttagtatataattattgactacggaattggtgcgactcctagcaattgacaattttagtcttaattagacttagcatatacgacagttacacttagcatacatgactctttcagtcttagcatgtaatattatttgagttttaatataagattattttattgcaaattagacttagtatgtaattattgactacggaattggtgcgactcctagcagttgactattgtagtcttaattagacttagcatatacgcacgaaacacttagcatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacaga

SEQ ID NO: 51042 - DNA, 205 bp, Oryza sativa
acagtgttcacaatatatattggggcccatatatcactgtgctagtaataacttgtacagtaatatggctgggcatgcatgcatgggccaagatgaagctgggtgtatatattactatgtcaatgtgggctccatttatgcatgtaacttgatcactgtttaattcatatcttttaataatttctcttatctttttttccctagc

SEQ ID NO: 51043 - DNA, 1501 bp, Oryza sativa
gctataactggtaataatttgtttagctcctggtttggagttagatctgtatagccgggtatggttgttcaggatggttgggcctgtgcagcatgggtgtgctgttcagtgttgattaaaatttctgattaattactctactattttactactcttagctctttgctaaatgctgctttcgcaaataagactatattatgccatcctttggtatccttgtgcatttgcatatttgctgtgtggcttgttgagtatgtcatatgctcattcttgcaataattaatcaacctcagttgaagaaaaaggatccagaaggagaaggcgtttggcttataccccagttgagctgcctgtgggagtagagctgaagccatcgctagaccgttattccactgctattttcttttcttttgtaagtatgtaacgttattatgatggatttgtatattaaattgtcagtttgtgtacctcggctgattcctggacgaggattttatgcacaaattagttcggaaattattagtgaatttccgggcgtgacaatatctgatttaattttagtttgtgtgagattgagattctcaaagtttttaaatttttcataactattggattggtatgctccggcaatgatcttgctataatatgactccttaatccatcacaagaattatgagcatatacgttttttctttgtcaaataggtttggtaacaaatgaacaatcctatagcatgagtataaaactattcaccatatattttgttatagttgaggaattataatataacaatcataaaccaaaccataccatagtgacgtaactataagtacacctcaacaaattagttattataaataattttgggaaattaatacaattttagaattactaaaggtgtatcatgcaattatggacaacaagtgacgaaaacaaacaagatgctaaaatatagatctttcttgaatataaacaagagtaaattttacaaaaccgcaactttagcgtcaaaactatcagtttgctgcaaaattagcgacatgtttcagtttgctgcaaaacaaaactatcaatttgctgcaaaattagcgacatgtttcagtttgctgcaacaatagcgtgggaaattatcacaaaattgtaacttttatattatatgctactacagttgtcacggtcacgtgtttgtttagctacatatatttttagtgattaacctcactcatttctaaagattacattgtatttgtaccataaaaaaataagcagttttgattaacaccataaacaaaattgtgtctaaacaaaacataaaaaaactatattttatgggaagaactgaagagctatttgcatgatatcaatcttctctttgtttccctagagggcaccaagcatagataccacaagtatagcatgtggcacacatattaatgaggacatcacttcgtcggatacgctcataacttcacatgttccaatgataattccaagtccaagt

SEQ ID NO: 51044 - DNA, 1501 bp, Oryza sativa
gtaagttgggggacgccggatgtccggttttgcggttgagggacgattttgtatctggctaacaagttgagggaccttgcgtgtactttttcctaaactgtatgctaaaagctaaattggtaatcaacaacttactaatattttttccctctttctttttcctccatgtcataaaaaatcataggtgacatcttctccttagacactaacggtacgcaagtgtccatatccttacatttccttacagcatattgagtaataagtagcaaatgaataaacaccaatcaactagtggcaaacgagtaattttatctttcatattactcccctcaaaaatatatttagccaatgtgataatacttttcgagacaaatctatttatatcatttgatttggctgtaaactaagcattcgagaaatcatcgatggccgaaatcttaaaggataaatatattgtttttatcggagggagtattcctctacgatcttttgagacgtccggtgttcatgctcatcaatttcgcttacggagtagtactgaacaaaaatagagacaacggtattttattacggacgatctaggacaagaaaaccccccggcgccctccctgccacggcgcaccgcactgctaccgaccgacgggtgcacggcgcggacagcagcagcaacgtgagttcgtggtcgtggaccacccaccgaaagcgacgtctcaccagcacacacacacaccaccacgtcagtcggttgccccttccctttttacccatcacctcactccaccttcttctcacgcagccgcagcctccgacccccatgtgcgttcgttcgtttcgcgcgcgcaactgtgaagccgagccagacaaattaaaaacaagaatacaaaaacagacaaattaaaaaacaagaatacactcaaaaaccaaacacggttgagaacttcagatacatccatctaggtaagcgacggagaagccgaagccgatgcgttcgcttcacctgcctcgtcttcttctcctcctcctccgaagatcttgacggtcggccagttattatcactgcccgcttcttgcttcttgcagacttgcagttgagttaattactgcggctgtgcaggagaaatggcgtgttttggtgggaggagtatatccaaagtttggatctaaaacttcagtccttctccatcatattaatctatcatagtatactagttgctgctcctcgctgcttctgcgtctcctccacgagaccacgaccgacgcccccacatgggtctcatggtggtgtgagctgagctgcttgctgctcaagtggtgagaaggtagagagagagagagagagagagagctgagctgcaagaaaggctcacccatcgaggacaccaaaacaagtcaagaacgaacgactcgtgatccgtccatgggttgctctcctgtcaggcgcatgagattctgaggcggaggaagaggagagaaaggaggaagaagagcaagatagcggcgg

SEQ ID NO: 51045 - DNA, 1501 bp, Oryza sativa
gccgccgtgcacccggtccaccgcaaaccctagccgctgacgtaataattgccttttccttttcaaaaataattcattattgcgtcataattcaattaaaatccatataagtgttttaatccgatttaatctttgaaaattcataactaattcatcttagctcggatttagttggttcaagtctctaaatttttctaaaattgagatcaacatgttaaaaatatccacatgtactgtttatgcttgtttttgtactgtttatttggtttttattagtctttttcttcgttttgcgtgttagcttgtcgtttccgttattgcgaaggttcgtcagtgcgtcggaagtgttcagaagattaattgaagaccgattattgcaaggcaagtcacacagatcccaaacaatcctttgagcatgttgatcctatatttaaattctctatttatttcaactgtgcatttattttcgaatgtcactgggtggtgtaaatctattcctttgttatggcctgtttgcattgattactctattccttgataccttgggatattataatttgactagttgagctttgtatatattggttcagctagatattatatatgattcttagccatgcttagaaacattagcacactattgggataacttatgacttactattatttaatgatggcttaatgatagttcacgatggtcaatcgtgattggttaattaattacttgccaactaaaacttgataatggtaggttgtgagcacatggttttgagagtcatgctcatgacaattaaggaccggttcgcgagctacttttgtgaaacattaaccgtgccaaccacaagccagcgtgggcaatggctttaccttttgtatagcatggttcattgcagagcaccagactgagaagtggcggagataagcccacgggggtcgctggagagtccatgtcttgttttataagagggtgattatgatccaggaaaggtgcgctgtggtggattgtgttctgcgaggggtactgtcacagctcctttccaaggtaccgtggtggtattgaggcgcatggtgacatgctgtggggctgtgtcttgtgggtacagtggtacacctctggccagagtaaaactattcgaatagtcgtgcccgcggttatgggcgggttgagcaatgtttttcgtgattagtctcacacctctcacaataattattgatgctataactggtaataatttgtttagctcctggtttggagttagatctgtatagccgggtatggttgttcaggatggttgggcctgtgcagcatgggtgtgctgttcagtgttgattaaaatttctgattaattactctactattttactactcttagctctttgctaaatgctgctttcgcaaataagactatattatgccatcctttggtatccttgtgcatttgcatatttgctgtgtggcttgttgagtatgtcatatgctcattcttgcaataattaatca

SEQ ID NO: 51046 - DNA, 1501 bp, Oryza sativa
gcatgccaccaaacaaatctgaacaaacatatcagaaatataagcaactgtgcatatctacaaaatattttgacaacctgaaactatatctacatttctgaaatataaacatgtattctgcaccgaagtgaccttggttttgctactgctgacacgcattagactgagttcatgcctaattatcttaagtttgccatagtctgagattttaaatgtacatgtcgactgaaactgtgcagtaccctgttcccaaaattcaaaaattcaaatagatttacgattgtgcagtcgtgtgatcccctgtccccaaattcaaaaataggccaattcaaacaggttaacaattgtgtagctgtgcaatcccctgttcccaagttaagaaacaacgccaactcaaaaggatttacgattgtgcagcaattaacagggaacagaaacacaaaacagaagaaaagcagtaggtgaatcaacagccataatttctcaaagcaacaggagccaagtattggcttgctgctaactcatttgaatcagcacagaagaattcagaacatgtatagaaacagaagaatccagaacatgtatagaaattttgtaaagcaaacaacacagcaggataccatctgaataattcggaagaaagcatgagcagaagtgcagaacacatgcagggaattgggtttaatttaactaaacaacttagaacatactgggacatacatctctgaaatgaaatgcttcaaatgtagaagaattcagacacaaacagggagttgggcaattaatcaaccaaacaacaggcagtatactagaaaaagttgcaacgaatgcagcattcagataaagttgcactaatgttttcccttctctattcaaatcacaccataatccaagcaaattgcaaccccaaacttgcacggttgcacccgatacaaattcatgaacaggaaaacatcgagcactgaaatgttgcaaaacctgcaaccagatctcttggactagaatcccaccattccaattaaccaaacgatcaagaacatactgctagatctgtccatgcatcactcaaacgaaaaatgcttgaaacacataagtcacataacatactaggggggatcaacccaaatgcatatctgaaacttttctgaacaaatgcttcagatgcaacgcagaacatacatactagggatcaatccaaatgggatgtctgcaaactatgcaaatatgtactgtgcagatctgcaataaatcaaattagcacgatacaatagaccatcagatctagtgaacataactaagaaagagcacacatatatcacggttcgccatgaagagaaagcattagcgcctccatccccagatccacgactatacatgcgggatgaaatcaacgaatcaaaccccctataaatctaggagaagaacaacaaccaaacctaaaacaatttatatggcaaacaccatgcgggatctaaacacaacatctaaaatgccccaaaaa

SEQ ID NO: 51047 - DNA, 235 bp, Oryza sativa
cgaagtcgggcgtggagacggtgaggtgggcggcggcggcggcggcggcgggggtgtgaatgggaacggcagtcagcgggggaaggggaggggagcgaatcgagggcggcgagggagaccgggacaggaaggggagcgccgccgttggagaaggccggcgaggcagtggcgcgcgaagccggcggcacggagcgggacggggcggtggcgaacgacgacgacgacgatggcgaca

SEQ ID NO: 51048 - DNA, 1501 bp, Oryza sativa
ggatggcataatatagtcttatttgcgaaagcagcatttagcaaagagctaagagtagtaaaatagtagagtaattaatcagaaattttaatcaacactgaacagcacacccatgctgcacaggcccaaccatcctgaacaaccatacccggctatacagatctaactccaaaccaggagctaaacaaattattaccagttatagcatcaataattattgtgagaggtgtgagactaatcacgaaaaacattgctcaacccgcccataaccgcgggcacgactattcgaatagttttactctggccagaggtgtaccactgtacccacaagacacagccccacagcatgtcaccatgcgcctcaataccaccacggtaccttggaaaggagctgtgacagtacccctcgcagaacacaatccaccacagcgcacctttcctggatcataatcaccctcttataaaacaagacatggactctccagcgacccccgtgggcttatctccgccacttctcagtctggtgctctgcaatgaaccatgctatacaaaaggtaaagccattgcccacgctggcttgtggttggcacggttaatgtttcacaaaagtagctcgcgaaccggtccttaattgtcatgagcatgactctcaaaaccatgtgctcacaacctaccattatcaagttttagttggcaagtaattaattaaccaatcacgattgaccatcgtgaactatcattaagccatcattaaataatagtaagtcataagttatcccaatagtgtgctaatgtttctaagcatggctaagaatcatatataatatctagctgaaccaatatatacaaagctcaactagtcaaattataatatcccaaggtatcaaggaatagagtaatcaatgcaaacaggccataacaaaggaatagatttacaccacccagtgacattcgaaaataaatgcacagttgaaataaatagagaatttaaatataggatcaacatgctcaaaggattgtttgggatctgtgtgacttgccttgcaataatcggtcttcaattaatcttctgaacacttccgacgcactgacgaaccttcgcaataacggaaacgacaagctaacacgcaaaacgaagaaaaagactaataaaaaccaaataaacagtacaaaaacaagcataaacagtacatgtggatatttttaacatgttgatctcaattttagaaaaatttagagacttgaaccaactaaatccgagctaagatgaattagttatgaattttcaaagattaaatcggattaaaacacttatatggattttaattgaattatgacgcaataatgaattatttttgaaaaggaaaaggcaattattacgtcagcggctagggtttgcggtggaccgggtgcacggcggcggctcacggaaacaaatggccgagattcatccatccaaaacggacggccaagatccaacggtccacggccagaccacgag

SEQ ID NO: 51049 - DNA, 1501 bp, Oryza sativa
atcttggaaactgacaacgttcaaggctctgtcacaacaggagctgtcgagatcaccctgggcagcgacaatcaaggaagcgaaagggatgatgtagtgtctccaaagtgtgcaggtttgcaagatcaagagggaagcaaataggattgctcatgctttagctcaaatggctatgaggtctagatcgtgtgaggagtggaagttgtgtgctcccgcaggaatcttagacttgatagaccaagaatgtaatcctctcttccgaaatcaataaaattccctctttgaagtaaaaaaaataatatttttaacaaatctatccatcgtttttataatattgaacatatatgagtacttatcaatatgttccacattaaagtgtgggtatcgtttgtttcatgataaaggaacttgttgatgtaaaaacacgaggcttgggagatctgcttaactccagtgcaggtccaaaatatcttgcctttaggtttgagggcgtgacagttgatttgatcctacaatcaacaagaaacaggaataacagttaatccataaatgatagccgatcggccggacgccgatgacgtatcatttatactcgagccgatgtcatctttgcatcgatcggctgtgcgaggcaataataaaggaactaaatctattcgatcggctgtagttattaacagtatataatctttatgtcgatatatacttaaatcaagtgattgggatagatcggtcgccatgccgagacagtataaatcacttagatcgcaatatgtattaacaacgagattatatatgttcatagcatagccgataagatagatctagcatgtatcagctaatactccgatactactctatattaagatattaaaacgagtaaaatatattaaacaagaagcttaacatatctaaaagcaataagatctcaatataaagggcgaatcaagcatatcaattaagcacatgaaacataaggctaaatcaggtaagatcagctgaaaccccgacactaccctaatcaacaaccaagaagcaggctagagattataattctaagcacgacttatgaggtcaaactcaactgatgcaaccataagtatgaaaaaaaagacaatatctagacaatcaagctattggaagcttcatagagtggtagatatcttatataatctaagccaacgtcgatatttaacctaatcggctgctccctagtgatagatattagccgattagaggttagatagcgatattgtcagagattatataagatatatgataactcgacaacttacatggacaggattagagtatcataatgatggaagcactaatcccgagaacacaagccgccataacaagtcatacctctagttgaagatcgaaaccgatgcagctcaacccgaaagcaagaactcgtcgaaacaaaatgaaaacaaaagggtggcgatgcgccgaaattgtattttaacgtgtgttaattgattacatggggctcggg

SEQ ID NO: 51050 - DNA, 1501 bp, Oryza sativa
tgtttaattggaattattagaaataattttaaaagcctagaagagaagatctaattttaaataataaattccaatataaaattgggccagataaaattttattaaatactttgcttgattctatagttcctagatttttctgggatttattgagccaaggaagtatttttaataaatggaattgcatttcatgaaaaatttaaattggaaaagttttaaaaagtcttcttttggctttgggccgaaagtcgacccaaacctctctctctctccttcccggcccaggtcggcccgcagccgagcgccgcccgcgtgcgcgcgccctcgcccgctgacaggtggggcccacctgtcggactcgtcgtcttcctcgcgccgtcgcccggccgaaccgtagccgagctgcgccgccgccgctcttccaaattcgatcgcatctttccatctccggtcatattgatagaggggaaatgatccccgagatcccctctaccttttctcttttggaatcatcggctaaaatcgtttggaaatccgtggattcgatctcgaatcggatttgtctctctccgaaccctaacctttccatcgccgccgccggtcaccgtgggccttcgccgccgccccctagccgctataaaaggacccccggtgtctcctctacccgccgccaccctcgctttcgtctcttgtcgccggtagagccctagcgtcatgtagcctagcgccgccgtcgccgtcgttcgtccagccgtgcgccgccatcgctccggtcgtcgtcgtcactagggaaggccgacgtcgtgatcgtcatctcgtcgccatcctcgtctgcccctccgtcgtcgctgtagatcgccggagccccaccgtcgtcgtcaagctgaaggtcaccgccgctttttcctcgacgccgtcgccgtctgttgaccttccgccgctgctttggtcactagtgagttcgccgtgttgcccgcaacccgtaggtgtcctccgttcgcgtcgccgtgccgttgttcgccggcgagaatgcgccgtccgagccgtcgccggtgatgacgtcaccgctgacgtcatcgacaccgtccgccgtagaccggtcgtagaccattaaatcttggccgtccgttttggatagatcgatctcggccgttcgtttctgtgaaccgctgccgtgcacccggtccaccgtgagccgagtccgctgacgcaataatctctttttccttttcaaaaataattcattattgcgtcataattcaattaaaatctatataaatgatttaatccgatttaatctttaaaaattcataactaattcatcttagctcggatttacttggttcaagtctataaatttttctaaaattgagatcaacatgttaaaaatatccacatgtactgttcatgcttgtttatgtgctgttttggtgatttttgtcacgaccggaaataacccaacgggcgttccttacgtgcgtgcattattccttgtcccagg

SEQ ID NO: 51051 - DNA, 671 bp, Oryza sativa
taaagagcatataaacttcaaatgaccataacttggccatttgaactcggaattggaccgtttaagtctctaatttttccttaagaagtcaagaacccatttttgtgctttgttccagcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgaacatattgaatcccagtttataaaattattttgatttaaattattgcattatcgctttttttaaattcccgcgttatcattgttttatctagccatgcctatgtacctttgttatgaccttattatccttgttcaccctagaataaacaaaaccccaactagtggacactctactcatggtaccactagtatgattttagttagatgcttcgctggttaattaggtaacattaggtggtttacaactctagaccttgggaatactcttattacctggacactatggaattgttggattattgtggaattggattcacacctccccctctattcaaaatcctcaaaatggttttaggctgggctcggggtgcatggttttgatagtagcacctcggccatataaggaccggt

SEQ ID NO: 51052 - DNA, 903 bp, Oryza sativa
aattaatatggtttgcgtgtacacatgcaattgcgacatgtttttgtgtccggggggagtacatattatgtttggctttgtagttcctttgatgattgtattgcatctggctgttgccctcggtggtgtgatcacttcattctctttgtttgatgcaactacttaagtctgataggcatttataaactcgtgtaagaagatcccaagcctctcacgtttcagcattaataaagagcatgtgaacaatatttcttctcagttgcacagattgtgcatttgagcatatcaatgaccagaccttttccatcttcatatccttcattattctgttatatcagacttgatcaaacaaccatgactgaataagatccttgattgtatttgttagtattctctacgcgcattaggtgtagctgtatgctctcttatactagtttgttgttaggtcttctttagcacctgaaaaaaatcacgggatattttgcacagcgaaagccttgccctgtgtaagaccatttgacttaatatattcaggtggccatttcgcccctcggtgaaccgtcaaaaaatatatatcttttgttatagtcaagtgtggtctgatttggtatgattaaattgttgatattaacttattcatttgctcatgcctccattggaaagttcatggtaaacacatattcattctgtttattggcgcttatgaaaatatgaaaatagttcttgagtggacatttccgtgtcaagatctgtggtcattttttcggcctgcgcatgcaactaggtggttataggtgtttgttggatggtacatgtttcatactgcgttttagttccatatctagtacgataaaccagatggaacatgctttatttgatggatgctattcttttttttttcag

SEQ ID NO: 51053 - DNA, 1501 bp, Oryza sativa
ctgggctcggggtgcatggttttgatagtagcacctcggccatataaggaccggtcttcgggcctctgttgcaaagaactaccgtacttccacatgtctagtgggtaaggcttagtttgtggctcagtctggttataaacaaaagtacacggatggagatagacgaagtcgggggtcgatggacatctctagggcaaatgaaggctacacgagctgcggcccggtagtcgagatgtcatggcacagggccggtgtcctgctgctaggggctcagtcctgcctacctgtcccgggggttccggccgtaggtggggttgggtcagtactcttgtctatggcaaggatgggttggaaactatgtcacgtcttccgtccgtataccgtggtggtatggggcacgtggttacacgtgaggaagatgtgtcttgcgggtaaagatgtacacctctgatcagagtataatctattcgaatagccgcgccctcggttatgggcaagccgagcaatgtacccaagttagtgttttaattcttaaaacctgcttaacaactaaaatgtgaaatggttggcctgggttggcttgggacgagctgggacccagggtcaggttgctagttcggtctaaatcatcgtaggccttgggttaaggcaggttcgtgtgggttcacggccttgtttaataatcttgtatagctctaggatcgtatttacaaaatagctttgagcaactaagtgtcttttaatgctgtttgctgcaaaccctaaccctttatattataacccccttgtactcccttgcatttatcctgcacttgtgggtgtgtcttgttgaatacggtggttgtactcagtcttgctcaatttttccgaaacccagaagaggagcccctggaagatgaaggctttggtgtctagctcgcgcctgccatcaagcgcctgtggtcgtcgccctagccttccgctgtttcccatttgtctttgtgtgtgctgggccttcgccgcccatgtaataaattaattaattacgcttcagcttgtaaactctgaattgtatcaacttttggtgtaccttgcctcctgggacaaggaataatgcacgcacgtaaggaacgcccgttgggttatttccggtcgtgacaaaaatcaccaaaacagcacataaacaagcatgaacagtacatgtggatatttttaacatgttgatctcaattttagaaaaatttatagacttgaaccaagtaaatccgagctaagatgaattagttatgaatttttaaagattaaatcggattaaatcatttatatagattttaattgaattatgacgcaataatgaattatttttgaaaaggaaaaagagattattgcgtcagcggactcggctcacggtggaccgggtgcacggcagcggttcacagaaacgaacggccgagatcgatctatccaaaacggacggccaagatttaatggtctacgaccggtctacggcggacggtgtcga

SEQ ID NO: 51054 - DNA, 1501 bp, Oryza sativa
gatgtttggatattaatttagagtattaaacatacactaattataaaacctattccataaccttagactaattcgcgagacaaatattttgagtctaattacatcatgatttgacaatgtgatgctacagtaaacttttcataattatagattaattaggcttaaaaaattcgtctagcagattagctctcatttatgaaattagtttttttattagtctatatttaatacttcaaattagcgtccaaacattcgatgtgacatggacttaaaaagttttagccccatctaaacacccccagccaaatttatcttcaacctaataatctttctattacgctctccaatctgacaatggatcccacatatcaatctttatatgtttttttcttccatccaaatctttccttcttcctccccttctctccacaacctctccactccataatctctatccacggaccatggttcaccactggcagcgctaagatgatggcggagtggccagcgccggagggggaggctgtcgaaggcgacgatgtaggtgaggcggccaacgccggagaaagagagaggtagtcaataggcatggcagacggagcggcaaagctttgccgctccagcgaccgcgcccggctgcggcagcggcatgaatggtagcgacactactgctactcgcgttggtaggggaggcgaggaaatcggcgaagggaatggacggagaccggcggtggtgacagacttggtgtgggcgtcgatgggtaggtagtcgaatagcggcggcgacggctccaccttgctccagaagatccccgtctctgacgtcagagagtccgcacactacctcttctcactctccttcttgagccggcagcactgcagttggttgtttttctttccgcacaacgacggggtggccgacgacaggaatcggcacgcggcaggcaagcggtagacgggaatcagcgtgggacgccgccacttgcagccttctcgatctgtcttgccccatgccatttgttgtgcacgactggtcagcgaggggatgggtttggccaaccagatggacaagccatccagctagcaagtctgttgaagctgtaaatttatctacactagctaaattttagcttagagagtagaatagagatgttgtttgagatgcttttataggatggaaagtataatggagaagcttggcccgtaaagataaagaacagtacaaggactaaccatggcaagagaaaaccgtcactactcaaacctttgtttttctctattaagattgatttagtatttatcttatatttcctacgaatgctttttacttcttatataaaaattgcttaaaatataagataaatatattttttaagtttttaataattaaaacttaattaatcatatcataactatcattctcattttcctcgcccccaaccttatctcaatatacaatgccagtccgccgcaccgttttgcggctaactaagcagtaagc

SEQ ID NO: 51055 - DNA, 1501 bp, Oryza sativa
gaaaccacggccatgtcttggagttcagcacagtgccacagtctgtctttggctgtggttagttcagcgcaaagtttgaattttggttgaaattaaagatgatgagactgaaaaattgtgtatgtataacaggttgatgtgatggaaaagaactgaagtttggatctaaactttagatctaaacacagcctttattcaggaatgcaggctgtttaatttcttgcttgcggtagaaacatgcagaaaaaaatgttccaaattcagagcagcttcatatctgtatgagcattattcaggaatgcagactgccatagcccatagactaccgacaggtaaaacaaaatactgctccgtgatgttattaagcaactagacacctgaaatctgaattcgatgatacacatttgaacatctccaagcacgaggagatatcgatccgtccaagtaccaacagtgcagtgtgcaccatatgcaggttggatatgcatattttgacaactatagacttggaaaacccgtttcagtggaacctgtgaaaaaacggtgcagatccttatgcttttttgaatccacaagtgtgctcaagctaagagatggaagcgtctctatgctcgactgagcggccatgtttttctccgtttcagaaggattggaattcggaggaggttgcaaagaaacagccaagcaaatggcaggagtccaggagatatcagtagcagatcctcgggttttctcactcgatgcagtgacatgtgtgtgcttcccatctgtgtactccaatcttaccaagatcagataaatattcgacgtgattcaaatttcgaagtaccaaaagaaaaaacttaacttgcaacatcacgtatagtgaccccagattggcattcatcgacacgaacgaacagtaatacagcccaagatgtgaagctgcggccctgctgcggcggttccccgtgggctggactaccagctgcaaggagataggaataagttcagatatcatccctcaactttacgtcgagtttgtatgacatccctaatcttcaataccagaaatcttcacccataaactatacaaaaccgtgtggttctcacagcagtatgattagggatgaagatttgaagagtgaagatttctggtattagggattagggatgtcatactgattcagcataaagttgagcgatgaaaggtgaacttattcccaaggagatacgcatgcaacgacgccaccacaaacgggccaccacaccaacggcccggcaattgcggcgttgcagtccccgcggcgcgggcgaatatgctctccgcaggacggcgatgccacttcttcggttatcgggtgggccctcacttcctccgccgaaagccacgcacacgctgcccataaaaaggcgacgctgttctcaaaacctcagaaaattcctatatcctctgttcgtcactgccttcctctccaagtccatccccttccccgatctaagatccatccgatccaggcca

SEQ ID NO: 51056 - DNA, 1501 bp, Oryza sativa
gggggaaaatatcacaattgctcacacctcgcatcaccgcgcgcggcttaagtatttaaccacgtactcgcacggaccgggcggtgccttgctatcatcgttggaattatggccgtttctcctcttatcaacgcaccaggatgcacacgaagtccgtgggtttaattccttgcgcgacgaggacgacgctgacgctcgcttagaatttttaaccggaccatgtcacgccgtgcggaacgaaccggcttaccggtttctgaacgttctttgcctgcaggttttattacgaagcgatcgaggagaaacccaacaactgccgacctaccgccaactgccaccgatcgaatcgagctgaaccaaaccgaggcgtgtgcatgccttggtgccaacgaaacgtcgagacgatacgatctcggttttgctttcggggcagctgtgcgtggtagtagctcaacggaagaaaacgacctgtaacctttttagtttccgtttccctcttttccgtcggagatgggcatgatgtaggtagctcaagttcgtaccaaaacttaattggggattgatttttgggggtgagccgtagggttccttgtcacgtgaatcctccaaggacgacgggtggatgtagcgtccatagggagcaaaacgtgcgggaaaccgccacggattagccgatttatgatcgaagctagccaagttggcaatttggtgaaatgacgatttgcgagctcgatcagaatcagccggtaagaagactgaaaaaatgaaaagaaaaatcatgaccggactcgaagctcgaattcattgcaagtttatccggacgtgaagcattgggcgaagaacaatgaatagcagtagatggcaatgctgctcatcagggtcccctttccttctgcttgtgttttctgggcccggatctcagctggtccaaccagcctttctgctactccaattgctgcaggggtttggtctggactatgtcggtattgttgcgtgccgcgtgctagacctactcctaccaatctgcatatcgaaacggcatcgttttcagaggacgacccttttcctggcttcgatctcgacaatgaaactagagctgctggcgtcctgtctggccccaagagtgtacatactcacaaatacttttttttctttctgttagtgccttaaaaatgacagctccagttggcaagaactgtcaagtgcctggcaagcaaggtagacggctagacgcttccctctgcctcgacccttgcccgtctggacgaccaaggtaatggcccccagcatcggattccttcatacagcttgggttgctgatcaatcactggatcaactgcatgtcctgattgctttatgctgtactcctgtagagccatcaggtagaactgtacaagttactacaggaacagcgatagtacttgaagttgacagtactttcatggttgcaaggtctgtaatgcggcaatggctaatcactgcataaattgattaacatagt

SEQ ID NO: 51057 - DNA, 1501 bp, Oryza sativa
ttcagtccagtagttaaggctgctactattaggattgttctgtctattgctatgtctatggggtggtgtatgagacaactagatgtacagaatgcttttcttcatggtttccttgaagaggatgtatacatgaaacaaccaccaggatatgaggataagtcctttccagagtaagtgtgcaagcttgataaagctctttatgggctaaagcaagctccaagggcttggtattctagacttagtaagaaactgatctgggttttcaaggatcaaaaggagatacttctctgttcttttacaatagaggaggactaattatatttgttcttatttatgttgatgatataatagtcactagctcaagacaggaggcagtgtcagctcttctgcaggatttgaaaaaggagtttgccttgaaggatctgggagatcttcattacttccttggtatagaggtaaataagatacctaatggaataatccttacacaggacaagtatgcctgtgatctcttgagaagggtaaatatgtttgattgcaaaccagtaagtacaccattgtctactagtgagaaattatctgctcatgagggtgacttactagggcctttggatgcaacaaattatagaagtgtagttggtgctctccagtatctaaccttgactagaccagacattgcttttccagttaacaaggtttgtcagttccttcatgcaccaaccactattcattgggttgcagttaagagaatcttaagatatttgaaacattgtactaaacttgggttgaagctatgcaagtccaagtctatgcttgttagtgcttattcagatgcagactgggcaggatctcttgatgatagaagatcaacagggggttttgcagtttttctgggagacaacctggtatcttggtgtgcacggaagcaagctacagtttccaggtctagtactgaatcagaatacaaagctcttgctaatgctacagcagaaatcatgtgggtacaaactttgttgacagaattacaagtgcaaagtccacctatggcaaagttgtggtgtgataatctaggagctaagtatctttcttctaatcctgtttttcataccagaactaagcatatagaagttgactatcattttgttcgagaaagagtatctcaaaaattgttagagattgattttgtacctacaggagatcaagttgctgatggctttactaaggctttgcctgttagacagttagaaaattttaagcacaatctcaacctaggaaggttgtgattgaggggggctgtaaaactatattgtatacatgcgtgtggtgtctgttaggttggataagatagactttgttaggatgttgttagtctcatctatccaactgaacagatcacgtgtgatatggatgcaaaccacggtgatggttgttatcaccatatattaataaaggtgcggcctctaacgaggttcaacgcttctgcacctctgattttcatagc

SEQ ID NO: 51058 - DNA, 740 bp, Oryza sativa
ttctaagctggtggttcttaggctgggagtttctcaagtcaacgtcaatgattagcctttgccactagtctccatactgtttctaacttccttaaattttaacatctcaaaaatggttccttgctaacaaatgtgacatgttatctccggtaggccattgcaggcagtacatggtaattttgtgagccacatgtccttgtaggatggcattcttgtttgattccccgcatctccccatcctgactccccgcatcttccccatcctgagttcctgacctagtgtatgaaaatccaagcaagcaaccaaacacacctttagttctgttacatatttaactgatctttctggttgtttatatattcagatattggtaccctatgcaaagtgcatgtccatttctgttccttttatgccattgaataacatgctattagacaattaaacatcattccatccattttatctggcacaattgcaaagaaacaaatagtgccgagcacctaatacatgatttgggtaagaccatatttgcctagcagaagtcaactatacaattcatagtacaatagtacataatcaggcaggtagcactggaccggttaaagtgttaactccataagttaccattttttttcttccatctaattcaaccatctgtcttcacaattccaatggttaacttctctcccatgcttgtgcaagcaggacatctggcgtcttatacattccttgatgccaa

SEQ ID NO: 51059 - DNA, 1501 bp, Oryza sativa
cgttgccggcctaaccaaaacggtgctaggttttcacccgtcgcccaccgcctgcctatccatagcagatacacctttgctccatcatcgtctaaacctctgtcggcgtccctcgcatgccaccacatgggcaccctcatcgtgcgctccacgccgactgctccacgccggcctccagcatgtcgcgttgcgccagcttaccgccaccgccagctatgtgttctcatgttgtgtcggcctcacgccacctccacgcagcactcgccggccacgagcctccaccaagcgctgatggcgccatcactgccagccgccggcaccgcccttccactgacgtcggtgtcgtccatgcacagtagcctgctccaccacacccccattgccggccgccagcgtcaccgcgctggcctcccgccgtgtcgctccgctccgtccactagctcttgccgcaccacacgtcgtcgccgcccacgccggctgctccccgcccagatccgtagggtgttgggtctggctacgctgcctaggaggggggatccggtcggggcagtgccggatccactgccccataccggagaagccgccacctcccacccgacgcgctctgctccgcctcccacatcaaggaggagcttcgccggctcggtttcccttgccaccaccttctcagtcgggctcgcggtttctagcggcagcaaggcgtcgagataggtggagagggtggcggcgcgagcagctaggatttcatccccaagctacccgcatgagagtgacgaggggtttgttagattgatatttttaggacactgcgaaccttgaacaggcaccacatggcaattcttttacccactccctgagaacgcaaaaagctcacctagaaaacacagatacagtacagatgttcgctattaccaaagatcgttactaattttgacacgaggaatcttgggggataaaatctatataccctaactctcttctcaagcatataaacgatttcaagtatatcggctttgattcaccaataaattctcgctgctttatatataaaatgtatttggtacatcataagtttgacgtagatagataaaagagttgaggtaattggttcaaagtaacacaaagataaaattattggattcaaaatgagtccaaagcgaaacaccgataataaaagatagccaaaagtaaaactttataaattttaaattctgtaaaatacttattcatatcatggttgcgtattttcactcttgctgcaacgatctttgcttgcaagggaaaagagacagcaaatgcgcctctgcctcgattcgatcgtatgcctgtttgccaagaggacgtcaaggcggggtgttgacgggatggaacaacgaactagcattgccaacgtacgaagaaacaagtccagctgtcatttcaatggctgaaccaggtgctcgtaataaccaaatgctgataagctgatgtcctgatgggttagtaacaattagtctttttt

SEQ ID NO: 51060 - DNA, 307 bp, Oryza sativa
ttgaaaaaggtttttaaaagtctgttttggctttgggcagaaagccggcccaaaacctctctccttctctctctcttccctcggcccagtccggcccaggtcgccgccgctctcctctctctctcgctgtcgctgacaggtgggccccacctgtcagtcttgtcttcttcctccggccgccgccgcccgaaaccctagccgagccgcgccgccgtcgctttccaattccgtcgctcctttccatctccggccgaattgatagaggggaaatgatcttctcgatctcctcttccttttctcttataga

SEQ ID NO: 51061 - DNA, 1501 bp, Oryza sativa
  unsure (1)..(1501): unsure at all n locations
ttacctaacaattcaggggcccgaacctgtataaaaatcctcgtccccatcttctttactataatctcgcatataccctggtaccaacgatccccatactatgcaaataccagaatcgcgacatcaaacgtcgacacattgcatatggattaaatccagcgcaacgcaatgattttcattcacccnnnnnnnnnnnnnnnnnnnnnnnnnngcatacctctaggcggtgcgcaaaggcgcgccccatcatctagtggggtatgacctatggctggttgcccaacatgtagtcattgatgcgataaaaaaaagtttttggtggttcaaagttgaaacaaagataaaataaactagtttaaaatcaaagataagctgatgaggacatcctccactattacccgctggtaaagacgtcaaagtcgggcgacgaccgtgtgagcctctgaataatcccaccttgcttagcttgggagtaggaagccaccttaaaaaggagagccacacttcccctattggactagtcttttagggagattgggccttttcccgagtgggtgtgccaaagaactgttggggtccgggcaaccttaagttcttgggccttggccaaccccacctgggccggattgttatcatttggtatcagagctaggcccttgtttaagggggtgggaatgatgaggacatctcctccactattacctgctggcaaagacggcgggcctttccccgagtgggtgtgccaaagaactgttggggtccgggcaactttaagttattgggcctcggccaacgtgtgagcctctgaataatcccgggcaactttaagttattgggcctcggccaacgtgtgagcctatgaataatcccacctcacttagcttggaaggaagccaccctttccctattggattagtcttttagggagattgggcctttccccgagtgggtatgccaaagaactgttggggtccagacaaccttaagttattgggcctcggccaaccccacctgggccggattgttatcataagctattgcttagcttgggaggaagccatcttaaaagggagagccaaccttcctctattggactagtcttttagggagattgggcctttcccctagtgggtgtgccaagaaactgttggggtccggacaaccttaagttatcgggcctcgggcaaccccacctgggtcggattgttatcataagctaagagtgatttgaagtgaatatttaataataaaatatggttttagtaatagctctaaagtagtatctctgcctaaatttattttattaggataagttatatttttagttaggttgagttttttaataactgagggaatggactgtgaaaccaattcccccgaaaaggaaagagtcaatttcggtcttacccaactttaatctttaatattgattttgccaccaactaaaacggcgtaagtccaaaattccccatacctctcgcactccactccagaaccccca

SEQ ID NO: 51062 - DNA, 1501 bp, Oryza sativa
gagacagcggcgctggatccatggtgggtaacaagaggcaccagcgacaacctgggcagccttgcaccgttgtgcttcagagctccatcaggaactatttcttttactcatagtaaatcttttgtttttgtttagggcagtcaagtcgggcttttttatgtttgtgtttagataattgaacatctactttgaccgacattactactgcagtattgcagcttattaccagatcatgctcacgggttaaatttctttatccaaacgtcttgactgacataacctccgtactaatgcagcttattagttattactactgactttctggtatgcttggaatcaaataattcttttcctttttgtcggccttgatatttagattaataagactaaggctgtgtttagttcctgaaaaaagttggaagtttggggaaagttggaagtttggaaaaaaaattggaagtttatgtgtgtaggaaagttttggatgtgatgtgatgtgatggaaagttggaagttagggttgaacacagcctaagtgatatctgtatgggtccatattctcccagcaaacacaactacaatccatgcatgggcatggccagtgaaaaagctgcactggagttccaactggacaaatggatgaagcagtttcataaagtgcatgcaggttcctaaatttctcgttgtattgtttttgctgcaatcagtttcagctagatggtctttatcttacttatggagtacatggaaacattgtattcaccctcaaaacaataagaaactgaagaagcttcagcagggtactcattggatccagatcctctgcattggagaagctaatgcagagggtggcattagctcgaatcctatctatccatcgtcatccaacggttgctgctgcttcttccttcattcttcgctactggtaccagaaacgaacaaccacaacagcgcagcaacgacgactccttcgcttcgtcgatctcgaccgctacgcctgatgcacacaacggcacaaaaccacgtcacaagtcacaacctcacatagtcatcacgtgttcgatcgcctttaaaaagcattttcgccgacgttgacctttcttgttcactgcggttatgaccatcggagtgaaaaccccgccggccaaaaaaagaagatgacgttaaatagaatgtttaaatagaatgatcataaatagaatgaaagtggaaaaaataaagaaaataataaagaaataaagaaagaagtaaaaattactactccttccacatttttaatagatggcgttatttaatattttatcatcgtcataataaaaatatgaaaaatacaagtaatatatatatatatgatacttggatagttttcttaataagacaatgtccaaatatcatatgcaaaagtcaacaacgtcatccattaaaaaaattataaatgaagcatttttaaattggataaataagatattgttaacaacaaaatttggtaatctgagtatcg

SEQ ID NO: 51063 - DNA, 221 bp, Oryza sativa
ttatgaggtgcaaccggtaaaaatttcccatcgtttgagaaacattttttcctttttggttagcacttcccattcttcaatgtaggctgcaactgtggatgatggtgaaatattcccttcacatgcatgcaggatgctacaattaaatgcaagtcaatatttttttcacaaatatcacatgggtccttccaggataaacatgctctacttatttagtcagg

SEQ ID NO: 51064 - DNA, 1501 bp, Oryza sativa
cagacggtcatcgatcttggcaaatccaatcccaacagaccctgaggcaaagaagatgagaatcagcttgcacaaccatagagtttggtcacgagtgtaactcttttttatccccatagaggtaagcattctttcaaagaaaccatggtctgccataaggcttgatttgtaggcctcaatgtcgttgacgagattggcatgaatggcagcttcgatctcgtcgaaacggtcagagggcgtcttttccagtttagagagctacaaagacacaggtgccaacatgaataccgacggggtatgccatataacaaccgattcaagaaagcttaacattcaactgaattatattgcacgatcaatcagaatgtttcgattcagagttagaattaggctgtttcaaatcacaaccactataaactaaattttcaagcattttttttgtttataatgacataagaattaattcttaatatggtagaaaaacgcatacaactctaatattaaaaaggccgaatttatcggaaaaggagtatccacaattgattgattatttaggagtggaccataaaccctaatgctaaaaattagggcagaggccctcaaaattccagaggtccgtcacttgaggagctcgattaggtcgatgagaagatggagacggggcgcacctcaacttcgccgctgggacgacgggcctgcggaggcgaacggggatcgccgtacctgctcggcggcagcgacgagtggacggcgcgggcaaggggtagaaggcggtggagggtgttggttgtcctggccgctgccattgacgccgccgacgtagaacacggcgaggtggcgccgcgagaaacccgccatgatcgcagtcgtcgcaagggggaagccatcctttcctcaccctcttcggctcttccccgacagggggaagtgatgactcaaaaaaaaaaaagttgagatatcctaacgggactagctattgggctgtccacagtttttgaggtccagagcagtcaaatttttgcacctcacgatctgcaatcaatgggttacaggaaacgggtctggaccagctgaaagcatagaaccaacctgtttaaagtgcgcgggcccgttaagaaacactaaacatgccaatcttttaaataaaaaacaaaacatacctacaaaacaaaagacccatcccaaaaactagactactcagaatttaattactaagcccatgaagagaacaaaacacaggcccagatagagatcaacttgcatatcaagaaagaaaaagctcgggcatcacacagccaaaaaaaaggattcgaaacaagaagcagatctaaaagaactcaagaacacagccgaaaggagaagaaaaaaagagatggaggaaaatccaagaaatgaaccaacatctgctcctccaggttgaatttctcacatacttttaagattacgttgcaatttcagtttttttcccaagaactcttcacccccatctcattttcttctg

SEQ ID NO: 51065 - DNA, 439 bp, Oryza sativa
tgtcctaaaaggggaaaaataacctaaaagcaagagaaggaccacaaggaccaaagaccacaaggcttattccatcattctccccctaagtcttgtgtgtcgtcttgtgggaaagttgggccatcccgatcctggagcagagctcgaggaacttgatcctcccaagaggcttggtgagcaagtccgcaagctggtccttggtgttgatgtagctcgccttgatgctcccttcctccaagtagcttcggatgaagtggtacctcacccggatgtgcttgctccgttcgtggaaaacgggggtctttgccagggccagagcggacttgctgtccaccctgagctctaccgctccagtgtctctgccgaggagatcaccaagcagtcgagcaagccagagcgcctggtactcagcctcgcagctggacagggccaccacctg

SEQ ID NO: 51066 - DNA, 220 bp, Oryza sativa
aattcctgcagccctgcctagcggaagtcaactatataattcatagtaatagtacataatcaggcaggtagcactggaccagttaaagtgttactccataagttaccatttttttcttccatctaattcaaccatttgtcttcacaattccaatgtttaacttctctcccatgcttgtgcaagcaggacatctggcgtcttatacattccttgatgccaa

SEQ ID NO: 51067 - DNA, 1501 bp, Oryza sativa
atatccactagtaactctagtttccacctagcagcagtgttgtatgcacattaaaaagttcttcttccttatcttctcccttctctcatctgcatgtggcgttggtacttggtacacgctggtggaggcgcaccccgcgcttgctgactcattcacgtcgatgcccgtgtcgcttcacctcaccctcgtgctgctctctatgtgcgaggacatcgacaccgcagccgccacactcatcatcacacatcaacttcacgctgtcctctagatccgagttagggttcttgtcctcctcgctgactcgccgcgttggagcacgtctatttccactccttcaatccgacactatatcatgtaaaatgacagttttgcccttatattcgagatacatgagattgctaaatatattagtgattatgtggtagagacatattatgatacatgttatttattagtttgatggtgtatgcatcaaattggacgtggtagtcatctctagttgtataaaacttgtccttacgctctgttctattttttctacctttctcaacttaacccctcatttttcgcgcgcatgttttctaaactgttaaacaatatttttttttttgcaaaatttttcaatacgaaagttgtttttaaataattataataatccatttaaaaattgctaatatttaattaattatatattaataagtagctctggtgtaccgcaacgaacacagtcgaggaggcgaggggcgtcgtgggagagaaacgcggggagggcggtcttgcggtgcggggcggacggcggcgggtcagcgaggaggaaggtggtcgggtagtagaggccatcgacggcggagaggcggccgacgatgcggtccatcgccgcgggctccatcatggctgccgccgccggcgtcgtgtcgtgtactcgtgttcgtgtcggcgtggcgaggatgccttcctcttttagccgggccggatttgggctttaggcggggggatgggcttaggtcggtttggttttgaatgggccttggcccatggggatatgtacggggaattggatagggtggtggggccgggcgtggtgtcacgtgacggtggtcaggtacagtagctgtttccgtgccggtccggtcggtccaccggttgatccggctcggtgaccgtgatctttgttggcgtgtgaaagagagaatcgatgaagcaaagccatcggtactcgacggtacatggtgttttttctttttattttaccaataacttatatacggtcagtgaaaattaagtggccatgtatcaagagtttatttacaagtttatattactacaagtgtctaaattttatttcaactaatttaaacaaagtataagatatcaagcatattttatagtttgatttttacagttgttaaagctgcattgaacatcacagttgttcggtcatcagtcaagaatgcatcttagccgtttggtggctgtagccactgctagttatctactctct

SEQ ID NO: 51068 - DNA, 249 bp, Oryza sativa
atttttaagatgattttaatggtggtggtaacgaatatgtcacccccctactatcattctatttttttcatattaccctttcaatttcttagtattacataacaactagtaaatttaaatggatagtcacatataaaataaattaaggttagtcttccctatagaaaaatgtagacaacaaatttcatggaaactatgcttttatttattttagaaaaatgttatgacattttttcttttatccatagc

SEQ ID NO: 51069 - DNA, 1501 bp, Oryza sativa
tgaacaacacattctttttcacaatggccagggcgccagctgatcgcaagaagacggcgacgatatacaaatcggagaagaggaaggaaatggaagaggaggggtacaggatcctaggcaactccggcgatcaatggagcgacctgctgggtttctccacgagcgctcgctccttcaagcttcccaatccaatgtactatattccatgacggaacagaagagggaaagagagggcgggtgagaaatgcggcgtttatttgatgcattttctcacccagcccattcaaactgactggtggagaaaaagaaattcacaataattcttcaaaggaattccaaactgtacaaaatctcactgacttcatgtagaatacattaaacttgtaaagtcgaatgtaattggatgaaatgagagactatttattgagttggtagttcatgatatactatattcttctcttgggaaggcttacttgaagcgataactgtttttgtgacgctgaaacatttcactcgcaagctgaattttcgttggagtctctgcactgtccatcgcttaacttatcttatttgcaagttccatgtagaaggcgaagcacgcaatcgttcgtcataaacaaaagaaaatactaacaaaggagaaagaaatatgagatagattgtttgaaagcgcattgcaaaaacatagccaccccattgcagtaaccgggctaccggaccaatccaatgtgacacacttcgcattaccgagcaaccgagaatttactaagttaaaataataaagagtaacaacaagtcggtgtggaacaattctgcagtccagttcagtaaaaatctagagcaagtcagatacagtagaaagttggaaaagaatggtggtgtatggctgaatcactggaccatcggatcagggttcccagcagcaagtatgtcgagcaacgagttctggggctccatctcttcatgccagagtggtagtttgtcaccagggtgaaatttcctcgaaacaccatcggcatttatctgcaacatgatcatatgcataagtaatccaccaatcctttggaaacatgatgggtagaacgaagagaacaggacatgtctctaaacttaaatctgcattgccaaactgccaaaccatagttgtactgaccaaacatattcagcaaaagaaagctacggaaaatgcaaccaaaacagatggccaagaaagacatgaggttgtccactctacctcactctagcatattttagcacaagagtacagcatgtctgaatgaagcaaagaggtaataccacactgaaatattccgtccttggaagttaaaaggccgatagttttcgctttaagattctttggcacagcatgccaaatatagcacagaaatttatatgtttgtatgaattccactaaaacaatcagttcaggtctctgaagtctgatgtttcaaaatgtctccaataaaggaacaaacaaggacaatagggatgaaaaaagaga

SEQ ID NO: 51070 - DNA, 1501 bp, Oryza sativa
aaaacataattggtgtaacagaaacatgagcaaatatgcaagcaaacttaatggaataggggcatagcttcctttgaaaaaagaaaaaaaaacaaaatcacacacactaaaaagaagaggtaagattataattacgactcaaagctagggtataaacataacggtcacttgtttgaatggtacgaggaacttaaatataaatttgtcccattggaatattcaatattggatcatttgcaagctggctgatcggctaatgaaaatcagaaataatcaattgaagattatcacaaggtgtttactgaaaattgcagcttgttccaaaatccaaatgtccaccagctgcagagcgagcacactgaactggaagtgcaggcttattgtgcagtaaccaaaagctgtctcatgagtggaggattagtccccgagcactctgagattagcatttttagttggccaaatcattagccgttcgttcccgcgggccccacccgtcggtgactgcacagtgctggctcaccgtagaccgtgtccaaatggctggacagcaacaaggcgatagttgggacaggtgagatcgcatgctttttacaagtacgctaccataccacgtccgttctaaaatataacaaattttaaacggatatgacattaattttaatactataaatctgaacggatctttgttttcatctattaaaaaattgctatattttagaacgaatagagtaccttttgttctgttcatactttcattttaaatttgaaattagagcttttctgatttgttcatactatagagagtaatttaggtgcctcctccaaccaaaagtccagtccatgagtaattgagtattgcaaattgccctatatgaaatatagtatccatcataacctattgcagtttgattgctagtagtctttattatgttatcctaactcaaaagaacacgttttaaatcgcacttcttttccaagacgaccggcctactaccttcgcatttaaatacttaacactacaaactttattcagtgtgcaactatgaccgtcatttttcttttagaaaaaaaatatctaacaaaattataagctgtaaaaatagttgaagagctagtagctttaaaattttaaccaaataaatcacgatagcatatacttaaatatactagctgaattgcaattctcacttttcaactatgtgaaaaagaaaagaatatttttttaactgttttgcggttagcatgacaaaccaacattatatcgacactacaatcaactacatgtactccctccgaactgataatattgttttataatattgttttagattaggacgaggttaaactttagaatctttgattataaattatttttaaaatatttgttgtttatacattgtgattactacatatataaattagtcttaaaaagtacttataatgaaaaataatggtggttgtttttttagatcataccattgtccaaaacgataagttttat

SEQ ID NO: 51071 - DNA, 1501 bp, Oryza sativa
attgtattttatcttaccctttcaagaagtatctgatcttcatagggtaatcttgtattggtgttggatctcccactaactatttctagtaacagaacaccaaaactataaacatctgacttccgtgtcacttgtcctcgaatggcatactctggagccaagtaacctctgtcatgtaaaactgagtaagtaaagctgcaggtgtattgatatttgatgggtcataaatataatccataaattactaaataatcatttgatatttgcaattttaattgccttagcttttccactgacaatcatttcataaaatgtaaaagaaattgtcggggtgtactgtcatatgggtcaaccatttaaactgaaaggaatgctataggcactaccatagatacccaagaaaaagataaggtacttgaaaaatgcatcgtacttgttaactcattataaaaagaacttatgacaaagtttacttacaatgttccagcaacccttgtgctaacatgtgatgcatctggaggcaaaagctttgctaaaccaaaatcagatattttcggcgtaagatctttatctagaagtatattgcttgctttgatatcccggtgaacaatgtggggatttacaacttcatggaggtatgttagtccacgggcgatgccaacacaaatatttactcgagttgcccagttgaactggatgttgctgtggccataacctgaaaaaacaaaagaggaaaaacaaaggaaactgtttgaatatctaggccttttcttagcactgtatgtaaaaatttgagaggataaagcaatagaaacgattcaagtaaccatacccaaaagtgtttgtgcaaggctattattttcaagataattgtagacaaggattctttggtttccttccacacaatagccataaagcttgacaagattttcatgagatacgtttgaaattgccatgagttcgttcagaaattccttcgctccctgtcttgactctaaagatagcaccttgacggcaacaagctttccattccttagctttccctgcaccattaatccatcatgatgaacacgtgagaattcatttttttttggaatttttcttcacttatttgtttgaactttgaaggctacttatattaccttatacacagatccaaaacctccctcaccaatcttattagacgggctaaaattttcagtaacccttgaaagctccttgtaagtgaattttgttatattcatatcaccagaggggtctgtacaaatcatgttaaatatttcagcaagaaacatatcaaggatgaatatggacaaatcatgttcaacaaatagggtataatgcagtctgttttagagatctctaccatcattatgctgagaactttgctgtcgggttgcccttctcttgccaaatatacaaaaacaacccattaccgaaatctaaaactactatgatggccttaattctgcagttcaacaaatacagtttcacttgtgaa

SEQ ID NO: 51072 - DNA, 696 bp, Oryza sativa
tcccctggttgagctggttctgcatttgctgtatcatcatgttcattaactgagtctgttgagccagaacttgagcaagagttgggttcccttcattattattgtttccacttccactggcgcgagtgttcaccatctattgcagattagagaagataggaggagaggggttacactaaagttaagaccttaaccatgttaccactgatctggtgtgtgtagttcattatattgttcaagttgattaagcaagcaacctagtatagttacatactcatcattgaactactccaatgatgggaaagcaaccatacctacacacaagcaaacaacaaacgttctaccctactaactattcttcaaagatactttggcggcataggttctaaggtaggatccaaacttcattccatcttgaccacttggcacttcagatcgaccatcaccttcttattcatcgatccacttgacttaacctccacaagtagaccacattggcgtcttcaagtttcaacaactactttcagaactactcaagttgaaagagagaggagagtagacaatgaaacaatttgcaaagaattctagataaggaagaaaggaggaattttcacaaattatgttttcggaaaattagtccttaaggtttgaccatttggcttatcctacagtcgagatggctctgataccaacttg

SEQ ID NO: 51073 - DNA, 217 bp, Oryza sativa
tggaaataggcggatgggagtgtgattcggattcgtttttccccaatctttccttctcgtcgccggccgccgtgggccttcgccgccgcctccttgcacctatataaggacccccgagctctcctctacccgtcgcctcccttgccttcgcccgccgtcatgtgtagcgccctagccccgtgagctttcgcgccgccgtcgtcgccgccgctccagt

SEQ ID NO: 51074 - DNA, 1501 bp, Oryza sativa
ttaaagtgcatagagaaagggtgaaccgaggagaagagagagaaagcgagagagagagaggagctcagctcagctcacctccactcgtggggttaaaaccccgagaactgcacagcagcagcagcacacggcgcagcagcggcaaaggcggcagcagcagcagcagcaagaaccgagcaaagtcgcaagaagcgagcacacacactcctctctctctctccctctctagctactgttgttcttggagttgtagaggaggaggaggtggtggtggaggtggtggagatagggggaggatgctgatgctcctagtcctatcctagttcgtcgtcaactccggcggcggatctgcggtggagcggcggctggattgtcgagcggtgagggtgacacgcatctccggagctcgccgcaggcgggagggatctgaggcgcgtttcttaatttgccttctctttgagctagctgcaaaggcggcggcgtgcggcggcggcggcgtcttggcgcgcgcattctatccggcgagtcgacgacgacgacgaccttcgcgccggtgtagcggcgcccgtgatgtgaaggaattcgagctcgctcccttgggatcgaaaaggttgcgggttggagaggcaagaaggtttggccggtttggggaaggagagaaagcgatggtggtggtggtggtggtggtggctgggttgcttgctccatgacacgacagcgcgtttgggaacgcctcgtgatctcggtgcagaaaggattccttctctgctccatttcttgcactctccactttgcattctagatcggttgggggaagaagaagaagagaagaagaagaatgaagctctcgccgtcggccggcggcgtctccgaccagccgccgtcgccgccggaaggtatagagaatagtactagctactctagcatcttctttctattgggcattgagttgaccagttgcatctcttttgttattattattttttcttttctttttgctcattaatgctcttctcatccattgggtagtttatgttcttaggacaagttagttaggttgttggcttggaagtctttaaatttcgtttggtaattatgtgctccaaatcaattcaatgatgcagcctgtcgatttcttcatcttttgggtgatttgtgctttgaataaccgagttactcctgttacagtaatgatacatacacatgatgcatttttttttcattagactgcttagttatacttgtctacaagcaaattagtgtgatttttatttatgcagtaacttttttccctgtaaaagtcatctgcttctggaaacatgcaaacaattcgtattcttaattcttgagaactctatccccttccccttcatttttttttgaaaaatctttgattttaaacatctttgttagccttaaaattatcttcttgaaatacgttttgaactaggatttgattatgggatggttcaagaattactgctgacaactaaaatttatg

SEQ ID NO: 51075 - DNA, 837 bp, Oryza sativa
atatctagctgaaccaatatataaagctcaactagtcaaattataataacccaaggtatcaaggattaaagtaatcaatgcaaacaggccataacaaaggaatagattcacaccacccagtgacattcgaaaataaatgcacagttgaaataaatagaaaatataaatataggatcaacatgctcaaaggattgtgtttaggatctgtgtgacttgccttgcaataatcggtcttcaattaatcttcttgaatacttccggcgcactcgcgaaccttcacaacgacggaaacgacaagctaacacgcaaaacaaagaaaaagactaataaaaaccaaataaacaatatataaaaagtaaacaaacatgtagatcataattttagatgaattatgagacttgaacggcctcattctgacttcaaatgaatttattatgaattttacaagattaaatctatttaaagcccatttaaaaagaattaaataaatttaattcaatttatggacaattttaatatatagatctttattttatacaacttttgcaacttgaaccacattaaactgagttaagatgaattagttatgaatttttaaagattaaatcggattaaaacacttatatagattttaattaaattatgacgcaataatgaattatttttgaaaaggaaaagaggattattgcgtcagcgggctcgggttcacggtggaccgggcgcacgggcgacggttcacgggaacggacggccgagatcgatcctatccaaaacggacggccgagatcgaacggtccacgaccggctcacggggagcggcaacgatgacgtcagcga

SEQ ID NO: 51076 - DNA, 157 bp, Oryza sativa
cgatccaggcgtatctctgatgtcgatatctggcggcttgtcttggcgtatgttggcttgtatgttgatcttgtgtcttgatctattgttccatgtatgttgattgtcgtctatggtgggtctcttccatggtgggtgtgtcccctctcctcctagg

SEQ ID NO: 51077 - DNA, 900 bp, Oryza sativa
attactgaactgttctttgtatcatttaagaattgagctccgaaaaatccgagaaaatttcagagagttgacttaatcatggagaatttaataaaaattaaatccatccatgctttagatttaagaaattttatttcccacatttaacttcacttgtaaattaaagaacatttaatataaattctattaataatttattaaataatttataaatcctgaaacgaaaatcaggatgtgacaaactaccccccttacaaagaatctcgtcccgagattcggaacggctagaaagaaaaagggaataggtaaactgcagtctatcttattccataactccgataattattctaaggctttaatgaaaactgctgccgctttgaaactggtggctgagctgcaacacttgaagacgcaactcttgaagacgcaactggcactgcattggctcctgtgacgacaatgttgttgacttgaccttgcggctgctgatgcttcggcttcggacactctcttgcaaagtggcctggcttgtaacagttgaaacatacctgctgctcccttccactactgttattctcctgagactgatcctgctgaactggcaccggctgattagcttgctcgatgttaactttattgctttcattagtctctgatttgatctcaccaccgatgttcaactgttgcgactgtccttgaccagcggaagaaggttcaccaatttggagtggcttgatacactgcctctggctactaccttgtgcctcctggaatacagtcattctccttttacggttatccatcctgttcttcttgtcttcaagtcgaattgctttgtcaaccaactgctgaaaatcagcatagtcatgagagatcaacgtaactgacagttcatccttt

SEQ ID NO: 51078 - DNA, 345 bp, Oryza sativa
atttgtgacccgataatattgcaatgaggaacctaatgacatcaaacagatggggtctgtaggcacatagagtgtgtacactggtgaaatcttctccacctgatggttggaatggtggtgtcgtctaatacctattgaggtatacttggtgttgttggctgtgtgttatcccccacagtcatagttgaaaaaaccggaccggagatcgaaccgcttgagtccttgggtcaccagtctagcgcttgaaccgccggttcacgtggttcgaatgctgaaccggaagtcttattttatttgcatattctctgtacatcccacatgaaagatggccggatggtggaggca

SEQ ID NO: 51079 - DNA, 382 bp, Oryza sativa
caaaccctaaccctttatactataaccctcttgtactcccttgcatttattctacacttgtgggtgtgtcttgttgagtacggtggttgtactcagtcttgctcaatttttcccaaacccagaagaggagcccctggaagatgaaggctttggtgtctagctcgtgcctgccgtcaagcgcctgtggtcgtcgccctagtcttccgccgtttcccgtttgtctttgtgtgtgctgggccttcgccgcccatgtaataaattaactatttacgcttccgcttgataaactctggaatgtatcaacttttggtgtaccttgcctcctgggacaaggaataatacacgcacgtaaggaacgcccgttgggttaattccggtcgtg

SEQ ID NO: 51080 - DNA, 1338 bp, Oryza sativa
aattcctgcagcccgtgtcgacacatttattcccacttacacatttaaccagatctttgtcatttcccgaaatgatcgatccatggttgttccgtattcctaacaccataatatgcacgcattgctaggaatgtcgtctccacgacgaacatcattatgaggtatatcaccttccaaagatgaattctccacaaggagaatcagaggagtatcctcacatccagtgagaactcttatgctctgactaaggcccacggatcgtgttagcaggcatccccgcagaatatgatcaaatgccataagtcttatgtggatacgatattattcccgggtctatccacatttaccacaattgggagcattactctttttaacaactatccagttgttcctcatatgattttgttggcaaaaattccatgcaccaagcaatcaggagtatgaactaaacatacaagttcaactcatttaatgcgttcactgaaagaaatctccaagcatttcaaaatgtgcatttctcccccccccctaatgcgagatgtcttgcaatagcatacttacaatccccatgtcatggcacaatattaaggcatttcacctcaaacacatgtgttctcccacgaatgtatgctacgttggtgatatatttgggaaatattacggactttaataggagagatttttccattatatgcagtgagcctggacatataccaatatagtggcatgaataccgtattcttcctttctcagaagggttatcctcaacctcctagttaggatatacaagtctgcaaaaaccaccattgctaccaaatgtatatgcaaccaacatgaaaatattttagccatatgcaatctccatggattaatgctcaccgagtgccattcaaacttacaatcgattccggatcgatgtggattagacatcccatgccttatgctttagaaggcatcctatggtggcaaaacacattcctatgcgctcaacaaggagtatgatagcaaagtgcgtggccactagcctgtgttgccaagcagatttttgtggtgcagagttgtattaaagtccaacttgtctaatgcccaagtttgaccccaattactcataccaaattctagaattgggtcactcaggttaagcagcaagttttaggtacgatccacgagcgagttgtcaaaccacattagcttatatcccctagacatagccattgagagataatcaacacctccaacaatggtaatattcactatgaaaccattatgttaagacatatccacaaaaatagtgggatgtgtcggagcaactgtcgttgtcacagcgagctcaacgca

SEQ ID NO: 51081 - DNA, 1243 bp, Oryza sativa
ccgctcgccgggaccgtttcccgccccagcttcgccgcactgtcgcagtccccgtccaccccctagtcgagctcgccgaccgccggagcgccaccgtacccaccgacccaagccgcgccgccgcctttctccgctccgtccgcctttttcgtcgtcgccgtcgacatagggtgagccgtggaccgccgcctcgtttccccctttcccctcctctctcggccgccgctccgccgtgcctatggccgccaccggcaaccataggggcacgggcgcgctgcctcccgccggccgcgccgacgtggccgccttcgggcgcgacgagtggccgccgcgtggggcccggccgtcagccgcccacgccctcgggtgtggctaacgcgtggggcccatggaaccggccggtgtgagcccggatgcgcccggtccaccgtggaccgtgaggctgctgcgtgggccccactcccgtggacccggtccgcgcatcctctcccctcggctgacgcaataaaccatttttaaattaaaatttaaatgaagaaattcgtaaatattcatttaaggagcatataaacttcaaatggccataacttggccatttgaactcggaattggaccgttcatgtctctaatttttccttaagagtcaagaacccatttttgtgctttgttcctgcttgttatatggagtttattagagtaaaagcctttttcttttccgttggtcgtgtagacgctgcagcttcggaagatccgctctacgtggaagttgaagccgacgtttgggaaagcgagcaaggcaagtcacatcatccttgaacatattgaatcccagtttataaaattattttgatttaaattattgcattatcgctttatttaaattcccgcgttatcactgtttatctagccatgcctatttacctttgttatgaccttaatattgttattgttattatttccttgttcaccctagaataaacaaaaccccaactagtggacactctacacatggtaccactagtatgattttaggtagatgcttcgctgtttaattaggtaacattaggtggttttacaactctagactttgggttattctcatcacctggacactatggaatggatggattattgtggaattggattcacacctccccctctattcaaaatcctcaaaatggttttaggctgggctcggggtgcatggttttgatagtagcacctcggccgtataaggaccggt

SEQ ID NO: 51082 - DNA, 239 bp, Oryza sativa
ccgctcgccgggaccgtttcccgccccagcttcgccgcactgtcgcagtccccgtccaccccctagtcgagctcgccgaccgccggagcgccaccgtacccaccgacccaagccgcgccgccgcctttctccgctccgtccgcctttttcgtcgtcgccgtcgacatagggtgagccgtggaccgccgcctcgtttccccctttcccctcctctctcggccgccgctccgccgtgccta

SEQ ID NO: 51083 - DNA, 1501 bp, Oryza sativa
atgtatactcatctgttgctttttcttcaaggacaattgaatactgtatgtttttatttgatttttaatccatcaatcatgcatgaaagcgactacgggtattctttaactccaaccgtgtcattcatgcatgcaacaaggatgacagtttgatgtttttaagtcgtacacataacagtgaagataacagtgtatgcgtctgtttcttcaagcaaggagcacatcgcaaacattcttttcactttccaagtatctcacatagcaaactcaaaacaggttgcactagcgaagtctaaatacacaacaaaacccaaacttctcctagggtatcccaaaatgagagtttaagtacttcatgaagctgctaccatcacattttaatcacataaaatacaacatcagtgattgctccaaatgacgaactatagccttctgtgactgaaaaggataaccaataattaataagatggcactactagctccatagtaaacaagtatttgcagaacacagtaaacaagtatgcaaaaccgcagtggataacaaccaaattttcccttctgtacaacatctatgaaagcattgtagcaaaaactagacaggaaagttgtagatacagattcaacaagcaagtccaagaagagatgcttatatacgaatatcaagcagttgtccttatcaattataaaaacttcaaaaggaacagacacctcaattgccaattgatcatcagaatttaacagtaacaaaaaagagagggcatggaaccagggagatgataagcaatggtgattgcagtgaatgctgtaaattcaggattgcagtacacaagaagccctgctccatctctacttctcatcatacacagatgcatgtctttttttgagggatacacagatgcatgtctctgcaacaagtctgccacttcacatgttatgcttttcaacaagacagttatgcttggaacaacaataaagaaattagtgcagtacaacccaacctgtcttcacactctaagaattggcaaattagtccaaattaaccaattttgggatcaaggtaaagcaataagatgttataggcatcacattttaattactgaagcggttctattataccaaatgtcaagtttagtagtgaagcttggtgtgaaaaattctataggctcagtaattttaaatgaaaatagatattgaaatgaaagtgactcagcttgtaagatgacaaaaactgctcaaatagaagcctcacatgatgtccttcagcatcaactgctgcatatcaggagatccactagattttcacttcagctagctgtaactgcctagctcccgctttgcagcctcaacaattacaagcatattatatggtattgaatcttttttcacctatcctaaagccaaattgtgaatttgcaatggcagtacctgcagtactacttaaaatgtttgcacccaaataatcaaaattttggaatcctaaactaggataaatagatcatca

SEQ ID NO: 51084 - DNA, 1501 bp, Oryza sativa
tttaggataagtgaaatatcagtgtccttctgatataaattatataactatattaaagaaagctaacaagaacggctaaaataaggatccaccttcgagacaatggttccattgttcgattcgacttgtcgaaacttgggggtattggcaaatgcacaaacgagaagtgtgcaatctgatgtccaatcgggtcgatactcggctcccatatccaatgcttgggagcgcaatgtgcctctttcagggttcacaaaccctgaaagtacaaagaccaccccatcctgcccaaaacaaacacatggaatcgcctcagccatacatacatacatcaagaacaacatatattcggttcagttgtgattagaccgccagagggtttagataataagtaccaaaagtttggagaaatccgatcctttctgcaccttctcgtgggtggccatgtgcttcttcttgcctggattttcctccccgtctttcgaacccatccaagaagggagattcctcttggatgactttcctctcccgttgttaggatctgagctcgattcaggcatactgactacgaacctgaccaagaactcactgttcagaacaattcaacacggaagaaactctggttaaaatccactccgaacacgcacagaaccaaatcaaggacaccaagattcttacagaaaagagaggggcgattcacctcttcaccccttctttgccgctccaatctcgtccaccattgaatcgcgtcttgcgaagttgggaagaacaaggagagggttttaagtcgcaaaaacaataaaagaaaagaggaaaaagaatataatatgggccaggccttagttcacgtgggcccacatcgcggcccaacagctggggcccaaaagttggtaatcgtacccgtacgttaacctttttgcaaaaagggacttaattaataattctcaggggctaatttgaaatggagtaataacaaaaataaataaaattacgcacaaaaccccctcctcatcttggtgtttagtttagtcctttccttcctcccaccctcctcgtcgctcccccgccgagctcgcgatcggattcgcttcgcctccgcctccgcctccgcgtcgccgcgccgccgttgccgcggcggatctctagggtttagccccccccgcgcggcccggctcccccgctctgcccacgccgttgccgccaccatggtacgtacgcggatctgaactttggccagcgcgctctcgctgttccgatcaatccgctcgcccgttttttttttttgtgtgtgttgggaagtaattgggtgtggtttggggagagatctgatcaaatgttgttttctgcttgtgcttcctgcagccgctcaggttggagatcaaggtgcgccactggctcgggctcggcgagcccgattccgctagatctcggtttgttgctgtctcagttggtggttagttttgtgctgattttgtggttgttttgtctttgggatggtgtgatt

SEQ ID NO: 51085 - DNA, 418 bp, Oryza sativa
  unsure (1)..(418): unsure at all n locations
cgctcctttgataagatgactgcatgnancnancacaanangaangngggaaatgctagaatgacttacattgtgaaacggaggaagtatttacagttcttgtctctactccagcatactaagtactagtagtcacctcactttctttaaaaaaaagcaaagttgtaagcacaaatagaaagctctcttgggagtttaggcatctagtgttttgaccttttgagagtgtttcctgatgaataattattaccaaataatgtgaactataatcacattctggagataatttgcatttcatgcgacttatattatcaaattgcatgtaggtatatttctatggttaaaattaaatgggtgacaaagcaggaaaaaatgccactatggatggctgtttattttcttgtttaactccctttaa

SEQ ID NO: 51086 - DNA, 1501 bp, Oryza sativa
gtggttcaaatccaaacaatgatggtcatgatataagactaggcatcaaccgatcatcctataggtcaatgcaaaattgtaaaaggcttacatgttacattggagtaaggcaccaaagctttgacggccaccaaaaataacatattacattggaataaggcactgaggctttgcagccaccaaaaataatatatattacatataatggatcagttagccacagatggcattaaacttcagtgggagtataacataagtgtgaagatgtaataatgtggtgagaaatgcttctatgttcctcccatagtgatttgtactaactggaaagcatgatttaaggatgaatgacaaaactacttagcatataccccttcatccgtcatgtgattaagttgtaaagcaaaatttgagctcaagacatgcaaaactaataagaaaccatatagattatagaaacagaagccctaattttatgcacaatcatgcttcggtcaattagcatgagtacagttttgaatattcatatttacttcaaaagtagttgagtcttagtcttgcttaatggggaaacaatgaacctaaaatgcaactagaactcttacctgcgactgatagtcccagatgcacacgctcccggagtaaagactcgacaggatcctacaccaatgcaaaaacagcttaataatcaaataatgaagcaaaagcacatcaaaatggtagtacgaacggctcaaatcaggctaaaatgtgctaaaaccctcagaaatgcaggtcacttgccatggctccgtggggtgcagatccaccgacttgaccctctccgaccgttgcgcaaacttcctctaatcacaccatcccaaagacaaaacaaccacaaaatcagcacaaaactaaccaccaactgagacagcaacaaaccgagatctagcggaatcgggctcgccgagcccgagccagtggcgcaccttgatctccaacctgagcggctgcaggaagcacaagcagaaaacaacatttgatcagatctctccccaaaccacacccaattacttcccaacacacacaaaaaaaaaaaacgggcgagcggattgatcggaacagcgagagcgcgctggccaaagttcagatccgcgtacgtaccatggtggcggcaacggcgtgggcagagcgggggagccgggccgcgcggggggggctaaaccctagagatccgccgcggcaacggcggcgcggcgacgcggaggcggaggcggaggcgaagcgaatccgatcgcgagctcggcgggggagcgacgaggagggtgggaggaaggaaaggactaaactaaacaccaagatgaggagggggttttgtgcgtaattttatttatttttgttattactccatttcaaattagcccctgagaattattaattaagtccctttttgcaaaaaggttaacgtacgggtacgattaccaacttttgggccccagctgttgggccgcgatgtgggcccacg

SEQ ID NO: 51087 - DNA, 1501 bp, Oryza sativa
agttttttacggctatggaggtcgaatcaaaacctaactatgcatcatacggtatatataatatatatatctatcgtcgtctactcaaaattgattgaatatcaggtcagttttgctgctgtgaaaagaagtcgatcaggaaggctggctagctgctggaagcatctgctatagtccctctggttttattttaattgacattttaaataatgatacggtctacgagatatatttttgaacttatttttctattataatatataataaataaatgcatgcttacttttattataatgctttaaaagacaaatctatatacgttgttttagttcctttaaaaataaaaattataaaagtttaacgttaaccttgtctaaaacgttaattaatatggaaccagagggagagcatatacttactactccatctgcattataatacttgtagtatgatgccggtaaactggagtgaagttccaagagaggaagtgttgcatgtcagcgtgtgtgatcgactgtgcatcagacaaatctctttgggggcgcgcgcaaacaacggccggagttaacgagatcacacccaacatcgtcgtcatcgatccctgcagccgttacagcatcaatatatgcttggaattacaccccagtttcagaaaaaaaaaacaatttttaagaatgaatctgtggatgggttcttgtttcgattcatcccaaaaactattttttttggacgaacacccaggctagctgctccaagcctccgatagcagccatctgcccgtctctctctctctctctttgatttatatatggatggtattttttatgattaaatacatattaattttatttcaactttggttaacactgtttcgtgtgaaaactttctgtatataaaagttgttttaaaaatatcaaacaaatctatttttaaaattataataattaaaacttaattggtcatgtgttaatgatttttttatatgtcctacctttatttgtattttcatggaatattttcattttcatagaagagaagagaagagtgggaacttcagtttagttttgttgggccagaaatcccagcccaacctacgggccaaccatgggccacagcgcctaagcccactggccactcttctgggccagcccacgcacgcaccttgcctttctctgtggcctgccagctctgcttcaggttttaggcaaatggtacagtttctttattattttggagcggagttagtatagctgcttcataaatttgtatggagccgagttttttctgtttcacagctccactctacctcaaaagatccactgccctttaatttttttagtgtattcacacaaaatgccactgaactacctcttgctaccctctctcctcccgttctctctcctccccatcctcctaccgacggccggcggcggcatgtagtggcggcgagcggcgggtgggtcgcagcatcggtggcaggcggtgacggcgggcggcggca

SEQ ID NO: 51088 - DNA, 569 bp, Oryza sativa
ccttcggtggagagttacagccgatcccccatcaacagcgcccgcgagtgaggatcaagccgccgttatcgagccaaatcaggcggacaagctgagctgacggtgtatacgggaggtagagatggacaccagcgacggcggtgcgttcgataagtgaccttgatagcatgtggcgggagaggatcggcggtggcgcctgagatgtcgacagggaacatgcttgcagatctcttttccatcaatggctaccacgagggtcttcccatggtgcttgcccacattgccacctacgccgcgcttgctcttcccccaactgtcgacgcccggcaccatagccgccgaggccaagaagatctggaccatctggtcatctttggcgccatgaatccggccacttccgccaacggggctgctgccatcatcgacccgccgtctagcacggttcaatgggcatcatcacacgcctatgcttcatgtccttctttactagcaggttaaaaaatccttaaggatttatttgctaatcatctttacctaatacatatctggtataattcttcgttgccttg

SEQ ID NO: 51089 - DNA, 1501 bp, Oryza sativa
gaagaggagttcctggaagatgaaggctttggtgtctagctcgtgcctgccgtcaagcgcccgtggtcgtcgccctagtcttccgctgtcttttcgtttgtcttcatgtgtgctgggccttcgccgcccatgtaataaattatctatttacgcttccgcttgttaaactctgtattgtatcaacttttggtgtaccttgcctcttgggacaaggaacaatacacgcacgcaaggaacgcccgttgggtgatttccggtcgtgacaagttggtatcagagccttcttgaccctaggacgagctttagatcccaagccttatcaatatttttgaaataaaaatcctttcttatttgtgaaaatcctctagtctctctctgtcctgctgcttaatttattgtcaaaagctgatctttaaaatgttgcttttctcttttgcttttgtttgtagatggccgacaacctcaaccgtcgtggtctggacttgactggctttgttttggagctgcggggcatgtgcattgtcttgggatatccacatggagtggactaccagggcaagaagcttccggagcaggacggtgacgatgcagagccccgcgccgcttgggaggtcactgcggtgatcctcaccggctctgccgagaggacttcgttggcagtcaccgtaggtggagattctttcccgccgcttgccagaacgccgcgctcctcaccatcagcactcttcaccagcgctatctggacgagttgcagcactcgccctatcgctaccaccctcgtcgaggaggagcccgcgactacgccaccttcagggatgctagctcggaggatgacgctaccatcatgcacctggcggatggtggaggcgtacgacgcggcctgtatcgacttccatcatatggtgcgccgtgggttggtcgataacaacatgaagatcctagagctgcgtcaggggaatttgcggctgaagaaggacttggacgcggtggaggcgtagctgtgttagctcaagatcgcccagggtgaggtctgtcgccccaagcgccgccgcgtctgccgcagcctgaagatcaccgcccgcaagagtacctccaggcctgagcttgttcgtcggtccttggcatggacttgctttgtggagacccctcgcgccgaatctcgccctcggttcctcaggaggagggagcctctggcgttggtagcacggaggatgtgctgttgctcaccttccggtttggcccgtcgcagaagtagacgagcagctagtaggcccgcgtgggggttcttttcgtttgttcttctgctggagtcgtgtggggcatggttataccggtgtgtggtataactgtgtcggagcctgtctttattttatttgcataagcaacttgaaccttaatgaaccaatttaataatagaaataaattcaagaattatggtagtcgtgggtggttagttttaatagtcagctctctctgtttgctggttctgtgagggattttc

SEQ ID NO: 51090 - DNA, 1501 bp, Oryza sativa
tcgttcgtcctcgccggctcgtcgtctcgcggcgccgcctccgtcgtcggattcgcagcggcgtgttccacgccgtcctcatctctgtgcagctactgctggctgccctcgtcgcctcctcgccggccccggtcgtcgtcatcgtcgtcctctcgtcgttcccggtcgtcgtggcgttcgtccctccgtcaagccattcgcgttcgtcgtccgcgttccgtcaagtgagccgctacagccccgtcatcgtctttgtcctcgtctccgcatcatcaagcctcgcgccggccgcgtctcaccttcgtccaaggatcgccgccaaagtcgttccctcaccgtccgtctccgccgcgcccgttcgtcgttgtcgttcccacgcctcgtcgcgtggtggtaagtatccctctccctcgctgctccgtcctcgtcctttcggtgtcgcctgtgcctgttgtgcggttgtcgaccccggtacccatgtaccggtgtcggtagtcgtttgtgtgtgcgtgtggtggccgtgtttgtgtgcgcgctcggtagccgcgtggtttccaagtgtgcagccctcgtggtgtctagtggagtccgtttgtcggccacttgcctcggttgacacacggggtccgcttccgtcgacccgtggactgtctctgtgtactcggtctaccatggtcccttaggttgacatgtggggtccgcatgtcaacagcgcagtcttcctgtcttttccaggctagcgcttacacatgttttatagttgtaaaacctaattacaataatccgcaaatctccatataacagcattaaacttcggatgaccatgtcttggtcatacgagctccgaatcgaaccgttcaagtctcctaatgtttgttataacctaaagaaccatgtgctttctttttatgtattgttattgcttctttataggcttgtagctttgcttgtgtgcttcgcgtagtcttcgtcgttccggaggttcccgaagcgtggtttgcggtcgtcgccgaaggttcggaaggccgttatctctgagcaaggcaagtcacatcatccttgagcatattgaatcccagtttataaaattattttgatttaaattaatgcattatcgctttatttaaaattcccgcgttatcactgttttatttagccatgcctatttatctttgttatgaccttatcattgttgttattgttattattaccttgttcaccctaggataaacaaaaccccaactagtgggtactctattcatggttccactagtatgaatttaggtagatgcttcgctgattaattaggcaacattagatggttttataactttagactttgggaattctcatatcatttggacactatggaatggttggcttatgttggaattggacacacacctccccctctattcaaaacccccaaaatagttttaggctgggctcgaggtgcgtggttgggttttgttagtcgtacctcgggtactataaggattaa

SEQ ID NO: 51091 - DNA, 421 bp, Oryza sativa
cccgaccctgggtcccagctcgtcccaagccaacctaggccaaccattccacattttagttgttaagcaggttttcagaattaaaacactaacttgggtacattgctaggcttgcccataaccgagggcgcggctattcgaataggttatactctgatcagaggtgtacatctttacccacaagacacatcttcctcacgtgtaaccacgtgccacataccaccatggtatacggacggaagacgtgacatagtttccaacccatcctagccatagacaagagtaccgacccaatcccacctacggccggaacctccgggacaggcaggcaggactgagcccctagcagcaggacactagccctgtgccatgacatctcgactaccgggccgtagctcgtgtagccttcatttgtcctaga

SEQ ID NO: 51092 - DNA, 1501 bp, Oryza sativa; identical to SEQ ID NO: 32431

SEQ ID NO: 51093 - DNA, 1501 bp, Oryza sativa
gtgacagggattgaggtgagagaggaaacaagccaggaaagaatagaccagaactagagacaggaccttaaaggaactaactcttcttgttgatgtgttgtttgttttacttattctgcaagtagattaagcaaacaacctagcatggttacatcacaacccaccgatgcaaaccacgcgctacacacacaagcaaaggaaacacacgacaaacgaaacaatagagggtggcttaggttctgcgacgggttctccaagatcttcactgcttcttcacagctggcttcactgcttccttcgcttcgctagcggaccctgtggtcttccggagcttcggcaaacaattggcgacatcttcttcttcgcaaagctgaccatctagtactagtcaaaaatccgaaggaggaagaagagaataaacattttgcaaatagcattacggaaaggaggaaaaaggaactttcacaaatagtttcatttataaaatatgtccttaggttttatccacttggcttatcctacagttgagatggctctgataccagcttgtcgcgactgaaaattttgcatttcccgaacgctagtgtattaatccccgtcccaggaaaagccggggtacaccacacaaacatgatacaaaaggcacatctttattatatcgataatatttacattattacaaaggcacttaaggcctgacaatcaaaattaaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaaggggtacaaggggtaataatataggggttaagttttgcagtaaacagcatttaaaagtcacttagttgcccaaagctattttgtaaacacgatcctagagctatacaatattattaatcaaggccgtagacccacacgaacctgccttaacccaaggcctacgatgattcagaccgaactggcaacccgaccctgagtcccagctcgtcccaagccaacccaggccaaccatttcacattttagttgttaagcaggttttaagaattaaaacactaacttgggtacattgctaggcttgcccataaccgagggcgcggctatttgaatagattatactctgatcagaggtgtacatctttacccacaagacacatcttcctcacgtgtaaccacgtgccacataccaccacggcatacggccaaaagacgtgacatagttctcaacccatcctagccataaacaagagtaccgacccaaccccacctatggccggaacctccgggacaggcaggtaggattgagcccctagcagcaggacaccagccctgtgccatgacatctcgactaccgggccgcagctcgtgtagccttcatttgtcctaga

SEQ ID NO: 51094 - DNA, 782 bp, Oryza sativa
ccgcgcccgtttcctctctctccggccgctctcttctccctcccgttgctatataattgctccccgagctccgctcttccgtttccgccgctcgccgctcgctctcgccgtcggaatcgtgctcgcgccgtgctcctctctctccgccgtcgccgccgagctccgttccgccgccgccgccgctccggacttcctccttactcggcgacacctccgtccgcttcgccgagtggttgccgaccccgtccgccgctccgcttcgcccgccgaccgccggagcaccttcgtcatcgtcatcccgaaccgcgccgccgcttccctccactccggccgccgttctcgtcgtcgtcgttgtcccggggtgagccgaagaccgccgttcgccttcccccttccctcctctctctcgggcgccgctccgccgcgccggtggtcgccggcggtgaccatcggggcgcgtgcgcgccgctcccgtcggccgtgccggcgaggccgccctcgggcgcgccctcgcggctgccaagtgggcccggccgtcagccgcccgcgcccgtgggtgcggctgacgcgcgggacccacggcgccgaccgccgccagccgcgtgcgcccggtccaccgtggaccgagcggctgacgcgtgggcccccccttcccgtggacccggtccgcgcgcccgcccctcggctgacgcaataaataggattttttaattgaaaaataaatgaagaaattcgcaaatatccatttaaagagcatataaacttcaaatggccatatcttg

SEQ ID NO: 51095 - DNA, 1501 bp, Oryza sativa
gctgcatcggtttcaatcttcaacaagaggtaaaacttattgtggcggcttgcattctcgggattagtgcttccatctttatgatactctaatcttgtttatgtgataaattgaattatcatatatcttatataatctccggcaatatcgctatctaacctacaatcggctaacatcgatctgtcagtagaagacagccgactaggttaaataccgatgttgacttagattatataggatatccaccactctatgacacatccaacggcttaattgtctagatattgtcttttttttcatacttatagctgcatcagttggatttgatcttatgagtcgtgattagaatctcaatctctagcctgcctttggttgccaattagggtagcatcggggtttcagccgatcttacctgatttgaatatatttatcttatgtgcttgattgacatgttaaatccgccctttatgttaagatctcgtcgtatttaagtatattaagctttccgtttggtatattgtacttgctttaatatctcaatataaaacggtatcggagtattagccgatacatgctagatctatctgatcggctatgctatgaacatatataatcttgttgttaatatatatttcggtctaagtgatttatactgtctcgacatggcgaccaatctatcccaatcacttgatttaagtatatatcgacataaggattatatattgttaatatcaacagctgatcaagtagatttagttctttcttacttattaatgtctgccgatcgatgcatatatgacatcggctcaagatcaatgatatgtcatcggcatctagccgatcggctatcgtttatagatttaaccgcggtttctttgtctttgtctcttgttgattgcaggatcaaatcaactggcatgctcacacacccaaaggcaagttttggacctgcactggagttaagcagatctcccaggcctcatgtttttacatcaacaattctatactagaataggaagagagtagagtagaagaagttggaagaattccggagttgtcggtaatcttctcctatttcttttattctgtttattactctgaattcaatataatattcttcttgagtaatttagatttatcttgtgagaattatctcttggttagtttctaaatagcatacaggattattgttcactataatcaactaaaacatagtgattgctttggtgagttataaacactaaagtagatattaattgcttagacgtggtgtttaggtaattattatccagtaattgatgcgtgtcccacagtacgttgaggtaggtgtagaggtggtgacagccctcgagatcacttaagtccttcctgtccgggtacgtagtagagcgacatctgggaacagcgggttgccagtgcctgaagtattgtgttaggattaaagttaagctttccctagacactaattctcactagtaaatcctctctatccaagcctatc

SEQ ID NO: 51096 - DNA, 768 bp, Oryza sativa
acggatataccaatgtagcacttcccctatggagtattacaagggtatcgaatccaagggaacgtgtatggtcagatcttcctccggttcatccatggacaccaagcaaaggataggcttggatagagaggatttactagtgagaattagtgtctagggaaagcttaactttaatcctaacacaatacttcaggcactggcaacccgctgttcccagatgtcgctctactacgtacccggacaggaaggacttaagtgatctcgagggctgtcaccacctctacacctacctcaacgtactgtgggacacgcatcaattactggataataattacctaaacaccacgtctaagcaattaatatctactttagtgtttataactcaccaaagcaatcactatgttttagttgattatagtgaacaataatcctgtatgctatttagaaactaaccaagagataattctcacaagataaatctaaattactcaagaagaatattatattgaattcagagtaataaacagaataaaagaaataggagaagattaccgacaactccggaattcttccaacttcttctactctactctcttcctattctagtatagaattgttgatgtaaaaacatgaggcctgggagatctgcttaactccagtgcaggtccaaaacttgcctttgggtgtgtgagcatgccagttgatttgatcctgcaatcaacaagagacaaagacaaagaaaccgcggttaaatctataaacgatagc

SEQ ID NO: 51097 - DNA, 193 bp, Oryza sativa
agagggatgagaaagaaagaggatgtgcgtcggcaggggatgctcaccataggcggaagcagcaggacgacaacaccgttgctcgactcacgtggtggatggatataggcgcaggcggcgggcgactctcgcgaggagattgagaccgacgctacgggagattgacttgggtgcaaggaatcaggcgagagta

SEQ ID NO: 51098 - DNA, 810 bp, Oryza sativa
tgctcaatttttcccaaacccagaagaggagttcctggaagatgaaggctttggtgtctagctcgtgcctgccgtcaagcgcctgtggtcgtcgccctagtcttccgctgtcttttcgtttgtcttcatgtgtgctgggccttcgccgcccatgtaataaattatctatttacgcttccgcttgttaaactctgtattgtatcaacttttggtgtaccttgcctcctgggacaaggaacaatacacgcacgcaaggaacgcccgttgggtgatttccggtcgtgacattgcttcgacggtgaaaacggaggaaacgatgtgagatttctcggggacaacggttagtatttaaagcgctgaataacggtcagaaaatggcaagcgcgagattctctcggaattgacgtatggcaaatccgaaacattatccaatattccggacttggggggcatgtgttaacaaccaaatttggtaatccaaggatcggagatgaagaagaaaccaagatggaattcgagatggaaatcgtcccggaaacagagtgaggatcggttgaagtctgaatcggctatgattaagatcggcaaagttcgagtcggacgaggttagccgattgagccgaatccgacaatatgacatagcatatgttgtcggtttaggttgatgtgcttcatgatgattgccacgcatggatagagtcctgagaaggcaattgtatctattaattaggatattttatgtaatttccttggagatatgtttgggcaaaagtctgccgcaagacttgtggtatcttatagtttgttaga

SEQ ID NO: 51099 - DNA, 1501 bp, Oryza sativa
ttatattatggtataaatttagatctaaaaatgtttatattttagaatgaatagagtactccctccgtccctaaatgtaatagattttggttggaatagttaacaacaatttattcactttgctcgaacaaactagaagtactgaaaaagatggtagctacagtagaaattcagttgaataggcttatttttatgtcatttttcttcttgtatgcatcgttaagttcagtgttttcaacagttctttcgaaaaggaaggaaaattttccctcatgaccccaaccatccctttcttctctccggatccatcgcatgcaatttaccaatgatagcacaattagcagataagcattgtttaatgtgtgatgccacatgttgtgcacgcaaaacacgcattcggccatttgccatccttgtacttctggacgcatgccaccccaacatcactagctatcctctcttgaatacatgtatacgtacaaactctgcatggtatggtatggtatggcttctgtacacctaccgttctctatttgagatgccctgtacacctaccggtatcaaacgacatttgcatcgatgtacgccacatcttcacgtgtgcccctgaatcttcccaacctctgaaagctatagtttcagaaagttcagaaattttgaaaattgaaacttcaatcgagtatctccagaatgttcagagagcatagatttcacatgtgtactgtaccctgataatggaacttgaatggagtactccctccgtcccaaaaaaagacaaaccctgatttccgtgcccaacgtttgaccgtccgtcttatttaaaaaaattataaaaaaaattaaaaagacaagtcacgcacaaagtattaatcatgttttatcatctaacaacaataaaaatacgaattataaaaaaatttcatataagacggacagtcaaagttgaacacgaaaatttagggtttatctttttctgggacggagggagtaactcaagaatttgaagttcacaaagattcagaattttaaggcctcatttgaatcacaggaatgtaaaaaaacggaggaatagaaaaaacacatgatttaaataggaatataaaagtaaaacagaagattgaaaaatacagaaatatccataggaatgatcgtttaattgaaccacaggaaaaacgtatgaatcaggtgagagagatagactcaaatgattttttttaaaaaaaaggttagacctcttgctaattttcctctaaaatctatgtagaattatctattccataagaattttaaaaggaaatgatatgatttaatcctttatttcaaaagctttcatacgatgttttttccatagaactacaattatctaaatttcatataccttttcctacaaattaaaataacccttcgatgaaacttctatggagtaggagtactgtactctctcaaagaaaattcagagaatagccagctagctgttgtctgttgccctcagattgagcta

SEQ ID NO: 51100 - DNA, 1501 bp, Oryza sativa
gcctccgccgccgccgccgccagcgccagtgcccgtcgcgctgcgcagcgcgacgcggccattcgccgcttgcagcgagcattcggaggttcgaactacgaagcagagagagagcgagagagtgagagaggaattttttttatttatacatttttttattaaaaaatttaccaaaataattttttgggagtttaaaaatcgtccttccagagtgcggcacaggacctaaatgcaaattttccagcacaacttgttggctctatgattttacaatttaaaattatattatataaagtcagatgaaataaaactttatatcaaaattgtagagctcaaagagatctacagctttgttattaacaactttttcatttaagatgttttagatatccaaatattcgttacaaaatataaaacatatttaaaaaaatcttagatctacatttcaaacgacattggatggagataaaccttatatgaaagttgtagatcttgatcagatctataactttatagtttatcacttttccatttaaaatcatttgaagtatcgaataagcattattagtttttaagcaattaaaaccggtggaaacggtttgaacacaaataaaaattttgcatttagttcccttgccgccctctggaaggatgattttaagatttgtaaattttcgaaacaaaaaattacttttgtaaatattttaataaaaaatgtataaataaaaaaaattcgggagagagagatgtctcgggctagcagcccaggtaaggcgttttccatgggccgggctgatggagggttggcctgcaaagcgatttcgattatgtgcgacccaataacgggattgggccttacgttcggcccattttggattgtgaattacatgcggctatgttggttgggccgtaaggggcttccagttacgtgggctctgaccggcctacagggttgagcccaatagataggtggccggagattatttggacttttggagcctattgttgtatacagtacatacagacaggtggtacagtaaattaaatgcgccatctcgttacaaattccatgaattaaaatgtccaaaatttgaaaactaagccaatctttgagatgaatcgcactgacaccccacatgcttgcaagtatccgtgataataatttgctcataatctaaatcaaacggagcaagcctagctactttctgaaagtaatagcatgatatgatatgcaaaatgccaaatggaagtgcaaatgaagagttggggacgcagcaaacccctcttgggtctggacctgtgctgtactccctgtgtactgtaatcactagctgaaagcctgaaacctcgctggagatgtgcagagttgagatgcgtagagcaggcattcgtcaactgatggtacttgagctgtagcatgcaatgcagcagcagccaggcaagagctaggcatgcaattgattgatgtcctgcacccctcttcgccggatcgccattaaca

SEQ ID NO: 51101 - DNA, 1501 bp, Oryza sativa
gtcaattctgttgaattaatggccattaattctccttagagcggatacaatagcagactattagccagctataaatatattttaatgagataaaagattagagagaagagcagcgggctacagatctgtagccagctacaacacggactccaagacacagtgtgtgtatgacatgtgggaccatatattaatagtataataagcaactattgtatgaattgctattagatttgctatagatgaattggagctagtagtgggctatactattaaccttgctcttataatccgttatgtattatgtgagttgttttgtgtgcatgtgtgttacgtagaggtcagaagtgttctcttaaaataattgtatcatctctttgtaatttaatgaattcaatagaagcttttattgccttgaaaagtcatcccagctcactaattcgttggtttcaggaaagaagatcattaattcgatcttgtaccttgtaccgtgtgagaggaatgtgacagcaaaaaggattcatggctagctggaaaataggggaaatggggaataaaaagatttgacattttgattttttttcaagaacagaataaaaggaaacaaaacactaaattcttgcaaaaaaaatctctaaagtttatttcatcttttaatctgtaatttattgcctaagtaaacatgccaagtgttaactaacttgagagacaaccacatgttcagagactctcatggccatgtgaattaaagcaaagaaacaggcgtttcaccctttagttcccagtttgttttggttaagttgggtagtatttgtcaattgccaccaacctctttattaatagataactccttttttttgctaggattattaatagataactcgacagctacccttttcctacaaaagaacacaactatgtacaggtagctagccggccaagaacacaacacacgtgaagagtcagagaaaaaaaacacagatttaaacataggaaacacataaatcagcttgtgctactactgaattagcatttgctagttttggtttctccacttatatctatttgaaggtgcattgctggccaacagttgccaatggcctctaatatcacatcttcaccacaattagggccaacaattggtgttatatatgcattcagttggtgatattccacttgtacatgttcttactctctctctgcattattcaaaatatttatcaagatttgcaagaaaattttgggcatcctactaccgcatagctatgcatcctaggtcacctttgggagaaagcaagcttggccaggttatggaatggagtccatggatggttggaaattccacttgattttgtaagtggtagatttgccttatcattgaaaaatatatgttgttatgatcatggtgtcttggtgctcctgtcacaactgatggcgcggaagctactagattaacatgtgtcaggaatgtgcaggccggtgcatatatgattgcagtcgacca

SEQ ID NO: 51102 - DNA, 1501 bp, Oryza sativa
agccgacgatggcggctagtagctagctggatgataatagctaccagtgtagatccggccatgttaatggcgatccggcgaagaggggtgcaggacatcaatcaattgcatgcctagctcttgcctggctgctgctgcattgcatgctacagctcaagtaccatcagttgacgaatgcctgctctacgcatctcaactctgcacatctccagcgaggtttcaggctttcagctagtgattacagtacacagggagtacagcacaggtccagacccaagaggggtttgctgcgtccccaactcttcatttgcacttccatttggcattttgcatatcatatcatgctattactttcagaaagtagctaggcttgctccgtttgatttagattatgagcaaattattatcacggatacttgcaagcatgtggggtgtcagtgcgattcatctcaaagattggcttagttttcaaattttggacattttaattcatggaatttgtaacgagatggcgcatttaatttactgtaccacctgtctgtatgtactgtatacaacaataggctccaaaagtccaaataatctccggccacctatctattgggctcaaccctgtaggccggtcagagcccacgtaactggaagccccttacggcccaaccaacatagccgcatgtaattcacaatccaaaatgggccgaacgtaaggcccaatcccgttattgggtcgcacataatcgaaatcgctttgcaggccaaccctccatcagcccggcccatggaaaacgccttacctgggctgctagcccgagacatctctctctcccgaattttttttatttatacattttttattaaaatatttacaaaagtaattttttgtttcgaaaatttacaaatcttaaaatcatccttccagagggcggcaagggaactaaatgcaaaatttttatttgtgttcaaaccgtttccaccggttttaattgcttaaaaactaataatgcttattcgatacttcaaatgattttaaatggaaaagtgataaactataaagttatagatctgatcaagatctacaactttcatataaggtttatctccatccaatgtcgtttgaaatgtagatctaagatttttttaaatatgttttatattttgtaacgaatatttggatatctaaaacatcttaaatgaaaaagttgttaataacaaagctgtagatctctttgagctctacaattttgatataaagttttatttcatctgactttatataatataattttaaattgtaaaatcatagagccaacaagttgtgctggaaaatttgcatttaggtcctgtgccgcactctggaaggacgatttttaaactcccaaaaaattattttggtaaattttttaataaaaaaatgtataaataaaaaaaattcctctctcactctctcgctctctctctgcttcgtagttcgaacctccgaatgctcgctgcaagcggcgaa

SEQ ID NO: 51103 - DNA, 1501 bp, Oryza sativa
atatacaatatatgcatgacagaaggagatgatttgatctgtagctgggtggtgatgtttaaacattagtactgaataatctagcattctagcctgcactcccttttttctttccttcctaccaatcatgtgaaactcacaatgagcagcaaatcaagaatagagagcaggggctagaacatatatgtatatatgcatataatagggagaatcaatgttttagcagtagtcatgtggaaagaatgaagaacatctaggagaaaaaccgaagcacaatgtcccaatttacttgcagccgtcgtcaccataccttgccatagtctgtgcctttctgccgtcgtcgccatactttgccatagcccatgccttgccgccgtcatggctttggtgcccaagctgctgctcttgctctccccatcctccttgaaaccggtcggcacgtgtcctcctcgtaccaaatccagcagcccctgagctggatctggcaccgaggggaggtgagcggcgtagagaacgggaggaagagggtggagagcagcgttgtattgccgaagagggccacgaccgaatccgccattggaaaatcgagggaatcggacctgggaccgcatcaggcatagaggatagggtgagagagaggctaacgtggagatgagatgaaagaggaggagagggtgcagtggcttgcaccactctcgtcattgcacccctctcgtccgggcaaccgacaatccaccagcgaggaggccgccgttgccggatctggaagccctgccttcctcgccggcgaacatgacgggcctacctgccggcgcgggagcgaggtgtgattttcgtcttacgatttataaattatttaataaattgttgtatgaatttatattaaatgtttattaatttatgagttaagttaaatgtgggaaataaaatttcctaaatataaagcatggatgaatttaatttttattaaattctccatgattaattatactctctggaattttctcagatttttcagagctcaattattaattttagtaatacaaaaaacatttcattaattagttaatcaataagataatcatgaaatgatctatttgtaattttgataagtgctttgcttgtttaaaaatccttaaattataaattgaatttttataaatgatcttaaaggcctaaaagaaaagatctaagtttagtttaataaatatcaataaaaatgggctagataaaattttggtaaatacttatcttgtttctatagttcctagatttttatgggatatatttgagccaaggaagtatttttaataaatggaattgcatttcatgaataaatttaaatagaaaaggtttttaaatctccttttcggctttgggccaaaagtcggcccagccttccctctctcttctccggccgcgtgcgctcggcccaagttggcccaggccgagccgcccctcctccctacatccccttgtcttttctttctttgttctcagc

SEQ ID NO: 51104 - DNA, 1501 bp, Oryza sativa
actaaaattggtggtagtgtggtaaactctaaataaaaaggtattaactctagagaaattgatatttcatgtgctctagagatggttgaacgggaattgaaagggtatttgttggaggtgttcgggaatggattcaaaggaaatataatttagagccaaagttagagattacagaaaataaatggaaaggttttataaaatttaaaagagcgattaactttgcaattaaagtttatgtccaaaataaaagaaaagattaaaagcaatatcactccaacgcaagaatcgagaagagcatgacttaaaaataattcgcaaaaatttttccctgaaattttgagtccgtttcaataatgattgcacacggctggcacatgacacattcatctggtgaacaaaatatatactcatctccagattcctgtaaaaaaaacatatctccagactccacatatatagcatgggcattttttggaatcccatatgccatcagctccaatctttttggttatctagttaactacaaacaaaggactttcagaaaagacaaaccattaataatattgattggtaccatcagagaataaaaggagatcataaataagatggttaatatcaagaacacataacccataagcacatactaaagttggtgatttctcaacctggtgataacaattgagaagagtatgaatctactacagacattgcatctcttgatctgtctctgctcacagtgctacatatatatatattgcattctaaaatagtaaatactatctaaatgcccaaaatgtagataaaaaaaagaaaacattggactattcatatcaacaattttagccatttatatctggtattgatactaccatctatatttagggcatgtctcaacatgctgccaattatcttgttatacaaagagcttgaactgagataatgaagagatcgtaaaaatgtgtatttgtggtctattaaattctggccaatatcaaaatctcgaactgaaatatatatatttttaaccattgtagttgtttcaatataattcccgggataatggagcctactccagatatgatggctaaaagacttgtacctcaatataacatcgttactttaaagacgccacaattatctgtctaaactgaagcctgaagaccatgaggttcatctctttgaaaatgaactccagtatccaaataaatataggggcaaaaataggggagcaacaaatcaataaaaaatcaaacagaggcaaatgcactggaaggaacatactggcacattcgcattccttggtaagaaataaaggaattatagaatatatagctttgcattaaccaagtggcttaagtataaaccaactggcttgttataaactaacaatattatctgaatatcatctaatacaatgttcaaccatacttcagatttttaaggtaggaaaaatgtactgacctccctccttatttagggtgaacaccttattccgagtcca

SEQ ID NO: 51105 - DNA, 286 bp, Oryza sativa
cggagcagagtataccgatagctccggtactcctcccgaattcctcctaggaagctacactcgtcgaggcagaagtcggatgagcgccaaacttctgggcactcctccagagcttcctctcactctctaccttattctaatgtataaaagatacaatagagcctcttgtaattcagctcaaagttgtgtgtgttggaatgagatgaagacctccttacataggctccaaatgacggttaggggcatgggaattgtccaaaacaccctgcaaccgcctctgggaagg

SEQ ID NO: 51106 - DNA, 171 bp, Oryza sativa
gactacggcaataccctgaactattttagcaagaggaaaccactcgttcctttgccacctccccgggaaaattttttccccccctttaaaatttggggggaaaaaacccttccgggggggttttttccctcgggtacctacgagaaactgtctgggtgttaacatccataa

SEQ ID NO: 51107 - DNA, 1501 bp, Oryza sativa
ctaaatttcagaatacacataataaaattaaaagaagagtttagagtccgtataaaaatataatttacgaataactaaaattcaaaattaaaaaaaacatgggaaaaagagtctaaagtcaatataggaatacaatttagaattaactgaaattcgaagttaaaaatttaaaaatattgaaagatgagtttagagtccacatacaaatagaattagaaaaaatagaaattcagaattaaaaataaataatattggaagaagagcctagagtctatatagaaatacaatttacagataacgaaaattcggaattaaaaaaagaaatattgaaagacaagtctagagtctatataggaatataatttacaaataattaaaatttgatattaaaaataattaataactaacacgcatataaaataaaatatgaatattacacattaatagtttcgtaaagttagtacaaaatttaaaattatgttgtcattttaatatatttgaataatacattgagaaaacatatatgctattatatgagagaaaatataatgatactagccgcgcaatttgcgcggaccactatgctagtttatactatctcaacaattagtaaaattaattttctactactagtagaactcataaatcaatagatcatttctattagtcataatattggtagtagaacactgtcaatagaagtcactgtactgtatgtaaaggtactcattttagtagtacggttagcatagcgacagttatgagagaaaattaacatatattctatgaaactagagaatatttcttcaagggagaaagtatgacgattacgagagccttgtgacaacgaggctcgtcaaaagaacgatgatgaagggagattgggagatcacatatattcccttcttttaaaagtgcaagctgaaagcagcaatgatagctgctagacagccaagtcctttgtcatgccgttggcatggtatttactccctccataaaaaaataattaaatccttagctataaacctggatagtattttttttaaaaaaataaattctagctatgaatctgacaaatgctatccaggttcatagctaggatttgatttttttttttacgaaggggtatctaattaagcacattgtgtgaaagagatgttagccggcccatcagtacccactctgccctgtgcgactcgtgagaaacatttttttctgaagagataatgttctttcttttctttggatgaaaagtgatcttgttcttatcttctgagttctgatacaatataatgtaatccttttttcctcttgttctgcattattatgatattatccttgtgaaattctcttatctttctttcttttttaagcagatggaatgagctctacgccattcatttcagagaagaaaaaaggatgatagcttgtgaatatcatagggacaaaatttcagacaaggtgacatctgaacttctgtagttttggacacaacctaaat

SEQ ID NO: 51108 - DNA, 1501 bp, Oryza sativa
tctgtagcccgctgctcttctctctaatcttttatctcattaaaatatatttatagctggctaatagtctgctattgtatccgctctaaggagaattaatggccattaattcaacagaattgactaaatcgtcatctatgtgattctgggtaaaaatctttgaccacccactctgaccgcatgtgattgaagatcagttatattaatggtgaaaagaatgaaaagaaaaaggccggttatatcaggcgtgcatggagaaacatattaatcaactataggactgaacaaagatcgaactgcagatttgtaggactgaactggctgccgaagcatgcatggaaagaccaatatataactacagtacttaaagtgaaaagatgagagattatatgcttttagagatttaaagtggaatttttttgcggctaactgcatgtgtgtgtgtccggagtcaaaaggcacctcttgttagttgtgttaggatcagggcactcactctacagtttggcatgcagctactagatatacttaattaactgtaaaaaggaacataatgcaagttcagttcagttccctgtttcttctcttctttttttttcttttgagacaccagttctgttatgtttgatttaaattattatcttatattatcgatttgattaaatgaaaaataaatattttaagaaacaggattaacagatagcttaaaatgagtggtctaaacagttcactagaaaaatgtttttgagaaaacgtatttttcgaagggtataacaaataatctgtttcaataatccgacacataagctaaaaaaaggggcatcaattcatactacaagttttttttttccatggactatggttgcattagttcatggtaaactaacaaatagtagtgttttggttggtgttaccaaattaattaaacaagacaggacaggacattctaagagatgaattgaaatggacatggaatgtataagctgatgttttcgggggcattttgactctcattcataaatgtacatcagaccatggatctgtttgactctgtttttttaatacatcatctctcttgtcaacccttgcatcttgaaaagtcaatgaattttcttcagatatgagagcgatggaaatcaaactcgatcgagaggaatgagccgggatcatcacacactgaatgtctctccatgcattttctgcatatgcatgcttcaggctttggtgcgttagtttgctgtctgatctgcacctgccactacggatgactgaatgatgaacaaacggagtcaacggtgtgagacacacatatgccctgctcctggagtcaacgacgatgtactttaagtctctttaacgcggtctagatctcgatgggccgatgcatgatctgatcatgtactacactcagctgaaatcattgtagccactaacaaattaagacacaaagtgatgatcgagtgacagtggccggtttagttaggtctactactcgatcgac

SEQ ID NO: 51109 - DNA, 1501 bp, Oryza sativa
ggcgcacaacgtactaacgtgtgtatggccggtgcagtgcagtgtacagtagttggctagttgcaatatgtagtgagtgagactgtctccaacaagtgacccataagggcacctaaacctaaaataggtctttgatagtactatttcagcctccaacagagtacttataaagaagacccattttacgtgctataagaggcataacctaaatctgagtatcctctctcctgaagacctatttgcagtaagggttctcttttaggtcttattgctggagaagaccaaaaataggtattgaactctttgactgtagcgctatgcaaacgtgaaatgggtcttgtattttgggtttcattgttggagatagcctgaggttaagggtctgttcactttgatgttattttcaaccataccatttttttggtaaagttatctaaaaaatatctatgtttagtttgttgccaaatttggttaatacataggaaatcatgttaaaattttgataatattaccatcttactgaaattttagcagtgctaaaacttggtaaggtttattttggctacattctgaacaagccctaagttttttttaatagcttaaagattctgagaagcatattggttgattattagtttctaaaaatatgaaaaagctgagttttctagcttttgactttttaatttatgtttaaattatatattacaataactttttaaatatgaacgaaaaagctaaagtactagtttgaaagagtttctgattctaaaagaaactgtagctgtcatacgttttcccaaatagatcttaaagttagtgagctgttgaagtagtacgtaggtgtgtttgtggcaggtctgtagcatcgatccaatttattcaatccacccaaatatacgttcgtgggtgcgtgtacaggtcgggccagcaacatgcatgaacagagtagggtccctatcgttcggctaaacggctaaatttgtagataaaaattttataaatatgttcttggtgacttaaaaaccaatgttgaaaaagaaactacgttaaaaatatcttaaaatcaatcttaaaattaagtttaaaaattcaaattttgattttttttttctttggctgattaggccatccgataggagcctagctagtcagatggatattaagctagccgtacgcctcagccattgagcatcgatcgatcggtgaatgcatatgcatgcatgtttagtcgatcgacaagctagatcgtgtcagattttgagatgagatcctccttcgtcgtcgtcgacccaactccggccggacgtcaggccacgccatgcatgcgccgccgccggccggtgagatgagatgatgaggatcgagctggcgatcccacctggcctgtcgctgtgacgatcgagtgcactagctcacgcactgatcgatcgatcaccgcgtaaatactacgtatccactatatacacacacgttgtcggcatctgtcaccgtcaccgtcagt

SEQ ID NO: 51110 - DNA, 1501 bp, Oryza sativa
tcgaactagatttgcagcaatatggcatcaatgacatgccctttttatcccagagagaatactaccagtgttgtctcttctgtgttcttgcatgcatgtgtgtgttcactgtgttatatgcagtgaaaattgtgagatgatatgcctaagtgcaattaattaaggtgtgggtgctaataaaagctatgcatatgagcaggagcttccttcatggatatcttatctcgctctgttgtggataactggctactgatcatgatgttaatgctagcagatactccctcgtcatttcatcttaaaatatagcaacctaataatattaggattcgtagtattaaaatatatcatatttcataccagattactccattttaagttagagggagtatactgaagcttagattaaaaccgcatattccttcaactaggatatgaaagaaagaggtcaactaatagcatgtttggaggagcttaaaattccgagaagcagctaattggtagtcaacatttagaaaagctgagtttcccagcttctggcttctaatttattttcctatagcttcttaggatttgtagcaaaagatagattatttgggggagcttctgattctcgaagaagctacagcagttagaagctcccctaaatagaacctaagaaaggtccatatagatatagatagagaaaaaaatcgagatatttaactatttaccactattgcaagtgacagttaaggatattttaactatttaccactattgcaagtgacaattaaggatattttattggactcacatattatagactgcgagtgacaaattcttagttgccacatcttaaaagtagcaaatagttaaatatcctggggaaatctgcatattgttgtttgtcaattgtgatgcaggcttaaattgtcatccatgaaatattaatccaggaaaccccatgtagaattctagcccgaataatatttggcgtagcccagatagtcatatggcccatcagttggcccacataagaaacacttgcaaaagcttctagaaaataattcaaatggctatgacaatttttgaaaaaaaatagatatggtgataactaatcaagattccccaaaaattcatctgaaaatgcaacatatagtatgaggaaagagactaattctagcaaagaagaaaaaacagtggcctttattttatgacctccttccggtataatctctcttttctcgcctcatcaacttttggtacatgaaaattgagtggaaaaaatttaaagtaaatttcactttagatcatattttttttagatcataattttttttactgatgtttcacttttgatcaccgtttaactcatgttttcactttagaccggttaaactttctttgttagtttgtttcactttagatttttttttgaaactgtaaattcgtatttctccattttggggaaattttttcatatttctttccaagtgaaaaccactgagaacgtcgtcggccc

SEQ ID NO: 51111 - DNA, 1501 bp, Oryza sativa
acacgctatacaagactagccccgagcatgctttcctagcctccttcgtccttgtcggtgatcctcctttacccttatctttctcctccagcttgctacctcgtctttcctccatggtacctcgtcttctccacttatccaccatcaatgttcctgacttcaatttttcgttgccttggttttctagttgtattttgccccatccattaggccatagaatcaaatccatctccagcgggtgccaccaaatattgcggcatcgccatactgatttgttggactctaaggttgaggcgatctatatccggtaacatgattactcaattgaagttcaaatcacttgcatgatcaatttgtttcccctctagctacatcttctttctttcatttgcctttgatactactattagaggtgagtttttccttttgattttttttggagggcagggtatggcgggggatgctgttttttttttgtttttttggggggggggggtacccaggaatagcatgcaaaatttgcaatctcaatgtttctagttgatacttgtagcgttagttcgtcacacatgtattggactattggtagcaccatatgggacactagtaattattttttccagattcgtcacaattttgctaccaattaattaggctggtgatgacacatatagatatttgtgcttctgcaagcaagtaatctaagtacattttgagcatgtaaatcctcctggctggtgctattttccttttaaacgagtggacaaataacaagtgcagtattggcgcgattaaattgtgtgaggtaaattaaaaaaaaatctccacatttcatttttgtttatacttaccagtagcacattgttctccttactatacataaatatgtgaaccccttaattaagcccacaggacaatgtaggtttcttggccggcataaatagctaccagaaaaaagctgttaatccaaaattacaaagccatcatttccaaaatctttatccaaagaattcagttccaaatatgtctcattagtaatggatattaatccatcccattctcacactcaaagagatcaacagaagtgtgcacacaaccaaaagggcaagaaacgccactgcacgcagccaaaagttcagcaagcaaacacaccgagttcttgttgcacccggcgcccgaggacgtggtttgcgcctccgccgccggcgtgatcctgcgaaaccggcgtgtccgggctccaggagcccgcggcttcgtcgcggccgccatggcaaaaccgggggttcgctgttctttctttgcctgacgaaatgtgtcgtcaggtggtgcactcctcctcctcctgcttctgctgctgtctgaaaagcctataaattggaggatttgatggctgctttacacacaaatcatccatccatcgatcgatctcgcattcattagcttgaattagctagttggttagtgtgatagtgtgtgtcgatctggtgtgttttgatcgaga

SEQ ID NO: 51112 - DNA, 1501 bp, Oryza sativa
tagtactccagtatttatttacaatagtcatttgcaaatgtttaattagagttgaagaagatgcatgacttgtgtgtctgttgcacatgcattgctgctgcaacagtgaggctccttaaaaaaaataaaaataataaattgaaagatgccgcaacacagtgagtactgagagtagctaggcttgattttgttgacatgtgtctctgtggctatttggtagcagcatcttaccacaggaaacgttgaacctgaccgcccacatgattagcaattgaccatccagtaaacggagcagtagattaactactaatgtggtgcttactcctaattaactactttctttttttaaatagatgtccgctgttgactttgactcttagacacacgtttaacattcattttattaaagaaattttatacaaatacatgaaatataaattgtgtttaaaatactattagtgattataaaataactcaccacaaaacaaatattaattatatatatttttttaataatacgaatgatcaaacaacatcgtcatttattagaaattgaggtagtagcactttcctcaccacccctactactgcatttgccaggaacctacatgcgtgcatggatgcatatgcatggttaagcccaagatagctcaaaaatttacatcgattttgaaatttcatatctactctttcgctagctggtagtagtagttatcgatcgagatgctatggattccatctatcaatgttgtgttttgagtagcagcaatagatagattaatttaacttagccccatgcaccgacctgtagttgcattagtaaggccctgtttagttcataaaattttttcccaaaaacatcacattgaatatttggatacatacatgaaacatcaaatatagataaatgaaaaaaattgcacagttatggagaaaatcgcaagacgaatcttttgagtttaattaatccatgattagccataagtgctaaagtaacccatatgtgctaatgaggggttaattaggctcaaaagatccatctcgcggtttccaggcgagttctgaaattagttttttcattcgtgtccgaaaggctcttccgacaacaggtcaaattaacatccgatataacattcaaaaaattttctttttgcggagccctaaaaaccatccctggacgcgtggacggataggaatacatcgagcgaggcatatggaatggaatccattcagcagatcatcgaggcaggcaacggccacacgtgcacacatggtttcgcccaaaaaccacgtcccgccgcttctccggtgctatctacctagttcgatcgtccaccgatttcattccgcttcgtctcgcctataaattcgcaggcctagctacctccaaaacccatccatcactccatcatctatctgctcacacattcactgctgctcatcgcgtgcagagcggttaactgaaatttgatttggatcatagttagggattgaattagga

SEQ ID NO: 51113 - DNA, 1501 bp, Oryza sativa
cgtgtacaaggaacggatgcgccaaccttatactactcaagtcatataagtggccgattataccatataagcatctgattatgccacattagcgattttgaaaacattggtttacatacatttgagtaataaaacagaaaactcaagcaagcacaccatcgcacacatggcaatccgttatctttgttttcttctgttgtccccttttgtgcaacaatactaacagttttgtaaaagaaaccaacttgttatcaacttaaggggaaaacctgaagttcagcatgtatatagttttttttttcatattttacatagcataataaatagtatggtctctacccatgtacgtcgggtcaatctagttaaatagcaaaaggaacaagaaggtggaggccaccagccattgtgatcatagataaaccacctcttttgatctcctaccttgcactcaataaaaacatgtctttttatgatgctcaagtttttaataagatggtatatctgatactctgaggtatgaaaatttgtactattctatctgtcccaaaatataaaaacgtattaatctggaaaaaaaaatgtgtctcatccattactaattttttatatttttgggatgaaggtagttaaaaaaaaattggtaccacttaacaacagtaaaatcttttgttttttggttctgtttgtttgtgtacatactatagatatatacagattcaaataatcgaaaaaataaggaaggagatggtgttcttttaccatggggaacttggacttggcggcggcggcgcttgacggacatgaggcgcatcagattcagcatccccatggagatggtggtggatgactcctatctgtctcaggggatctctctccggcgatggccactgtggtgagagaatcgcactgaaattagggggattggagaggcaaattaaacgagagattttccttttaggaaggaaagagaagacattgcaagcgacgcgtccgaggcatccacatctacaccggcagtggtcgtcgacggcatgcggttttctggaccgccggcgaccaaagagatcacacacaaagagcgcaccggagcaatgacaacatcatcacaccatataagctaagattggcctagcctggtcggttagatccaagccaggctaccaaaattagagatcatagattgatccacttcagacagttcacgtagaggctgatatatatggttgccatttgccaaggcattcgaatttcaacaacactaatgctgctgggtaagcaaaccatatcaatacaactgcaaacgatgacacatgcatggatatcaggttatccaatgattcagattggcacttgagaaccaagcatcagattgtcactggataaccaatcacacaaaccagtttgtcaggacatcctttggaatgggtttcaggaatcaatacagatgacttgcaaaccacatcaaacaaaatttgaaaatataatacgcacatagcagggc

SEQ ID NO: 51114 - DNA, 1501 bp, Oryza sativa
caccaaaggccacggttgggccacaacagcactctcactgcaggcagtagcccctacagcaaatttcctacttaccaatgcctccttgcctgccatgccaccatccacaccctggaagctaacaaccatgctactcctgtctaccatcccgtttttcaaacccgccatgtcgactcccacgctgcccactaccgtcggtcctagcacgctagagaagccaacaacactcaacataccacaaagcgtgaagccggcaacaatcagtactataaaaccagttacaacatagacatttacatgtcctcccaccaacgaaggcaagcaaagtagtagcactatcaacccctgccgaaagccatgtcgtagtagaagtcatgggaataacgtcgttcatggcacttgtcagtgccacaggcacgacaaccttcgccgctcattttgtccctgccacaccgatcgcggacgacactccgcccgtcgccgggaagtgttggctagtattttctccatgccagttcgctctaaagccaccacctattcttcattcagcatggcaaccacggtaccatcggcctccatcgtattccctacggtgatgcaacgttccatcaccgccatcgtacgaccatacatcgctgtagattgggcgacaaccaccccttgttgaccacaaaatcaccatgtccaccacctctcactgcaccacggtaccctcgacctcaattgtatcccttgcggcgatacaatgttccaccaccaccaacgtacgaccatacatcgccgtagcttggacgacaactaccccttgctgaccacaaaatcaccttgtccctcacctctcaatacaccatggtttgctaccccacctctctccattttggaccttatcgcctcatgacatcagtgtacaagggagatggtgtcacaactcttggcggctcacgttgggtttacaagtttgaacagtttagaatacgaccccattgaactacatgaatttatgagtttcgttcagaattatattgaatcctatcaaaatttatatttgagttggatataggttcaaagtttgagtgattttcgacaaatttacaaaccctagtaacaaacgcttggtggtcaatggagaagagaagttgggggaaaaacaaaagggaggagaaagatggaaaaaatgaccgtccgatggtaacggatcatagatactgcacttgaccgacctacacctcttgcaaatggcaagtggcaagcatcagccgggcgcacctgggtgccaccgtctctccgaccctaagggcggtagcaatgcgtcctagcaaattgcaatgccacagctgccatgtaggcttgggaactccaaaagacactacacccacattgcaagtgtagcaagttgcttgtggttggacccacccgtaccaccttttttactttgggttaatttgatctatgccattgcaaatgtgactattcagaaaaatgccattacaattcgtctatt

SEQ ID NO: 51115 - DNA, 1501 bp, Oryza sativa
ccgccgctccgctcggcgccccgccgccgccgctcccctccgccgcgccgccgtcgtccacggcttccgccccgacgaggagaggtggaagctggggcggcgtcgactgaagacctcgccggcctcgcccgttccccgctcccgctccgctgagagccccgccgccgtcgccgccccgtcgccgtcctcgatccgccgccgccgccctcaatccgccctcgatccgccgccgccgccgtcgccgctcgggccgtcccggcgctcgcgcctcgcgccgcccgaccgctccgtcgccgctcggaccgccggccgccgcccctcacccctggcccgagtggggaaagagagagagagagagcggagaggaagatgagaaaggaaagagagagagagaggagagaggggaggatgaaaaggtaaaagggttaatttgatgagtaaatttgattggtggcacagaaattgtcctagtaccaaaaaaaaatggcacagaaaatttatgctttcatttgaaagcacagctccgttaaaatcttctggtttatagcactcccgtctcctttagatataatggtggaactagggatgaaattgccctcactgtcccacaccagaatacaccgatttcctttccctcgttcccttctctctgtgtgctctctacggcagcggtggcgcctgctcgtgcggcatgaccacttcgtcggctacccgaatatcggccatccacgaataactgcggcggcacgggtgcggcgtccaagcccagcagcgcggagctcgtcccagcgggcactgtctcccatggagtcctcgctgacgccgatgtcgctgtgacgcccaaaatagcaagaacaaaagaaatgcgaaaacaacagtatcgttggttggctttgagcaagcaacagcagtagcagccagccaagccgtgcagtccccatccaacaacaaagtcgtcatcgtcgtggtgcttggcctcctcgagcacccaggcgtaggtgtcaacagctagtactacagaaggcagtgaggaggttcggatccaaaagcatggcgaacgggctccgacgatagcggcgcggtcaaacgagctcgcgaccgtagagacatggttgcgcgggctagatggcagccatggcaacgtggccacacgggatagacggtgccgtggcgtacgggctcgccgccatgccgtcgcgcttggagagaagcgaacaaggcagcagaaggaagatggtgaaacaaaggtccttttagtctttctgcattccgattcctttgactaatggctaaactgacagaagtgctgtaaaatcaaaaaaaattgacggagctgtgctttcaaacggaggcataaattttttgtgttattttctggcactgggtgaatagctgggctatcaatcgaatttcctctattttgattcatgccattgcaaatgtggctattcagaaaaatgtcattataattcgactattcgtaaccgtgccacttcaattt

SEQ ID NO: 51116 - DNA, 797 bp, Oryza sativa
  unsure (1)..(797): unsure at all n locations
tccaacggcttgattgtctagatattgtcttttttttcatacttatagatgcatctgttgagtttgatcgtatgagtcgtgattagaatctcaatctctagcctgcctttggttgccaattagggtagcatcggggtttcagccgatcttatctgatttgactatatttatcttatgtgcttgattgacatgttaaatccaccctttatgttaagatctcgtcgtatttaagtatattaagctttctgtttggtatattctacttgctttaatatctcaatatagaacggtatcggagtattagccgatacatgctagatctatctgatcggctatgttatgaacatatataatcttgttgttaatatatatttcggtctaagtgatttatactgtctcggcatggcgaccaatttatcccaatcacttgatttaagtatatatcgacataaggattatatattgttaatatcaacagctgatcaagtagatttagttctttcttacttattaatgtctgccgatcgatgcatatatgacatcggctcaaagatcaatgatatgtcatcggcatctagccgatcggctatcgtttatagatttaaccgcggtttctttgtctnggncnctnnttgatcgcaggatcaaatcaactggcacgctcacacacccaaaggcaagttttggacctgcactggagttaagcagatctcccagacctcgtgtttttacatcaacacgcttttggcacgcctggtgggaccattagaagtcagaaccgcaacagtattctctca

SEQ ID NO: 51117 - DNA, 1501 bp, Oryza sativa
cgcgttcaaacgggcggatttgcccacgcaaatctcgccggcgccattgatggcggccggacctcccgcgccggtttccttccactccggccgctctctcccccttccaaccctatttaaaccctccccgcacctcctccgtccgtttccgcctctcgccgcccttcctcctcgccggattcgagctcgcgacgttgctctctctctccgccgtcgccgccgagctccggtccgccgtcatcgtcgccccggaccgcctcccacctcggcgccgcctccttcgggttcgccgcatcctcgccaaccttgtccacctctctgtttcggtcgccgaccgccggaacgccgtcgaccccgtcgacccgagccgcgccgccgcctccctccgctccggccgcctcctccgtcgccgccatcgccccggggtgagccgtggaccatcgcctcctttcccccttcccacccctctctcggccgccgctccgccgcgccggtggtcgccggcggcgaccatcgggtcgcgagcacgccgtctcccgccgaccgtgccggcatggccgccctcgggcgcgccgagtggctaccgcgtggggcccggccgtcagccgcccgcgccctcgggtgcggctgacgcgtgggacccacggcgccggccggtgtgagcccgggtgcgcccggtccaccgtggaccgtgaggctgccgcgtgggccccactctcgtggaccccgtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaacgcccttttattttccattggtcgtgtagacgttgcagcttcggaagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttaatatttccttgttcaccctagaataaacaaaaccccaactagtagacactctactcatggtaccactagtatgattttaggtagatgcttcgctggttaattaggcaacattaggtggttttacaactctagactttgggaatattctcatcacctggacaatatggaatggttggattattgtggaattggattcacacctccccctctattcaaaaccctcaaaatggttttaggctgggcttggggtgcatggttttgatagtagcacctcggccatataaggaccggt

SEQ ID NO: 51118 - DNA, 1501 bp, Oryza sativa
acggccaagctgaaaccgcggcggatttccttgtttcgtgggagacgagacgagacgacggctgcccccaaaaccgagggctggagggcacgcttcacagtgcacacacatatgcttcatcttctccagctatccatgcagcttccgtccattgcagtagtagacaatcttatccactgctcattcatgcattcgattatattctcttctcgtactcgtaaagaaagatgttttggacagcgaaacggtctccaaaacacaactttgacttattgtttctataaaaatatttattgaaaagtgatatatgtatacttttataaaagtatttttaaaacaaatctattcatataatttttatattttcaaactcaacaaattaagagttattcatgatttatattcccaagggtttgatcctaaacgacttcctttgcgagtacggatagagtactatggattacttaaagtcatcagagcaaatttaatagcgtaagcatatgctagttctaaaaattaaaacatcgtcatatcatccatagccaatttactagcgtataaaaaatatttttcatgtaaatatacactacatcattatatttggcccatcatatcttggagcacagctggtagaacaagtttataactcgttttttctcacttccgcgtatgcttaattgcttatactaatcagatgtaaaaaaaaaaattagccaggcagactgacaaaccggccagtacgtgtcacctcccacgtgtcgccgttctgttctggacggtcagattcatctcgcctctgaaaactcaaaattctttttcgcagtaccttttaactctgaaaattgactagatgtactgaaaagagtcgggtacaacatgctccatccgtttcaaaatgtttgacaccgttgactttttagtacgtatttgactatttatcttattcaacaaatttaagtaattatttattattttcatattatttgattcattgttaaatatactttcatatacacatatagttttacatatttcataaatttttttaataagacgaatggtgtcaaacattttaaaacgaagggagtataataagcgccacatgtcattgatggcaaatagttatttcaagtggcaaacagttaaaagcccccggtttcagagagagaacagttaaatgcccccggtttcagagagagcatagtgccaccgaccaatccagcatgcaaccgcctcccgattcgtccctcccactcccactcgtggtttcacctcaaaaccatggtctccttcatgcttcccgccttgctgccttcgcatcctcctcccttgcattgcgttgcttgctgctgcctataaatccagagctccccttcaagcaccatctcaactcactctcgatcaaactagtagccagtactcctcgatctccttgggttaatcacctccttcgcttcagactttctcttcagctcccatcccatcatcgtcttgatcgcga

SEQ ID NO: 51119 - DNA, 1501 bp, Oryza sativa
tccattgctaccatttttgtctctgccgtagatgaatgcaacagttgaacacccgattgctgtgaatctgttcttggcgctggaaaccatatggtgattaccaagtcgtaatcctcctctggacgtccatgcaattggatcaaattcattgttgtacttccatgctaccgtccctgatggtatatcggtcaggatgcgagcctcactctggactacatcaaaattcgtgaccctaatgtccggtctgataaaggtatagtacaggaaaaccgttagtacaggagtagttaattattttaaacttgaaaatgaatttatctgatattttaaagtaatttttagtttccgcatgaaattcaccgtttaacaatttgaaagaacgtgctaacagaaatcaagataaaatatttattttaatcagaaaatctgacccaatataagcttgttcttgcttgcatgagatattaaagccgcccttcggtcggaagcaaccttctcttatgccaaacgggtagggaatgttgacgttgccgcacttcgctggagctggacaatcgggctggggctgccagatacttccagacccagccctagccccgtcagatgcaccactatgctgtagtatcagcagcatcaggctggttgccacaagtactaaggctcccatcggatggcctaatcagtaaaagaaaaagccaaaatttaaatttttgattttgtgatattttcaatatagtttctttttcaacattgatttttaagccaccaagaacatctatataaaagttttacctataaatttatttttattccataaaaaaccaaacgatggggacctaacttcttacccaggtaatgagcaaagaggtttagagcaagtttaatagtactagattcaaatcatctatagttaatttaacagtcaatttatacaatagttgtttataaatatgtaccacactagtaatacctggtcccacttatcagacaaacattgtgtcttgtatttgtgctgcagctggctacaaatttgttcttctcgatgtgtgtttatagttggtttatagtatgctattgtgcctgctcttacaataccgtcgtaaccatatttgtcggtgacatgggatcaggagtatcatgactagaggtttgaggcagacacaatcgcacacgtagcctggtacccccgagggacgtcgggcccgagggtgatgcgttcgccctcctcttagtccccccgagggggtcgggccgcacccccctcggccccgagggccgaggcgccccgacccctcgtgggtttttgctccgcgtgtatgggttaggtgagcacagtgggactcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtca

SEQ ID NO: 51120 - DNA, 1501 bp, Oryza sativa
gtcactgttcagtttagttcattccactcctgcgtgatcgaactggactaatattttttccatgttgtataggaagctccagctgttattcagtcatactacaacaaaaggattgttggttgtcccggtggtgaaggaggtatagtacctgtgcatgctaatttccttgtttttgacctataaagaagcttctaggatgaaatcttctcctgcatcttctctataaatattcatcgactaaccaccaatggaattaacttaaactgcaaattgcaatgattgatattttcagaggacgagcatgatgtcgtgtggttttggttggagaaaggcaagccacatgaatgccctgtctgcactcagtatttctcggtatgttggtactttctgttgacaaaatcgcttgccttgtgagagcaatttctgcatgagccactaaatcgcgcatatgttggtatgttgtcctgatgttcgctgagctatcaacttgcaactttatgttcacagcttgaggtgataggagaaggaggagatcctgatgggcatgacgatgacgacgatcaccaccatcattaaggttgcagaagtcacctctagcaataaaaacactggatatggccatatccatgtcaactctcaattcagatgacttggagcagcagtggattttggaaaaacaaagtttgtctttttagagatttgttcatgcaaataacaggattcagtaaacaatgatatgcaattctctttttcagcacaccttagtcgaattcaaaataggtatgtttgtttgtttgtcttgatggatgattccatgttcaatggccacctggaccatttattttggtgtatgatctgttatctgaacatttcacaaaccttggtcctgttcaattcagtttaaacaaatgaagtcagcattctgatgatccttctccctcctatccagttcagttatctttgattataaccaagcagttggatgaaacagtcaattgcttttgtaatttctttatatgatccttaatttcctactgcttacgtggtcaatttgttgctttgatgagtgagacagtgatgcattcaaacttggatttggccaaaccagcaccacacacttcaccactcactgatgtcattcacgtgaggatgcattcaaccaaagtgttaactttaccacacaaaataccgaaaattttggacggattcggcgtgacagaattccaatttgcactgcatttaatccactttattgatttgaaccattcctgatctccacacctacatatcttttcccttcatttttttttgatcaggtcagctccttactactgcaagataattagataaatccaatagtgatgcactaggcacaaacattagttgaaatgtagctatcactcttaagatttcagtgtgttttctcacatgtattaattgctaacccatcatgtcaaaatccgaaattaactcgcgtccaaagtgagcaaagaactgacca

SEQ ID NO: 51121 - DNA, 1501 bp, Oryza sativa
ggaaaaaacctgcaatgccctcgaattccaaacgtctaactctttgaaatgccagtgtctcccttccccttcctatcccttttatcaaatctcaagtcacaaatcgaagaacaaggcagctcgccaaatgagaaagcttccagcgagcgcacgagcaaggggcagaaagaagaagaaggtatccatgggtttcgcgacgaggagctcaccgagcgaagccgacgaggcaccgcagccggcggcgaggggagaacgcggagagcggaggcgaaagccgccatcttttcttctcctctttcctctgccgcgctatctatccaccacctctgcaaaagaaaaaatcgaagcttttttctttttcacttcgtctctatctcatcccaggggcaatctcgtaaatttacccgagcaaaccactccagtgccactggcagttgggccccgcgagtacggacgaacaagttaaccgaataatgaatgattaggagagacgtgattagtttagtagctaatcctctgtcaaattaatcatcgtccccttttctgctcggattaatgcctaactaatctgtcatgtcaagagcgcagaggagcactccgcgtcccaaatcccaaaccggagctagggttgctgctgctgccactcgcgagcagcagcgccccctcacgctgagccgcctccggctccctcgccgccgatcctgcgcgtgcggcggcggcgggtggccggtttgaaggaggagaggaggtaacggtagatgggttcttggttttcttttgccccccgcggctatttcggtttctagtggaagctggttgcctgtggtgtaaattggggattacggattttggccgtctgattctccattttagctgtccctggatggatagatgagtttgctgtttgtagctgattcttggtgtggtgtcattccaaggactgatacttgattgtgtgctcatcttcatctagaacactgaaaacatatgtggataattgtttatgatgaatttaggatccagtgatctctccatgtttatttttagaaaaaaaataagtttctcacaggctaaagaatactgtaaatttcaggcttttggtcgtcactccttgcgcaggatgggtgggagatatctgcattctccacctgctgttaatttaatctgtgaggaatcaacttttgtgcgctcaacaagttgctgtctccactcttgtctgtgtttgagatgcaaaacatcgaatttgaagccatgtcgaacactggtgttcaatatgccatcaagggtatgttctttctccatatctgcagtacactgtgcagacaaggctaacattttagcttcagggtagatatttagtcccacaaagaataaaagaatgaagtacattgtgtgagctttagtcgcagcctgccagaatttgataactatttcactagggatacatttgtggccggagaaggactctgaactttgtagtctcatactcacagatggtgaa

SEQ ID NO: 51122 - DNA, 1501 bp, Oryza sativa
gctccggataggcaatttcttttcataccttcatatggagtaatgtaacagtagggttatcacttatcagcaacgtctctcttaagaaaactaattttgaattaatatacttctatgggttccaacatatttattttgaataaaactaacatatctatgtgacatcccataggccataggtgatgacctattaaatacttaacttaaagtcgtgtgattatggcatgcatgtgcagaccattggataaaacctaacttttcagattgactgccatggagacggatatatcaattctttagcaccgcatgctaaagaattgcatatatgatgaagttcatcttttttagataatatatgatgcaatttatcttttttagataatatatgatggaagtccatagtgcctatctttggaggggcaaccaaccaatagaccctatgcctttccctccaaccttgaatagacacatcagtagagcactactcctgtagaaatgagatcgctcacatagcatttatcatacaacttttccctgtgacttggatgctttagcccccatctttaaatggtagagcaagtttatgtcgatgcttctggcctgctgacttgaggaggaatcaattccacgcggaagagcaaagggaaagagattacagacattatcagttgcaaatactgtttccactaaataatgctggttcatgattcatggaatgtcgatccgacgcagcaaataaaagaccaacttgtggagatcaaataattccttcctatgaatggatactgatttgatgaaggtgaaattcagtccaaattgcagctgaatgatactcagctttcataaaaaagtaaaagatccgaaggtattaattctaatttaattatgatttgcaaagattgttccctgtgtcccctgaagaatttccgttctctgctccctcagagggagctccagtgttgagactcgtcattgccaatttagatttttcatctcgtgctgccgaaatatcatagctgtagtttttttttttgtgtgtctcctacgtattctagttggtgattggtaattcaaaacagcatgaagtaagataccttaaagcttgggcacaaatgtgaactagataattatattgagatgacaaattgacaatgacaaagctagtcttcatctatgaagctctaagttaaaaaaagtgcaaatcaaaagcactaaatcccccattccctttcatcactatgaatataatctactcgatccaatattaaattggaaagcagcaacactccccccaaaaagggaaaaagttaacaaactagatcagttcatcttttgatctcttgttacagttaaacaatctgacttaaagtattagcagctcaacttttaatattcatggtgattgaaagtgataaaggaggccaagggtaaggggggagggaccaaatcggtagggtacctggagcaaatttggtagggtttgcgactgcgagccgcgcga

SEQ ID NO: 51123 - DNA, 1501 bp, Oryza sativa
ccaattagctgcttctcggaattttaagctcctccaaacatgctattagttgacctctttctttcatatcctagttgaaggaatatgcggttttaatctaagcttcagtatactccctctaacttaaaatggagtaatctggtatgaaatatgatatattttaatactacgaatcctaatattattaggttgctatattttaagatgaaatgacgagggagtatctgctagcattaacatcatgatcagtagccagttatccacaacagagcgagataagatatccatgaaggaagctcctgctcatatgcatagcttttattagcacccacaccttaattaattgcacttaggcatatcatctcacaattttcactgcatataacacagtgaacacacacatgcatgcaagaacacagaagagacaacactggtagtattctctctgggataaaaagggcatgtcattgatgccatattgctgcaaatctagttcgattttgtgagagtatattcagatttagccctggcctttgcagcctcgagggagtgcttcctggacagctccaccaccttcttctccccggcgatgaagtaggccatgccagcagctgcatcattaaccaaatcaaccatgaattaatttcccagagctcttaattatcagttgctgatctttttcaagcactattatctgttgtagtaattagctagcatcaaacatttttaccgtaggtgatgatgactgtcttggcgactgggttgcccagattggcctttgcccacttggacatacgaacactggcaaactgcaagggatcatatcaaaagttgcattggttcagaataattcagatgttgttcgcatccatgataaatgtgcattgctctgacaagaacgagcacattgtgttttttgtcacaagagtagttaattatgatcctgctaattaaattaattaattaatctgcttgcactcacggtggggatcgcggtgcagacagcagtgacggccgctgctttcagcccggcaatggccgcctctgaagtcaaaacaaaaaccatccatatacaacatcaaacaacatcacattgttagaatctaacatgcaacgatcaaacatacaatcttagcaataataatcagatatcgtgttaatagctagctaagctaggcagcaggagaagaaatcaccatgggagctctgcttggccatggcgaacttctgctcgatgagctgggaagaatccgtagccttgttcgacatctcgatcaaaacacaccagatcgacacacactatcacactaaccaactagctaattcaagctaatgaatgcgagatcgatcgatggatggatgatttgtgtgtaaagcagccatcaaatcctccaatttataggcttttcagacagcagcagaagcaggaggaggaggagtgcaccacctgacgacacatttcgtcaggcaaagaaagaacagcgaacccccggttttgcca

SEQ ID NO: 51124 - DNA, 763 bp, Oryza sativa
tgcggaggaatttgatttggaaggatttggattcggaattgaactcgacgatagattggggatttgagatcttgagatggcacggacactagacgacaagcgaagaaacaaatttcgcaattagggtttttaggaaataaattttccgctatgcgccacgacggaacgggcgctacaataaggtagatggtcaaacatcgagtacataaaccaaaaattgaagttattttagatcggaggtagtatattttgcacctcaaagaccgtatctagtctaaacatatttttaaatctttgtaatataaagaacaattttagtttaatttctcagttatctgaaaaaggaataattttagttcagttggtctcaggatacgtaagcaaatctataatgatttcttttagatagtacttatcgataatggattgtggtttccaagtttcaaacatagctctcgcatgaaacaaaactcgcatcgagccaagggtgacggtacgagcatgcgtgcaatctctgagcgtcgagcagataactaagcccatgcgaaactgatcggccatttcagggtggtgtaaaatcggcccatgcatgtgtgagctatttactgttcaatcagctattattttccggtggattattaattaacagcatactaatctcgctgccgtcctggtcggccggtcacgctgcagattgcaaacgaaaatcttgataactttcaggagcaaccggtctctgatttgcactctgcctttcgacagg

SEQ ID NO: 51125 - DNA, 595 bp, Oryza sativa
tgtacatgcaagtatatttaacaatgaatcaaatgatatgaaaagaataaataattacttaaattttttgaataagacgaatggtcaaacacgtactaaaaaaattaacggtgtcaaatattttgaaacggagggagtacattggaatctgtagcatgggcgatggcggtctccttcttccttctccgtccaacacgtgggtaatctctctgcgcagatcagagctgtggactatggtaccatgtcagcatctacatgactgatccatcaattttatgcagagatttggagggtagatgtgtgatgtgtccccccttttagaaagagctagcttagtgtacatatataaaacatacccacgacggataaacggtcactggcccttgctagctttgcgcctccggattcttgcaatggcaaccgggcctccgaatcctaaagcctaatgagacgagatgttttacactggtcgtgcaaaccagtgctacacgttgctccatgaacagtacaaacaaaggcttttagttttggctgcatggacaagcatcatcagccacaattagtagctgtgatcatgtgcgagctgctagattga

SEQ ID NO: 51126 - DNA, 1501 bp, Oryza sativa
aatgcaggcttcaaggaaaggctgttgtttttgcaatggattttatttgaactctttttttttttttgaaaacactaagtgagtgcttctcaaacgacacggatgagacagtgcgtctcgtccggtcggagtatgtgcaatgtatcagtctttaaaattgaaacaagattggcacccggccaacagcttttcaaacggccacccgggccaacaactttcaaacggccacccgggcctagctgatcccttcagctgcagatttttcaaacatcgaacccctttccacaacagtaatttcacaagcagtagtcaatcaaaactacgctaggaatcacctcacattcgcccatgaccgtgggcacggctgttcgaacagtttgttaacctctgcagagggggtacactttacccacacgacattactaacccggatcacccagcccgtggggatcagccacgacgggagacctccaagctttcatgacaaggcatttcgaaagcccacacatgtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaagggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacccaagttttacccaaattgtttttcagattttaagtttgaaggcgtccgtcgatactcgtacagggtgcatgaatatcgagacgcaactagatggttacaagggaacatgatataacaattaacaagggaggatcaatgcaacaaattaggtaggtccgccaatctgccttgcagacgggacaacagattaagtgcgatcctataagtgcataatatttttcaagcaacataattaaatttcaaatataggctcaagatattcaaaggtggcttgccttgctcgagatctggagcttgatcctcgcaatcctcgcactgcaggtcttcgggctccgaaactacacgcgaaacgggacaactcaacaaacggcaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaaggaaagagggagggattatagacttttccttgggcagctagggcgcggcccaagggaaaaggagcggaccggccgagctaaa

SEQ ID NO: 51127 - DNA, 1501 bp, Oryza sativa
aactaaacacccccttaatccaaattttcaagttatataatattgaacggagggagtatatttttaaagtcaaattgttaatccagatagattagtataatttgaatgttttcgatttatggataatgttaattactcatggatggaggatttttcgttcggcgcctaaacctaccgccaatgacagccccaaaacattccattgccgcccatttgcccaaatcagaatgggaaatgtcacttttatcctccatctaacgaagagcaaaacaacacccaggggcatttgtgcaaccactatatatttacaaagcctctcacccaccaaaccctaatctccaaatccagccgccacaccatcggggtgccgctctaccagagccgccgccgactaccgccgcaccggagccttcccccgcaaccccgtcgacgacgaccgctgcgccggagccttcccgtgcaaaccgatcgacgacgaccgctgcaccagatccgtcccctacttcctcgtcgtcgacagccgctgcaacgacgccttccgctgcaaccccgtcgacgacgaccgctgcaccagatccttcccccactacgccgtcgacgacttccgctgcatcggagccggtaccccgtcgacgactactgctgcaccgaagccatctcccacaacaccgtcgacgcctaccgccacaccggagccgggtaccccatcgacaaggtccctgcaccgtcgccgtacctagccgatgggaagacgtcgacgtccagtagcacgaggtacgcaaaattatcttgtcgtctcaagctcagatgtttatgtgtactgtctcaagctattagatgttatacatcatgtggattgatttgccgtccaacttctattaagaattttctgtgtgcaatccgattgaggtcactatctacaataacagttgatgctattgctagtttgctactgcatatggcattgtttctgtgttattcaggcgcacctttaaattaatcatgctatgttgattctcaaataaatttgtgccttaagttgccataagcatcttccagagtgtggatttcagatcaacaatggaaattttatttagattctgctttgtttgtgtttatgaatgtaccaataatttgagttagtcgtataaatagatacagtttattaggtgaaagagaatgatataatggctatatcatttatatgaccaatgttgttcactgtaaaagtgtttccagagttctcatcaaaattgtcttttaaaatggaaaagtgaatcaccctgttgtttttactagatattgaagtaaagttgtttttcaccattgatcattaaatccccaatgttgatgagcatggtctctttttttttcatcccaaatgcctagatactttattgtttctatttctgaaaatgcttatatgcttaggaaatgccatcaaaatgccatctagtattctgaccattaaaatatgtgtattcatgtaagaacctgcaca

SEQ ID NO: 51128 - DNA, 1501 bp, Oryza sativa
ttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccctttttcataaatggacggagatttgtataattgccgtccgagtcaccttctgatgagacggcccacaactacctccactttcgccgggagcaggtgcgacgtggaatcgtggctgtctactgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggatgagcgcctagaagccctcgtcctgacgggatggggcgatgcgtgcgtcagatcgtctgtcgccacctaacccgcgatctgaccggtctgtgactggtcacagaccggataaacgagtgcactgcactgcgttacatgcggcgtgacacgctcagccaaaccgcaataaatgtggttaggtgagtcccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagccctcggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcacacgatatgatctacgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcatgtgccctaccttcgccacacacgctcgctcttaatcttctcttcctccggcgcca

SEQ ID NO: 51129 - DNA, 1501 bp, Oryza sativa
ccgcgcaggcccccctttgccggttcggccggggactcagggagagattctaagctctctatatgtggaaggctcgcgagacaggaaacacacaagacacgggtgatgtatacaggttcgggccgctgagaagcgtaataccctactcctgtgttttgggagatctgtgtatgaaggagctacaaagtatcagccagcctctcccttgttctgggtttctaatctggaaaagtctagtcccccctctcagtggacaaggtcctccttttatatcttaaggggataccacatgcaccatttctctctttttttgtggggacttacccccccccctttttcataaatggacggagatttgtatagttgccgtccgagtcaccttctgatgagacggcccacaactacctccactttcgccgggagcaggtgcgacgtggaatcgtggctgtctactaacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgagtcccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggctacgtgtgcgattgtgtctgcctcaaacctctagtcatgatactcctgatcccatgtcaccgacaaatatggttacgacggtattgtaagagcaggcacaatagcatactataaaccaactataaacacacatcgagaagaacaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatccga

SEQ ID NO: 51130 - DNA, 1501 bp, Oryza sativa
cattatgaaagatatctccgatcgaacttcaccagctagttgctttaactcctgtctttcaatgggaattgtcaaaaattcctcagccataacatagttagagagtatgctactatgcttaagatagtatgactgacgaccttactagatagatttttcaaatggatgggtgcatcgatcgtgtccaggattggagttggatccttctcccaaaagaaatcatcgacatctggcagcgcagccactcttctattgaagcgctgtacaaaaagagagaacattcaccatctgtgagtatgagactacaaagttcagagtccttctccggccacaaatgtatccctagtgaaatagttatcaaattctggcaggctgcgactaaagctcacacaatgtacttcattcttttattctttgtgggactaaatatctaccctgaagctaaaatgttagccttgtctgcacagtgtactgcagatatggagaaagaacatacccttgatggcatattgaacaccagtgttcgacatggcttcaaattcgatgttttgcatctcaaacacagacaagagtggagacagcaacttgttgagcgcacaaaagttgattcctcacagattaaattaacagcaggtggagaatgcagatatctcccacccatcctgcgcaaggagtgacgaccaaaagcctgaaatttacagtattctttagcctgtgagaaacttattttttttctaaaaataaacatggagagatcactggatcctaaattcatcataaacaattatccacatatgttttcagtgttctagatgaagatgagcacacaatcaagtatcagtccttggaatgacaccacaccaagaatcagctacaaacagcaaactcatctatccatccagggacagctaaaatggagaatcagacggccaaaatccgtaatccccaatttacaccacaggcaaccagcttccactagaaaccgaaatagccgcggggggcaaaagaaaaccaagaacccatctaccgttacctcctctcctccttcaaaccggccacccgccgccgccgcacgcgcaggatcggcggcgagggagccggaggcggctcagcgtgagggggcgctgctgctcgcgagtggcagcagcagcaaccctagctccggtttgggatttgggacgcggagtgctcctctgcgctcttgacatgacagattagttaggcattaatccgagcagaaaaggggacgatgattaatttgacagaggattagctactaaactaatcacgtctctcctaatcattcattattcggttaacttgttcgtccgtactcgcggggcccaactgccagtggcactggagtggtttgctcgggtaaatttacgagattgcccctgggatgagatagagacgaagtgaaaaagaaaaaagcttcgattttttcttttgcagaggtggtggatagatagcgcggcagaggaaagaggagaagaaaaga

SEQ ID NO: 51131 - DNA, 160 bp, Oryza sativa
cataagtacataattaggcgtctgtctgacatgtcaaaccatctttatttctgcattccttcaataaaatactctgttctcaaatataggaagactgactctatgcttgatgttggaaagactgctatcgttcctaaatttgaaaatgttaaatctttgc

SEQ ID NO: 51132 - DNA, 1501 bp, Oryza sativa
tccatcgaactgcattatgtcattactgatcccaggtccaacatctccaggaaaggattttgatttattcttggagcctctgatagaagaattgcttgaattatggataggtgttagtgcttatgatgcattcagtgctagaaagttcaatcttcgtgccgccgtgctatggtgcatacatgattatccagctctaagcaccttgtcagggcgaactacaaaaggttattatgcatgcattcattgtgacaaaaatccgttgtcacgagcactaagaaataagataggctactttggccaccgtcgtttccttccaaggacacacgcttggcgaagaagccatgcttttgatggacaccatgaaaaccaggttgagccaggaaaattcagcacagatgaggtcctcgagcagttagagaaggtgaaagatgttagaccgggtaagcatgatacaagtaagaaaagaaaacgtggagaggatgaagggccactaatttattgccgcaaagtaagtctgtggaagctcccatattggaaagatttgttgctgccacataatcttgatgtgatgcacattgagaaaaacatatgtgacaacattttgggcacattgctcaaaatcgagggcaagacaaaggacacagtcaattcgaggatagatttgcatgatatgaacataagacataacttgcacttacagcaggatggcaactcagttcgcatcccacaagctcgctatgtcttgaggaaggaacaaagaattgagttttgtaacttcctcaaaggtgtcaagtatccacatggatatgcagccaacctagcaagatgcataagttcagatggttccaaggtgcaggggctcaaaactcatgactgccatgtccttctcacaaagaatcatacctgccggcataagaggatttggggacaatgatatatacgaagcaattgcagagcttggtaacttcttcagggaattgtgtagtataaatctaaggatagatgtcctcaaacgactgaaaaaagacatcccgctgatcctatgcaaacttgagaaaatttttcctccagccttctttgacgtgatggtgcacttgaccgtacatctacctgatgaggcactacttagaggtcctgtacaatatggatggatgtacccaatagaaagacgacttggcacctttaagaattccatgcggaacagggctaggcctgaatgatcaattgctgaggcctatgtagcaagtgacaccttgacattttgttcaaggtacatggaggatgttgacactagatttaatcgggacgcccgtcatggggatgggccattggatggtaacagctctgtttttatgcatggtgttaaactcataggatccactaggatatagtacatggaggatgaaatcatggataagctagtttggtatgtgctaaataactgtgaggaggttcaaccatatttggagtaagcaccatttatgtaggtttatttcacatg

SEQ ID NO: 51133 - DNA, 1501 bp, Oryza sativa
ttcctacctgtccatgatcatggaccacaaacagagcatcattcagagcaatggaatccaatccatggtaattaacaataactagtctttttttttccaagcagaactctattgcatggcttgtctcatgtgttgggatcacgtatttgtgatggatggccaaggtgacacaatgaaatactctatacatagaaccgttcgtccgtcttgtacttttggttttaaccacctctttagattttgtcctgcttttgctgttcccagacatgcgatgcacagatgacaaactgaaacgatttatatttcttgcttgttctaatctaccgtcacagcatgttcttgatgattccctttgtctagctaacgcctcgtgggcgttgcctttgtgttgcagaacgagctagatgcatgcatatggtatggttggagcctaatcctgatttgaacctaatctaagcactaaatgcaaagtttattacacctaacccaggcctaggttagtttgctttagcccagacctagcctaggcccaattggaaatcagctgcagaacactccggaatgaggaaaattcagcgctgctttagtttcagattgattgctgcagtgccatcttgagagaaaagaacacatgcaataatctgtactgccttggatctgtacagtatcgaagttaatctcacgtttccgagttcaccgacatgtattcatgcgactgtaacactcttgaattttcttcaacactgtagcaatgccaagttccatttctgtaacacactgaattttcttcagtgctttagcattcctgcatatgcctagctccctttctcttcagtgttcttcggtctttcttagttcttacctttgcaggggtctctttcgagctactggctgtaccagattagctataacttttcaattaactattccctaatccaaatagtgatctgaatattatctaaaaaaatagtgatctgaatttaaactctcgctgacatgcataaacttcattcgtggctaactcggtcagaatcggccaatgccaaggaccacggagtataccagctctagcccaattagacggcccagacgggacacattgatcagcccatgcaaatatagggaagtaattaggaaaaagtatactttgactccctcaactatctctcgagtatgattcacgtccttcaaccacaaaacccggtatgtcagtggttctacaatacattatttatgtgaatgacatataggtcccatttattctttttatttttattctaataccacataaacgccacgtaggacaaagactcggttaaaatcgccatataggcgtcatgtcatccaaaaaccacccagaggcattgtttgcaccggttttaatagatggaggtgtcgatatacccagttttgtggttggaggacataaatcatactcgggcgatagttgagggagtaaaagtacacttttcccaaataattaagctgttagcccactaaa

SEQ ID NO: 51134 - DNA, 1501 bp, Oryza sativa
taaccatacatcattgaaaaaacaccctcaacacatgtaattgtctatggtttcctgagcattgaattagtgattagaaagctaggtaacaattgatagccttggtatgaagcatgacaggctcacaatagccaaggatcgggcatgttgcatgcctggtggtttatagtgtttccagaattggaggcaacaactgttgtgctaggaaatcatttcctcaagacaagatcatgggagacaaatgtagagtgtctttacttgagtttaatttttgtgtactactgttgcgacaacaaattggaaagttaaagtttttacctttgttgcattcgtacgtcatcgtaactaatttggttctgatatacgtagaccgttggcatgatcctatgacatcacaaccaagcaaatctttgttttgcccttttgtttttttaatttttatgtactactattgcgacagcaaaatagaaagttaaaatttgtaatatttttgcattttgtcgtacaccgtacgtgcgactctgatatacagagtagtatatcgttggttcgattgtatgatgtcatacgagcaagcaaatctttgttttgtcatcttcttgccgtttaattttgatgtattacgacaacaaatatagaaagttaaagtttatacttttttttgactgaatgttaaagtttatacgtttgttgcatttgtcgtcatacttgaaatcataccttagatttctaatatacctaggccattggtacgataatatatatgatgtcacacaagcaataaaatctttgatttggcaactcaagtgggcacggggaacaccaagaatgggggtagggtgttagagatgagacaccgccatggattaactcaagttggcctcatcgattgaacattggagaatagctacgttgcagagaattgcctaaaatggtttgttctatcttcttttctacatgacaagtgttactatatatagtttatacagaattgctaaccatttgttgacagaaaatctatctccaaatcttacagattttggtctagatgtgcttcacgattcgtactctagctgcttcttctccaactccggcgaactcctctccttctccggcgtcggcaacaacccaaactccgacggagggccgatgagttagggtcccgggttggggaggtgtgggagggggagggggaagaagggggagttcgccaggcttatagggatggtcgtgggtatagttggccataaggcccgaggcccgaaggcccggcccacggcacgcctctttggcccgtcccaagcacggcaaggcccgacttgggtcgggcccgtgccggcccggcccgactgtcgggccgtgcctgggcctccccaccagcacgctgggctggcccggcacggtcgggccggcccggcacgatgggctggcaggccaggcccggtacacaaagtatagggactaaaaatagacatataaatgtcaatgtctaaagaatagg

SEQ ID NO: 51135 - DNA, 1501 bp, Oryza sativa
tttgctacaaaagatgtatgtgttagacatagtcgcaggtataaaatgaaacaaatatgtcattagagatgacataccatattctttggatttgaccactttgcaacaagttccagccactgttcatcagtcatgctacttatgggagaggtagttctaatctcgttagcaggtactccattgaagtaggccttcttcaaattataccgtgtttgtcgtatccctttctgccatacatcagcacaagcatcccttgttggctggtgtttttggttaatggccaacctgacctgatggtttgaattgcaatcattaaggagtaacactaggtcatataatagatgaaatataaaagaatatagataggctcttacagataacttgcccatgaagttgttaatatagccttcatcatccttgtacttcttccaatgagggaagacaggaactttagtcctaatgataacaccagcctctgatgcaaacttggcagcttgcaccggttcatctggccttttcttcccttcggcaacagcaatgggcattcttcccatagctttggtcatcttgtcaagcattattcctgcagttggtggccttgattttcttgtgcctcttcgtataggtactacagagtattcaattacaatgttagcattcatcaaatagttaaaaaataataaatttctcttcgttgaactaactggccttcaacatcagaattggtttgctgtgcaggttgctcttcatggttggcatcatgtccatatgaccagtccatcaccgggctcgggggcctgttcacatcattatcttgaagcaaatgtccactgcccacatcttcatcaccattgttttttgtttctggaggcagttcttcatggccattacctttaccttgttctgctatgagttgccttttcgctgaccttgttgagactccaggaggcatttcggttggagcacccgccctcactctctttgatatccttactcctggtggcatcttgagggtaggtttcttcttcgtcgcacacttctttcgtctagtttgtcgagggtactacaataataaacacaaaagttgtaagcatgtgaataaattagcaacaatcattaaaaaaataatcaaatgctgcacaaattaaatgcggaaaaattattgcagatatcctagctccccccccacagccaagatagaagaagcacctcaatcattatggggacgggctgctccggttctaaatatgaatcatcatcacactgaaccccttgttcatcatcttcagggagaaactctgatgtatcagaaccttctccatgacttttcttggtgcctgagttttttgtctttgaagatgcatgttgtgtttcgatatgtttaatagtggcagctatgtctttgatgccaagttcatccatccttcttatattctgcaagattttctcttgccacgttctttcatattcgttttgtgcaggttcttacatgaatacacat

SEQ ID NO: 51136 - DNA, 1501 bp, Oryza sativa
gtcggcggcggctctggtagagcggcaccccgatggtgtggcggctggatttggagattagggtttggtgggtgagaggctttgtaaatatatagtggttgcacaaatgcccctgggtgttgttttgctcttcgttagatggaggataaaagtgacatttcccattctgatttgggcaaatgggcggcaatggaatgttttggggctgtcattggcggtaggtttaggcgccgaacgaaaaatcctccatccatgagtaattaacattatccataaatcgaaaacattcaaattatactaatctatctggattaacaatttgactttaaaaatatactccctccgttcaatattatataacttgaaaatttggattaagggggtgtttagttccagggtgtaaagtttttaaagtatacggacacacatttaaagtattaaacgtaaactaataacaaaactaattatagattatgcccgtaaactacgacacaaatttattaagcctaatccatccgtcattagcaaatgtttactgcagcaccacatactcaaatcatggcgcaattaggctcaaaatattggtctcacaatttacacgcaaactgtgtaattggttattttgtctacatttagcactcaatgcatgtatctaaacattcgatgtgacatttttggaaaaaaaaatgtgggaactaaacaccccctaatattatttttttaaagcaactttcctataaaaactttttggaaaacacagacaatttagcagtttaagaagcattcaccgattaatcggaatacggttgtcagacggaatacggttttccacaacactgctttaagcatgactgaatttatttttagaaactagcacctataatatattataggcgtctttttttaattaattggcacctatgacaaattaaaggtgttggttttttttttaaaaaaagaaaaccaacacctatagtattggtgtcggctcttctatagtcaaaatctgctgtggacgtctaccacaggggcgcggtcgtcgtctcccatgtcatcgagacctccatgtcatcctcgtggttgctcacctcgccattcaccatcgacaccgtggaatgcaagaacctggttccagcctcggtggcgttgccggtggatctaaagccaagctggaggatgatcggcgacggaggatttgagccaggcaggtgataaaatcgtctcagtttaccattcatggatactccctccgtcccataaaaaaatcaacttctggctatgaacctggacacatgttgcgtccagatttatagtcagaagttggttttttatgggacggagggagtatataggtccaattgaaaattgaattttaaaaattttatgttcactttaaactgggtgaaccggtcggtgtttgtaggaaaaatgttggaccggccggttttaatagaacggactgggtggtttggaccgacttacccctcattcttatcggtag

SEQ ID NO: 51137 - DNA, 1501 bp, Oryza sativa
cggtgccgaggggcgggctcaacgccaagctgtggaagcaggaggcggaggaggacatgtacatggccatgggcaccatcacagcagcaggtgcttgacacgtactactgctgatggtggctgatgtgtccttggtttcttttcgtcgccgtgtgtgtggatgcaatggtcgatcgatcgatctctcctgtaatcctcggataaagcaaaggccatgggagggatgagatgatcgtgtagcaaaatctctcttcactttttcgtgtgtgtgtgttgggttggataatggtggtccatggatatcgttcgatgatcgatgatgatgatgctaaacctagtcttggtgtgcctagtgtagcactaggagtagtagtttatcaattgcttagctgttagctagcatcgctttgcattgggttaatacagctagctgtcaagcttataagtaattaagctctctaatcagggttttaaatctcctgtttgagaagtttgagaaggattctctcatgtacaatttagccgctataacttcatttagcctggctataactgtttgagaagctaaccgctaaatgtcttagcctgctacttaaaaacattgctctttattgcaactgcaaactcgagcatgtgtcatgcatgaacatggcagttgtgatgtcacttctgagttctctgactgtaacaccagtatcagcgacattgaaatgctgccacatgccagaagtctgtggctatcagggtatgcatcatcgatcgatcacaccagtgatatatctgtgtacttttctaaagctgattgttactccctggtcccattttaactgcaatcatgagtttccgcgttcaattttaatcgtccgtcttttttaaattgtttttataattagttttttttataaaatgacaaaacatgatcgaatagtactccacttgtgacttatgttttcaatttttttaaaaaaacaatttaaataaaacggacgatcaaaactgaacgcgaaaaactatagctgcacttgaaatgggaccgagggagtagtactttcaccttcaccttggataaaaaataatttggtgatcacagggctggcctcttcttttaaggagatctctttaagttttctgaaagaaatcgaagaatctgtgtaataatatcaggttgatctctagacatcatagataatcgcgcatgatcttaagtccaaaacaaaagcttgcattatccatacttgtcgccacaacggcatgccacttattacagccgatgtgaccactacaccaaccatatggatcaaccactgcaagactgatcgccagcttgtcactagtaaaaaaaacaatagtaaaattatttagataacaaaaatggattgaaaaaacaaccgtaataatttgtaccatagaatgtacatgttagcagtttttttagacagttctgtgtttgaatatgaagtgaatttgtttatcttttctcatcaattaagcttttgagtta

SEQ ID NO: 51138 - DNA, 1501 bp, Oryza sativa
ctcagcaagccaggggaaataagtgtttaatgcaggcttcaaggaaaggctgtttttttcgtaattgattttgtttgaactcttttctaaaaagtctaagtgagtgcttctcaaacgacacggatgagacagtgcatctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacactaggaatcacctcacatccgcccatgaccgtgagcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctcttggcatcaaggctcccctgataagctagttactcagccaggggtgtcccattccacccatgtggtcgtacttgtcttatgtttggatgaaattctaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatactcgcacagagtgcacgaatatcgaggtgcaactgggtggttacaaggggacatggtataacaattaacaaaggaaggatcaaatgcaacaaattaggtaggtctgccaatctgccttgcagacgggacaacagattaagtgtgatcctatcaatgcataatatttcgcaagcaaaataattaaatttcaaatataggctcaagatgttcaaaggtggcttgccttgctcgagatctggagcttgatcctcgaaatccttgcactgcgggtcttcgggctccgaaactacacgcgaaacgggacaactcaacaaacggcgaaaatagagccctattaaagacctctaagcgtgccactagatagatctcgagatttgggaaattttagaagttgaatggagtcaaatggaattacggttgggaagatattgaatttataagattattggatttttggtctaaaggaaaaggatttaattaaatcctttttgaaaaagaaaagaaaagaaagaacagagggatggaaattagacttttcctcgggcggctagggcgcggtccaaggtaaa

SEQ ID NO: 51139 - DNA, 1501 bp, Oryza sativa
tggtattccaatgctctccattgttgcttgaagaaatatggcattcatcacagtagccaacatgctgaattaggaaaagagtaagataaagtggtgaactattttatgctgagaaattatgaaatcacttataacaggaatgatgtcttcttttttttaaaacaaaacctaaaaaacatttttaaaaacgttatgggcaaaggatatagaccatatgttaaatacttacatgtaagtttgcacttacagagaacagtatatacttattgattgtatggtttgtaaaatcgaactataagtttacactcagtacactattctgcttggaaatttgttatggaattttgttctatgaaatttagatgtgttctacgtgatgggccgataggcacaatcaggcgtggtattatagatgtttaaatagccaaaaaaaaaagttagcatggattacataaattagcatatttgcatggttgcatgcaactactaaggcatgccgagttgggtgttcttgtgtcattattaggttaaccctcatggcgcttccacttcatttaatgcattctcgattgccaaccacaggatgttacgatggttcaattatgaaagacattagaaaactgaacatcatacccaatgtaatctgctgatgagcggtcgagtccactacatccagcccaagaggccccgcggaagatattgccgccaccaacaacaatagcaacctgcaagggttcccgatctttaatgtacagcatatgtttctacaatagagaagacaagaggaacatacacatagcataataccacttcgttggaacacagggcggtttagttgttgaactttaaatgtctactatgtacatgcctaattatgtttcacttgatttaatttcaatcttcaaacagttaatcgggtaaataagcaataaaagaatgaaaggcactggcacacctctacacctagtctggtgacagaagcaacctctcttgcaattgccatcgtgatctgcaacaacattacacacttacatgacctgttccatcaaatattcagtattttaaatttgataatgctccactaaaagcaacctcacctttggatcaatattttctgtgtgatctccagcaagagcctccccacttactttaagcaacaccctttgccatctatatggctttttagatctagagccttcatcaagcataaggctgaatggtggcatcagtgatgtttgacctctgtcaaataaaaggagatgcgttatcaggaataactcactccataattagactgtattcaacatcagaaagaaactactacagaatttgaaagaacatacattgttacagaattgacctcagattttgatggcaagctgccaattccaacagaatataaggaaaagtcacagtcatagtttagtatttgtgaacatgaaccatgcagatgtattgcacacacaaataatttaagtttgacttgaagacatcacaatag

SEQ ID NO: 51140 - DNA, 1501 bp, Oryza sativa
gcttcaggcggtgtggtggctacgatgggcagtagcagaaagaaacgtatatactctatactgaaatggttgtgacctgctatctctgtctatcgtgtaggcatttagatgtagattttcatctgttccttgttgatctactagaatatttctccttttttttttgcttatcctgtaggaatggccgaggttcttgacagccattgttagggttaagtcttatttcaccacatcgtttttttctttttgtcaaagggcatatgttaaaggaaacaatgtcaaaatttctatcgaaatgatgctagttgactatgttcttgcttgctgcctcaaatattgttttattgatgccaaaatgttgtcaatttcacaatttcatgggcaagggcatccttgtcctaattttcatgaaaaccagccatctaacggtgttagtctaagctgttagtccagtggcagttatgttagtttcatactgtttttgatggcaaatttacaattatagtttttttagtggcagatccacaatacctgatcaatccagtggcaaatatgcaattggcccaaaaaaaatctctgtgcgtgtgactataattacgtggctttccttcctgaagccgtcctcatcgtcatcatctcgtcccccctcttcccggcgcggcggttgctctccagccatggccgccgccgccgccgccgccgtcgcctgcggcatgtctacgtccttcctcatccgcctctcgccttcgccgccggcgtcttcccacgtgcctctccctcggtctccggcttcgtcggcgcgcccgcggcgagcgtcttccgtctccctctccaccgcgcctaggccgagggcacgcgccgccggctccgactctccctccaactttgggtacgtgattctgcactcggttggctccacggggtgttgttcttcgtggctgcggttgacgtgatgttttgtggtctcccccattgtgtttgtgccaatgcgtggtaacaatggcggagaactcgtatgtctgcgagtagcccccagcttttggccggccgccatcgccctgagacatggtcagcgcgtgcgagatgcgagatatgagaaggagcagtgtcgaccacccgagtcttagccgagcggaggccggaggcctgaagctttgggcggcgagttggccaccgaggttcgtggcggtgtgtgcggcggccgtacggggtggcacaccggcgtgtggaggggagcgaaatactgtaagaaatagaggacgaggcatttccccaaatattgcggtatttgctagattagtgtcttggagttggatgctaaattttgggtaggatatgttcagatatgtcagagaaattacaatagcgctctagcagaatctgtagactagtagcatgattccccttttacagtatcactatggaatggaagaattttctgttaaaattttacttctaaaatctcaatccaagaaatttacataggaattagtcttcagtc

SEQ ID NO: 51141 - DNA, 1346 bp, Oryza sativa
acggactccgggtggtccagccagccaacaccatgagctgctggatcaggtgcggtggcgtcgtcgtcgtcgtcgtcgtcgtcagcatcgacgcgccaccattgatcgttcgccccgccatggccgtcctcgccgccgaagcgccggtggtcgggaacatgccgtagttggtgatggctcgcacctgcggcgaccgcagcgccgtcgctcgcggcgactgaacatacgcacgtccggctgcgacggcggcggcggcgctgccggagttgagcacgtggaacgtgttgctggcggcggcggatgaggcggcgggggcggcgacggtgccattctctttcctcgccggcgccgccgacgacgacatagctgccaacttagtcgtaatccagaggaaagaatcaaaacgagatgggtgtgtttgcttcctgaaattaccagaaactaaacaggaaacgagtaaaaacgtagatcaaaacttagttgtaatccagagtgtttgcaatccatattagtatgcattattgttgcttgatttgcattctgcagcctctgaatcttaattaatgctttctgaattcgttcgcagctgtaaaacgaggtgaagatggaatgaaaacatgatcagctaaggaagttcataaaaacacacagcaagcaaattaattactgtcaattgtgatatatcaaatccttaatttgtcctatactgactctaatgatcagcaatctgtgcacctgacgatcgacatgcgttttctgaatgaacgaaaatatgtattgagagacactgagaattaatgcgttatgattcatgaacaaatttaacaaccaattacgcgttgtttgccacattattaatttgccatatactataaacttccttcctgctgtcatttgcagatgtaaaagctaaaaagctgaatgataattgtgaaacgtactccaatattcagataatttatcacgatatactgatctgattttttgggccatatttagttcaggtctgcaagttgaattcacctctacaaatgttgggatgaatgacaatatttggtaacggagttcagcagtagcatacattttcaaggcattgattatagatgcacctccttgatgtagcataattgttgcgtatcaacaactttagactggcaacaccatctcacgaaagttttgatacgtttaaggtgagagttcacggtggagtttgtcggagattgccacctcatgaaccacagagctaaggacacattctttttttacaattttaccacaagtattctacaaaaggccatatatcaaaaatccagttttatatgtgctaaaaaatgtaatgtggtttt

SEQ ID NO: 51142 - DNA, 988 bp, Oryza sativa
ttcctgcagccctacgaaagtatgttattttcagacatttgcatggtcttcaagatacgattctcaccactagtatatacacataactagaataattatattttgtaatgagggcatacaaaattatatttgaaaacaattatgttattaccaagataattctcgagacaaatttatgcatatggtttttcatgcctccaatccaaatatatatatctgaaagcagatcgatgtttaaaatttaaaatttgacttataacatactataagaagaccaaaatgatgtgtttattttttataaaatggattaaaataacccgacctctacattcaaaatatatgtacacagcaaaaaaaaaattgatgtgttttatgtgactacatctacatgtgtagttaaatatcacacacacagtcacaaacacgtgtgtgtgtgtgtatttgactgcgttaggagataaactctatatatgatgtttaattagcgtcgtgagaagtaagaaattaaaggtaggaatgaaaagagcaagtaggtctcacagacgtacgtttcatacatgattaatatatatatatgtaaatatagtgttcaccgtgtgctacccttttgtaaatcctcaacacgtgttgtttattattatttatgcgatacatgtataatatgtgcgttcttgccgtcgttgtcattaggtcatttactataaagttcaggttggtagttaatttgtgcggcgccggagatcgatcgagctacttcatcatatcgcatatgccaacaaaactagctagctctactcagtttaatcaattagcagtcgatcgacccgtatttagttaaattaatcaatcttgttatctcgatcttgttgtcaaattaatcaattgtcagatataatttcatcgatctgcatgtttttgaggaaacatctctcaaattttatgtgcattagtaaacacacaaattaatctctcgagaaattactactga

SEQ ID NO: 51143 - DNA, 1044 bp, Oryza sativa
aaacggagggagtactacttagtgtttacagtggtacctgactgggaaagaattaccatttgtgcatataattctggcggggtagttttctacatcatacactgtgtagattcaggatggtgtaagcagtaagcacagtgctttgatctttcccctgcaaacggttaacccttgtgcatagctcagttacttgaatgaacgtttaaatgacaagaaacaagaatgaacactgccactaaatgattcaatgtgcaactatttctgctaacaagctttcgttgaagatgtttaaactgtatactggttaagtggtttatgaggcttggtcgttacagggcaaaggtattggaagaaccatcataactgatgccataacagaggtacctatcttatctattaattggttttgctgcccttgcaacattatataggtcacataggtgcaactcattttgctgtttatttcagttaccactactaagaaagctagctctggatctttgtgatgcttctgaagaaggctacgatagcccaaatgtgagtatattccaaagattttgccgagttgggcgggttaataataataataactgaataaagatgctaatatctttgcaattgttttgaagaacccggaggggaagatgatgaggaccataacgatgagcagatgcaagtcggtgaggtcttgtttcgagctccacagggaaggatcctcaaactcaaaaccagtgcacaaggagacgattgtgttggaatggagcagcagacagctaagaaccaccatagtgaaagaaaaaatacgttggagtacgccgattttcttgtaaatttgatatttcactcccctagtcccctattaccaatttttttttttaaaaaaagaaaaaacgcaaccttaccagcccaaaggcccaaagcccacaacagagaggagagtgggcgacggggggctagggcggcggcggcgcggcgaccagcgacgggcggcgcgcacctgaccggaatggcccacctcgcggcctctgccgccccgcttccaag

SEQ ID NO: 51144 - DNA, 364 bp, Oryza sativa
ctaaaaaagaatgtagcaaataaaagaaaaggtaataaagtgtacagaaaatacaaaagaaaagagcatatgttactcccaagtaatccatcttatcatcatcaccaacaccaattacaagctagtcgagtgagtctcttagcgaggagagacgaggcgagaggagaggagaggcgccgccgcggcgaggagagcgagaatcggaaggcgatgggcaacgccgggagctcgccggagcaggccgccggcaataataaggaggacgcggaggcccgccgccagccgccgtccaccgtgcgattctaccccagcgccgaccagcccaaggccaggcagccgccgcccatcaagctggaggaggagg

SEQ ID NO: 51145 - DNA, 1501 bp, Oryza sativa
cggggtgcacaaacgacaatgttgacatacagatccacgtcttacaaacattataaaggtcttacagaaatgcagcggaaaacaaaagaaactggagctaagccttgactaaactgcagcgggaacaccactccacaggcatcctcgacggcacggacgaagcctactcctcagggaagccttcatctgacacatacccgtcctctggggttgggaaaagtagagcaagactgagtactacccactgtactcagcaagtcataccggaataggggtatgatgcaggggattaacaaagaagagctagagtggttcatttgcataaaaactggcatttataaacaggaattgaatgcgaaaacggttgtaataattaagcagtattaaatctccgctgtccaacgctaacccacgttgcgacaggcccaaccatccacctaaactatccaagttcaacagattactctagggtgagactaatcatggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctataatctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaaaatgggatcaacatgttcaagtgacaagcatgacttgccttgctctgctgctggagggacctcggcgactatctcgaagtacaccggagcgtcggagggatcggaatctaacgacatacaaagcaaacattgcaaacaggctataagactactgaaacagagaacaaaaccatttttaatggattctacacatttttcttgatttactgagacttgaatgggattaaacggagctcggatgaattagatatgaattttagaagattcactgtgtt

SEQ ID NO: 51146 - DNA, 1501 bp, Oryza sativa; identical to SEQ ID NO: 43072

SEQ ID NO: 51147 - DNA, 1501 bp, Oryza sativa
caaagattaatttctattgattcaacccatacaacatttaaaattaatttctattgattcaacccaatgcgaagtgatttttattagataagaagcgacgaagcatattaatcgatagtaatgattaatttagaatgatggaggttttggtacggcctttgcttaaggggtgatcgaactagcacggaaagaaagtaatcctctgtatacttgtaagtttatccccactaaatatagttattgctatttctcttttctcttattaagccacatcatccgaattatttttagccattggatgatggatttatggttcaaattgtcttttttttcttctctcataacaccatacaatctcaataatttatagactcaaaattcataagtatcaatttgttttagttttaataatcatattgcatcatatttgtatatattatataacttaatttcccgcagcaacgcagcggggtattgatctatttcttatttaaatgtactcgctaggttaaaaaaatatgagcatttctgtacttcctttttttttacggggatggaggtgaaattaaataagacatgatttttactgggattaaggagagaagtgatattaaataagtgatggttttcatggggattaaggaatggtgaaattaaatgagtactgattttcgcagaatttaaagagaggtggaatgaaataagagatgattaattgatatattctaaaataaaattaaaatgccagatggttatattttaggatagaggaaatgaaatattagtaaagtgctcttgataacaaatacaattatacaactttgatgttaaatatttagattatttaaaatataatattggtcccacgtggagtatttacagatttttatactgctttggtaggtaaaactttcagaattgaaaggatggaaattaaacgtcggtaaaaaaaagaagccccacatggagtatttacatttttttactgttttcttctttcaccattgtaattacaacaacaactaaaatacacagtgatgtaggcctcacccttattcacaaagtagatagaacatatggagtaggcaagataccaaagttggatggagagagagagagagtaaaagatgcgtgttgactgttgagtattgagtgagtaaaagagaggcctcctgccttctgagttctgagctttctcaatacttgacacttacactttgggtggctaccggttggttacagttacagaagaggtttgtataacacagtaaaaaccagtagataatacagttcccaaaaaacttcattcctgtgtttgtttggcatctgaggtcgccattgatcgactagcaagctcttgatcttgtccatccataaccatattaaaaaaaaagaaacaaaggtatgttctagggttcttcggttgatatctagttgtttgattctccttttggttggacatgacactgatcatacgaaccatttggtttcagtgattgca

SEQ ID NO: 51148 - DNA, 1501 bp, Oryza sativa
ttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccatgattagtctcaccctagagtaatctgttgaacttggatagtttaggtggatggttgggcctgtcgcaacgtgggttagcgttggacagcggagatttaatactgcttaattattacaaccgttttcgcattcaattcctgtttataaatgccagtttttatgcaaatgaaccactctagctcttctttgttaatcccctgcatcatacccctattccggtatgacttgctgagtacagtgggtagtactcagtcttgctctacttttcccaaccccagaggacgggtatgtgtcagatgaaggcttccctgaggagtaggcttcgtccgtgccgtcgaggatgcctgtggagtggtgttcccgctgcagtttagtcaaggcttagctccagtttcttttgttttccgctgcatttctgtaagacctttataatgtttgtaagacgtggatctgtatgtcaacattgtcgtttgtgcaccccggctggtcctggacgggggttttaatacacattctgcttggaattctattcgggaatttctgggcgtgacaagttggtatcagagccgaccttgaccgtaggacaagccaaatggaaagacctaagagccctctgaatccttttcattgcatatgttccttgcaattggattttgttccgggaaaatggggatctgttcttgtggttcaagggaaaaatcttggtcgctcgtttaaagtgagttttttaaaacgagtcagtctagggttttagtaaaattattgggatttattcgtcagtcagttggggtttgaggggtgaaatgcattaggtcctagctcggtaacatgggttgtaaggtgtttatgctttgttcgttattattattatgtatctaatttcccattattttatcgttatgtgagtcttatttattcgcactcatgtaaaatgatctatgcataaaattttgctcttatttgattcctttatttgagtctttattgctttatttaaatttggatttgagcatgcattgatcctactcctttgtcttctctagatggccggtcacccacccaaccaccgcggagaaggcatgattgatttcgtggcagagttggcacgca

SEQ ID NO: 51149 - DNA, 1501 bp, Oryza sativa
taaagttaaggtgtaagacacataaaaggatcagaataaaaaaattatagaaaagaatattttcaattttcactaccttaacactttctggcaatagccaccaatgcttgattatatttttgcacagctttaggtagtgatatggtttcttatcatcgtaaccagatgggtggcttcttgtttggtcataacttatcatctcctgaagaggggatggtaaattccccaagtaggtcacaggtggccactgtatgaggttgttaacctcctgctctaccttatgtgggttcatacacaagaccttcaacaagtatttccccttctcagtttcatcccaatccaacggatacctctgtagcgtcttcacattgccctctgcaatgtaatcaaggaatctcacgaggggcatgtctttgggggaatccacatgatcagcaaagattttcttcaccgcatctctcatttcatgccaaagatttgcctggatttgccttttcctagcatcactttttggcaaagcttcagctgcacaaacatattttagagaggaactcaatcatggcatggaagctagattgaaggtaaactagttcagtcaaaaacgtgttacagtaggaaatttcttcaagggaacagagcagcagaaaatgcattatatatgggtaggtaccttcttcgataagaagttgcgccaaggcatttttcccaacttttttcacatagatgtccttggcagtgatttgaattggatagataccatgctcaaatagacattccagtccactgcacaaatccctaagaaagaaaacacatcttttgttcattctattcaacgtgttattccataaattgtttttttaacttactaccttacaagctgacggattgtggagtttcgacaggtacccgtccctgttctcttcagaagtactttggcaccttcggttttaacccatgcactcatgcttccatctacccagttaaatacaaatctgggttggccacttccatcaaaaaagttttttagaaacacgatgttatgatgccgaatgtttttcagcaaagaatatgcatttgcctttttacgatccactttatcaaaatattttacgagacatttcgaatgtagtggtccgatagcatattcagcttcactgagatccaagagacttccatcaaaatcctttaacttccgcttatgatccaaaactatgcattctccatatgatgtagccttacggaagaattctttgcgggtttggatatcactattcatcatcctacaaaataaatataagtgtccattaatattagtttatcgacaatgagaggggcctaaactgccagaggcttcccgcgtagcttaaaatttccgactttattttctaaagaaaagggattgtcttgtgaattcttgagagaggagagaaatttggggattgaactattcatccattgagttggccctaagggctaatatgttgagaagagtacaacgcaa

SEQ ID NO: 51150 - DNA, 1501 bp, Oryza sativa
acatggaattgttttgttatttggttctagttttacctaatgcagtggatgaagaaacatattgttttttttaaaaaaagttgcttagttttgtcagccactaaaattgcttagttctgtcagctcttaatctgaatttgatgagatcaatgattctatataatccatatacctaatttagcactgagcatgactacatgattactcttgttagcaaatttcagtcacgtggcataattttggggctgtttgatagccctatggaatcggcatctatgaaatgacacacatccaaaatttctgccaacagttcattttgtgaacaaattagaagaaaaactatagtgaaagggaacttgcagtgggggatgaagcacaaaacaaaccattttggtatcccagatcacagcacaatagcagtcctactcaatcaaaagcatcttccaatcttgtaatgtgcattttgtgttctctcttatgtttcctgtgaatcagtcaccaatgatgcatatgcaagcgcctcaagcatgctcaaaacatcattagtatcatccattagtattgaccagatagtccttgctttgcttctagctagttgacagtgcatgcatatcattgagagaacaaaatctgcttgtcttctattatctatcagcgttgatcagcaacaaatcctttgttgttacagtacctagtatatacctgttggtactgtcttttgctagtttatcttactactagttcaaatcattttgcaatccattcagtccatccaagtctattgcatccttcaatttgtcgaagttatgtcaatccatctcttcatcgtcttttctacatcaccaattccctgtcagagttggctttcatcatcaccagctcccagtcggagctagccttcattgtcacttcatcatctccacgtcggagcttctcgtcatcatcatcatcatcatcaatcagtgaaggtccgaagaacaatttgtgaagggccttcatcaacatcaatatctcatcatcagtcaaaggaccgaagaatagtttgtgaaggttcattgtcttcatcatcaacaacatctctgaatcaatgaagagccgaagaacggttcgtgaaggcttcaaggtaccgagggccgaagaacagtttgtgaaggttccgaggtccacttcattgaggaggggatacatcttttcttcttcatcatccaagaattggctcacttcgacgacatcatcaagactttggagataggctaatatttagtttgtgttctcttgtttagttttcactccaaatgcaatgttattgtatacacattacatttgagtgggggtgttaagaatatatgtattagtgtgtttgtgttaaggggtatttctatctttttgcgttgtactcttctcaacatattagcccttagggccaactcaatggatgaatagttcaatccccaaatttctctcctctctcaagaattcacaagacaatcccttttcttta

SEQ ID NO: 51151 - DNA, 1501 bp, Oryza sativa
tacattcaaaaaggaaaatttgtgtggaagttcattgtacatgctttggcttatagaatactgaattgaaattcctctacatttagaaaagaaaaagaataatgaagtgaaatttattttcttctttttttttcagatgaacaaagcaaaattctacgagcagtatatcgaaaagaagatagatattgcccaagctattggattgatttccacggtattgtcttattgctgttgacaattgcacatgagccatgttttctcactgtgaataaccaaattagcttccttcaactaactgtcatttaaaatttacatttgcaggatgggactgaagcaacatgatgtgcttaacttatagtgtttttttttgggagggcttagcttacctttctttttatatcagtatcagtagatgtcgatgccccgccagcgcctgcagaaataaagatcccgaaccaatgtttttttagctgttatgattaattcggtttccaggctccggcccgatcgaaagcattgtaattgataatgttatgtgcgatacatttagcgtacgttgcaatcgtgcctcggagtgattcgacttgctgattcggaagatgaagtttttttttttgcatgaaattgggctatccaattagcttgttgtttgctttgtggtcgacatggatgaatgtgattgtatatagaggctcacaaccgtgtctttgtgctaactgccctagctagattatgcaagttgatatcagcaatttgctgctttataggacactgagaacaaaatacatctacaggagagttttttttttctttgaagtttggtcaagttttttcagttcttttttttctattaatcctgataagttgagacttcctttgaaattgaggaattgcatataagatctctgtaagaactgaactagctctgtgagaagtgttataaaattcttcgttccaaatgagtgctgggctccatatatatatcataaaatttgatgatttgacactttatatgttgccaatttgattgtatttacactcgtgaggatgacatgtgggattatgcgagtctatcacaatggctcaaatagtcagatttttcaatttttatgtttggctcctgataagtcagttgaggcttccttctaaatgaaaggaatttataattctttgtaagaattgaactaattttgaggaagatgttgtaaaaggaggccatagtttcgcttattaatggaataagcgaaacggtatatttataaacgaaaaataatttataaacaaaacttttatatacatgttcttagcaatctaaaagcaaaggctcgaaaataaattacgatgaaaaacccttacaatcaactctttttcaaaattcaaaattagcttataagcataagccaaattgttttgtttcaaatgagcgctgggctctaaaatctgcggtgtggtcagttgagctcatcatctcctccatcctgaggcggcggcgcaacgacga

SEQ ID NO: 51152 - DNA, 1501 bp, Oryza sativa
agtttaacctggcactcaaccttttctaaatcagggttctgtggtaataaattatgcagaaagaatggccagtatgttaaataaaaagaagtgcagagcacacctgatgccgttgcttccacttggggaaaaaagatgaccccaagagctcaaatatgtgatctctcatttcatcattagtcacaagcaaacaattcaacctaatcgccgcatacagccaatacctgaaaaagtgcatatcgtactgttagtaacatcgatgaaatgaaacacaagtgcatcaaaccggagactgatgggtgaaatatccaacctattacctaattgcacatattaatcaatgaatgcacaaatacaatataaggtaccccaaaaaaaaatgcaagtgcacccaagactagagactgaagagcattaccagtcatcatttgacccaattggtgaagtgtacaatgccccgttcgctctccaggtttcaatcaggtgtctattagatgcattttccataagcttggcaatgcgtttattatgtaatacgacaagtggccatttaccattatatctatcccgtagctctgttacaacagcgtccagctgctctatattaaggatgacagataggaaaagcattagtaccacattacttcactgataacattgataggtcaaagtacattgaaagatggagttcagacctgagtcaaactaaagccaccctctgcaaaattttgttgataaagtgcaatatttgcaccatcaactatagcttcatatgctccatgttcttccaaccactcctataaagtcatagcactcaaacttgtaaggaagaaaaaacatgtgttccaaatttataaatggattatcacctagaggcagtgttctaaaagtcggctctaggcgccgcctaggcactgggtagcagccacaattaggcattagatgctgcattaggcggctgaactaacttgggtggtgctttattgctattttagggttacatagtataatttgtatgcaatatgccagctaatttcttggatttcttgtatgcgaactgcctaggcgctagaggcacgcgaagaaaaaataagtatctgaatcatattctgacttgcatcgagaaacacatgcatgaggtatcttacgttcttaggaaggtaaattcaatgcttaactcataagggaagttccaaataatgatttatctaaacatagaacaagttacctgggcaaggaactactgagcagacattgctcaaatacacagcagcatttaaatctctaaaaggggtgaaacccaatatagataaatcagctgagcactattaggttaggccacaatgaagcatcaaatggttttttgaacaaagcagggagacagaccgatgggcttacatctctgactacaatttttctatgttgttatgatcactgagcccacaaggccatgttagattgaatagaccaagcaaaacgagtgatcttcctatcacactta

SEQ ID NO: 51153 - DNA, 1501 bp, Oryza sativa
cggcgtcgagcccgccgctggtgtcgccgaaggcgaagcccggcgtgcggccgaagctcccgcccaagacgaagctgaccaccatcaccttcagcccccaccacaagcgcgactaccaggtcacctgcaccaacaccggccgccgtccctgcgtcgtctcctgcccttccaactgccccaacaagtgcctcgtcgcctgcgcctactgcctcaccttctgcagtacgcacgcacatatatatatttcgattattcatccttcgtttccaattggattaatattgatatatgtatgaactctgtcatgtcagtgtgcgatctgttccccggcacgtcgtgcggcgacccacggttcaccggcgccgacggcaacaccttctacttccacggcaagaaggagcaggacttctgcatcgtctccgacgccgacctgcacatcaacgcccacttcatcggcaaccacaacccggccatgaagcgtgacttcacctggatccagtccctcggcatcagcttcggcgaccaccgcctctacatcggcgcgcgccgggccgccgagtgggacgacgacgaggaccacgtccagatcaccttcgacggcgagcccgtcaacgtcgacgccgccaagggcgcccactgggtctccgccgccctgccgtccctctccgtctcccgcaccgacaccgtcaacgccgtcgccgtcgagctcgacggcgtcttcgccatcaccgccaacgccgtccccatcaccgacgacgactcccggatccaccactacggcaagaccgccaaggacaccctcgtccacctcgacctcggctacaagttccacgccctctccggcgacgtcgacggcgtgctcggccagacttaccgccccacctacgccaacaggctcaacatcaccgccaagatgcccatcatgggcggcgccgacaagtaccgctcctcgggcctcttctcgccggactgcgccgtctccaggttccaccgccgccgcaccgccggagaccatgtcgccctcggttttgcctcgtaaatcgccgatcactcgtctactccaaccaagtgagatacgatcgatcgactatgaaataaatcgacactgatcagtacgtacgtatatacatactcgtgcaccacgtcaaagcaagaaataatattctcattatgtggatggtgcattgattaattccaaaattttattgactattattatggagctctttcgattgaacatggagtaataaggattcttgatttgttttgatgaaaatgtgtcacattcataactttgttccattattttttaattagtctatcgatcagattaatatattacctaattaacctgtgttaaacttcaaatcgcggggtgtactatatgtaccatttctgcgtcaacgctattacgaccaaattaagttaagtaaactaggaaaaatattgcgtgaatgcttagtactacgaaaaaacaccggccttgacttgtttttgaagg

SEQ ID NO: 51154 - DNA, 1501 bp, Oryza sativa
taatgctaggttaaccaccactaatatttttgttttttgttgtgtgatcgatatgcttagttcatgagaagaactgcacctgaaggattacttatggattgcgaaatggtggccataaacaatagccagggctcaggagttgcaatcaatttgggaccaaccttcttggcacaaaaatactaccagcaaagtccagcagaggtaggttacaagggatcaggaatggcacggtatagtcgactgcagaggatcctgatccggttacaagttgcaatatcttcttcatctcccgtaaagttatttttaattaatcagtttccaaaattaggggttttgctcacctgtcacatcggtacactgttgtgtcaaatgcccatgtaatcatctttccattaaaaaaatgctactaccacacatttcaggatctggcactggcgaagatgctggtgagacctggcaatcagttcatggatgatccggtgatgaaagatgagagcttgctcaccaatggcaactatggatcggtgaagaaggtgtacgtgatcgccaaggctgacagctccagcaccgaggagatgcagcggtggatggtggcgatgagccctggcacggacgtcgaggagatcgccggagctgaccacgccgtcatgaactccaagcccagggaactctgcgacattctgatcaagatagccaacaaatacgagtagaaaaatgccagtttggaaataatcagtgcttcttcgtcatgaagcctacttacagtccatcgctacaagtataaataatagaagtttggttctcattgctttgtttgatcttgtgtgccaataattgatgaaatctattaaaaaaatctacaataagaaaaatatcaatctgacaacgacaagagagcaaagacaagtcgtagtaacctgataatataggacttgccaacagtgattgacctcacaggctcacagtcacagcataagagagagaagcacatctagcttaggccatctccagtgtatgcaaataatattcagtgttagctatgaacaaagagaaggagataaggagggtagtgcagaaaacagaggggaaggaccagctcaattaattaggaaaagagaagggacggtagaaatttgaggaaaaaatccagaaaaagtcaaaaaggtgaacatctcccaagtaaatttgaaggtacctggagctaattatccatataaaattgtcgggttttattttagaacatgtaatggacaccaaactaaactagtgatcactgtcagttagtacgttcaaagtccacacaattttctttacaaaggctgacagttagcacgttcaagccagtaaatatatcatcaatctaaatgatacctactgcatataaaattataaatgccactgtcatatatatttctcgataatgtatgtataaatcaattcatcgctactatcacagcgtcagaaacttgcagaagagcaaaccacaaacacttacaggaaa

SEQ ID NO: 51155 - DNA, 867 bp, Oryza sativa
agaatttggacaaggtccaggaaatgattgcaaattcaaatcatgacagtaattttctgatgtgtatacgcccatctgtttgtgaggttggtggaggcgtggagtctggttggaccggggaccctaatggtagctggcttggatgcctggggtggacaggtgacctaaacagtagctggggtgtgaaaaaatggtactgtgtgctttactgctttctggaggagattttggaaagtgcatgggtactgtttgctgcaatgctccctttgtccccttctcttacttcatacttactccctctatcccaaaataactccaaccctatcttcccaaggtggatttaagaccaaaatacccataattaataataaagttatattggtgggtgggtaggtttggggtattgaagggataaaatttctcgatttgcggatcaatgataggtaagaaggtagaagctagtttattttgggacaattttcaaactataaaattaatttattatgggacggaggagtagttcatatctaacactgaaaatatgtaacttgctaattaattgttcctcttgtggcttggacatgattggttgctggattgtggctttcctttgtatgatgaaagatgaccaagggcatctccatgcgttgttcacaaacatagagcatgatactgctacagcaaccgcaacattgattcttttgtcgcagcgggctggtttggtgctgggtccacatttttatcgttcttttctccttaatttttctcatgggcgatttctttactaactctggtttgaacgagcataccatctatcttgttatgcaggctcccgtggactgagtccatctcttctaggttcggtca

SEQ ID NO: 51156 - DNA, 1501 bp, Oryza sativa
acgtcgtcgccgttgaccgtcttgcgcttctccttgtggcacttgtcggaggcctcgccggtgacgaagctgatgaactccgagacgcactcctgcatcgtctccttggcctccttggagatcttggcgttgggggggaggatctgcttcatgattcgccccacgttcgcgattggcagcaacctgtcctgctccttgatgatctccgccgccgcctgatccgccgcctccccctgcagctgctgctgccggcgatgcccgtcggcgtggtggccgccatggtggtcggccatggctaagctcgagctctctctctctctctctcttcagtggtggtggtggtgagttcttgggctagtggaagcgctacagtatatatgacgatttagagggcagcacgcgcgcggccgccgttggttgtgtcttttatatgcggttgggtaatccgattggcgagagagacgaccagatcgattcacttgttattgttgggaataatggacttttcttcatctgctttcgctaagctatacgcatcacatcctaagagccgagtataataaggtgaagaaaacgggctgtataattaagttgtcacctcatatttgtgcttatatggagaaaagaaaaaaaaagaaagaacaaaacagactacaaatttacagccaactgcagcacaaacttcaatgtattaggtattaatgatacgatgtatatctacaattaactattgtatgagtagactattaggtgtattattaaatttgctctaatactacaagtctaaatagtctttatctagatatccaaatttttagtacaagatgaataaattatactccatccgtcccattttaagtggccatgattttccgtgcccaactttgattgtccgtcttatttgaaaaaatttaaaaacataagtgacgcgcaaagtactagtcatgttttaacaataaaaatactaattataaaaaaaattaaataaggcggtgtcggtgatatgggaccgggagtatcgtgaccagaggcttgaggcagacacaatcgcccacgtggcctggcaccttcggggacgtcgggcccgagggtgaggtgtccgccctcctcctgatttccccgagggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgtagtgcagcgcgttcctttatccgctctgtgaccagtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctata

SEQ ID NO: 51157 - DNA, 161 bp, Oryza sativa
aaatcaaatcaattggtaagtaagtttctgcatttgcctgaagatttacttaaaccaaatgcaagtgttagtgtgccagttctccaaggtagcttaggatggactgaattccatgcaaattttgcatgaaaaagttcagagcttaccgaaatgtgtcaaaa

SEQ ID NO: 51158 - DNA, 1501 bp, Oryza sativa
ttaacatcggaggaagtagtaacttatcaaacataattaaagtccaaatttaaaatctgctttctctagtttcctttttagtgtatgtgtgttactgaggctgttcggaaacactggcttatgcaacaatatgaaacgtggctggcagctggttcgcaagctacaaccgttagcattactgaatagcccccatcaacttttcaacgtgcgtttaactatatattttactaaaatattatataaatatgtaaaatataaatccggcttaaataacatataatcacaagaaaaaaaaatcataaaagttaacgacattgtacattaacaccagagcaagtgatttttttcatttaatataatacaaatataaaaattttgcttataaattatttttttcctttttattttgctgctattattagctgtagctcaacgcataagttattaccaccgtaactccaagcctatttagtgaattacatagtcctgttctcccatgaatttgcttttcgaaatgcttcatgaattatttctaaattattttttttctatttatttttctactactttaccagctcatctatcacatcttaactgtattttttaaaaaatcgaaattctactagccgtttactgaaactacctaccaatctaagccctatcggttggcttgataagccaaagcaaaagtcaaaatttaaaatttaaaacttaattctgtagttgattttaaaatattttcaacgtaatttctttttagcattgacttttaaatcgctagaaaaatatataagagttttactcaaagattaatttttattttttaataaaccgtcttgattatcatggaatatggacaagccatgaaggcaaattatcagggaatatggacaacccatgaaactctgtttcttgtatgactttgccttctgagttctgaaacgttgtatccatgtgaaattttttactggagaggtcagggtcaatatgacatttgtgaagcctgaaaagaaaaaaagaaaaaaagagagcttgacctgttcagggcctgccagtgagtgggggtgatgcaaacatgggccagaattaagaggagagtctctctctctctctctctctctctctctcttgccatttaaaagaggaggtggcaggcaggagaggaaagtggatgtgcccccaaagatcccctcccctctcctctcttcttcactctgccccagagctgacttttgcttcttactcctactactactacttgtctttctctttgcaccctagcctcatgttcttcttcttcctcctctcctcctccttgtagcttccacccccaccccactccctcccacccccgccgcccgcttaaaagtccgattttggggaggttcgtgcgctcagatcggggagggggtccaacaccccatttcgtcttgctgcggcggggagggtggtgaagcgaaagtttggattttttttttttggggggaaggttctgcttgga

SEQ ID NO: 51159 - DNA, 1501 bp, Oryza sativa
ttgtgatttgtaacaagtacatttcgatgaataatggagaataccacagatttgttactgagagcctgaaatcgaagaggaatacaggaaaaaaaatgtcaaagcttaaagcgaagttactgaaagcctgaaatcgaagaggaaaacaggaaaaaaaaatgtcgaagctaaaagcaaaggggaaagcagggaaaaaaattggggtttaagctcagaaggtgcatcatctgtcccgaataatatcaggtagagcgccggacccgccggtgctggtgcttttcgtcattgcttgacgatgcaatcgctacgtgcggaactatttaaaatggtcgatcgtaatgtgattgagcagtacggtactaaacttaactccgacgttgcgaggcagttatgggccatgttgggcttggtttagtcctgccgttctgaggcaacgatgggccgggccttcctttccagtccaattgacagaacgcggtggaattgccctgcacacctgaaggagtatctaccacttggggggaaaggcagaaatgatggtacacttcgcagatgattgagatttgtgattcacatgcttagttaatttgaactagcactgtactgttttttttcccttaaagaaagggaaagatcacgttcaagattactccctcggttctaaaataagtgtaactgctgatgaattctaacaacctgtcaaaccatggattgttgaactagtcccacaaacatagcaagcaattcaagctgaaatgcagcagtttacagcggtgttcgtctggtacacatgctacatgaaccccatcaggtcctgcattttttgtggaaacaaagtcctgaatgacatattgacctttcagttaaaaaaaccttccagtttttagcaccccatatatctggtgaaaacaccaagaggaagcgagaatttagcattagcatcatctgctgtattttgcatcagaccttcaaattccagactaggtgaggacatcgatccggcggtgggaatgagaactgcttttcgccaagacgattctgttcaacacatatggggctaaacaggaaacccaacagataagaaagacatgtcgtcaggattcaacttgttggagagatctgttagacatcatttactaattttctaaactttatgtccttcagctttctcttatgcactgcattcaactagaaactcgatctgaccatgaattggataagtagcccgtgcagataacaccactgctcggtggtctaagacattcagggcagaggaagagaggaaggttatagtcgatcgactatatagtgtatacgttagtgatccttattttttccacacatatgcatcagatgtgcatccatttttttttcattattattatgagttgtgttttgttacaagtacaattcaatgaataatggagaaaggccacagatttgttactgactcagaaatttctgagatgtgatcaatgcatcgctgaaagcctgaaaccga

SEQ ID NO: 51160 - DNA, 1501 bp, Oryza sativa
aaagttcatcagcgcactgattccagttcaaacaccagcatatcttctcccggctgcttgccgagccccatcgccggtatttgacccagttcttgtagtaccaatgtctatggctgggctgcttggtcactccaggattcctttgggctatactaatcccgtcatccggtgagcttggacacacacacacacacacacacacacaaacagagaatccagacatcgtgattgaacaagtttagatcgattacttttgaattttgagcttcagcaacaaaagtttcatccctgcaggattcatcaaggctggtacgtgacagcttattctgttccaatgtatactactcaagtttgagtacaatgactacaagcactggaaattggaaaacgcctgagacacgataaagttatttcctcacaaaaagcttgcgctgctgtaacaattcgtcaggtcccattccaatagcctgctgaagccgagcgtgcgtttgtccagatcgaacaccatcaggatgttctccaactgcatcccgccgagcaccaccgccggctcgccgtccaccggcatgccttccggccccatctccacgaccccaacgcacgtctcgcgtaccaggtagttgccgttcagtatcgtccagttacccgtggctccggcgtccagctccagggtgatcgccggcgcgtcgaagcccgtccgcttcatcatagggaatgacaacatggtgtcgcctgcgccgccgtaacaaagctcgaactgcttctgcctggccaccctcgccattctgctttccgttcctctgccgtgtgtggcgaagtaatcagctagagatcaaacattggttatggcgtaagtttgtctcgtgtcggatgctgtacctggtcacgactgtgtcgaacgccttgccgaaggcgcggaacacgtcggtgcgcatgatcgcgtacggcgtcgtggtgctgagcacgacgccgccgcggcccgtgcgggcgttgaggtcgagcgcgccggcgggcagggacaccgggacgtcgccgggcccgcgccacgacacggagatgcgttttacggggaggtagtaaccgccgttcctcctcgggttcgtcaggaacggggttcgccggagcatcttggtgtagtcgaagggcccgtacgggttgtagttgggcaggtacaccggcgtgtcgccgaacgtcgcgaacaccggcaggcacagggcgaacgtgctgccgaaccggcgctgcgcggcgagctgcgacggcagcgagagcggcgtcgtcccggagaaccccgcgacgccggcggccgcctgcggcagcgacggcgacgccagcagccgctccggcgcgcacgcgccgacggcggtgaacgactccgggtacagcaggtcggtgccgttggtcgtgttcgccgacatggtgaatgtcgtcagatcgccggtggagcactcgccggtgaccggattgaacgggtgggcggtgcaggcgcagcgcgaccccggtt

SEQ ID NO: 51161 - DNA, 1501 bp, Oryza sativa
ccgtactgcatccagcagctcggcggcgtgtagtggttggcctccacgcactcgcgctcgtaggggaggacggtggagtgggaggcgtcgcaggtcgaccagacgagctcgccggagaggtcgagggcgagggggtggccgtccttgacggcgatggtgtagagcttggtggcgccgtccttggtgacggccgtgacgaggggcttgccgccgccgccgcttgccagcgtgtgccacggcaacacggcgaggaaggagatgaccaccaggagaagcggtttgcctttggatttggcctgcggcgacgacatggtgtaccgtgtatatatgtacgtgagttttgttaggctaatcgtgattagtgtgtggtaatctgatgtgatttgatgaatgcatggtttgctctttatatagatcgagctagtggtcgtggcctgtcaggtagtaagtactaattttttgttttcaatttttgtatcattcaattggaagcttcgccatgcaaattaatatgcaatcgccagatgcttacaccgttacacgtgctttaatgtgagcatcatgtatgcatgcacggcgaataaattagccctggagaaggcgtgacggtggcatatatacacgtgaacgtgaccgatggcaaatagtattgcagagaggaaatataatgcaccatgcataggaaagaaaaacgagccatgccgttgttgcacggtggtgatttacatcggagtcggcaaacgaagttgactcgtgggcagtcggcacgtggatgggctcgatcgagattcgagtgtcctagttctatagaactataaacgcgaatttattttatttgtttcaaatatagatgaaatgaatcaagcatgtgaatcacgtactacacctcactgcctcagccatcttgtcgggtatacacacaaaataatgactccaactcattttctgacttcttccttttcgtccccgagggagtagaactcaagaaaacaggttgattactcagatagttgaagctctcacagtacaatacaatggaaagcagcccagctgagctgatggccgagccaacagaaggcccttccactcatacattccggcccaacttcaagcccatgccatatggcttcgaccttttactcgtcgcgttctttagtaccgcaccgcttaatcacatcatgcacgaccactttatatagtcctccaatgtaaccaatcgcaagcaatgacgaaaagcaccagcactggtgggtccagtgcattctccatatatttaaggacgtgtgcgctactgagctttcataagtttccttttgcattcttatcttttgaaatcattcgtcaaaaaatggtaacaaatcacaattcataaaataaaaattgtttcttttatattttttgaaaccatttgtcgggaaaactgtaacagaacacaactcataaaatgcaaagtgcacctacgatatacagccttctggagtactttcctccagttaaagac

SEQ ID NO: 51162 - DNA, 1501 bp, Oryza sativa
ttcaattcagtgtctgctttgaacttgaaggactgcaggttacaaatgtgcagtaagccgaaaaaataccttccaaacaggccggtcattcctgatctcaagaatttacaacgaaggttgtgtttagttcacgtcaaaattgaaattttggttgaaattggaacgatgtgatggaaaagttagaagtttatatgagtaggaaagttttgatgtgatgaaaaagttgaaagtttaaagaaaaactttaaaactaaacatggccaaagcagattgttccgatctcaacgaacgccataacgcaggcatctcgaacgcatctccccgatctctcaccacaacagcattgcaatctgcatcgactgcgaaaatctggattgattattgggggttcagacttcagagctgctaccatgtcggatcttgcgatggagtaccgagcaatacgcggcagagtcaacggcgcaaacacagcacaaacaacacaaagctcttaacgaaaactcatctcatcttctcgcgcaggaacagacagtgccgcgccgacacaagagtcttctccccaaacacgccacgggaccatcaaccttatcttctcactttgccaagacaaatcgaatcagatgcaatatggtttagtacttcaggacccctttcaatcgcaggattaagaaaacagagaaataggaataacgtaggaattgaatgccacacttattgaattcctatgggattttgaaacacgggtgtagtttgattagcacacagaaaaaacgcaggaaacttagacacatgaagaggaaaacatgaggtgagacctcatgcacctcatgcttatttttctccaaaattgctctagtaagattgctctagtaagtttcattcaataggaatttcaaaggaattgatagaaaacaatcctttgtttcaaaagactatagaattatttcccataggataaaatcctctagaatttctatggtttttccattaattcaaagggcccctttgaatcgtaggattaagaaaacatagaataggaaaaacgtaggattttaatagaaatgtaagagtaaaacagaggattgcaaaatgtaggaaaaacaaaggaatgaccgtttgattgaaccacagggaaaacacaggaattagatgagagatatagacttaaaggaaagttagcaagaggttgaagctcttgctaaatttcctctaaaatctctataggattgtccattccataggaatttcaaaggattagatatgattcaatcctttgtttcaaagggcttcataggaaattttcctataagattgaaatcctctaaaattcctatgtttttcctccaaatcaagagtcacagtttgactaccaaaagagaagaaaaaaagatactaatactatggtttacgtgttagagcaaaacgcattcacggccattcaagatatccacttggtcccaacactgcacaatcgtaatgcttgtatcttagttcaagcgac

SEQ ID NO: 51163 - DNA, 1501 bp, Oryza sativa
gcctgttcgaattcgctgccacacaaagcccattgcatcttaacagttgaatcatcatgtgattatttgttctgttctatgttctttatggtgaactggaaatgcaatgtataaggtctcaatgcaaattagagcttcagtccctgagagcaagctacacggttagtcattactggagagatgccaaatgtgctacaacatgagtagcaagtgaaaactgataggacagaacatggtttaaagcagaagggcacaataatcattctattcgtaaatgagaggaacaaccaaagaaacacagtacgggggctgcgatatagttaccttaagatggcagcatattcagaaatcactggaatagacatgcatgtagagcttttcttcgtcttgcctctcttgtttatgttctctgtcctgagaagaatgcccacactctgccgtgttctgcagaaattatgacatacgattaaatgattaatacgaatcacacctgctgccgaaaatatcacaagttggaaaaaaactgacaattcaaaaacatgcacagctagcgagggatccgttaatccccgttaacacaaagtattcgtacactaagcagtactcaaatgaggcatcacaggcacacaacacactaacttggcatgcaagagaactgaactaattgcacaactaagagatagcacctaagaataacatatatcatagagaagataaatattatttgctgaattcctaggtcatcaaatatactgctgaagaaaatgcaaatgaaatgaataaatattactgggtttttgggaggttccatacctttgatccttcggctgtttgtcccggtatgaatatttcattattaatatgattctagggatgtaagaaatattgctggcatcctccccttggcacctctcaatgagtcttggacagttccaaatgttatagttccttcaagctggtatggttccgtatgctctccggtaaacatgtcatgttgggcgaatcaaagatgttaatttgtttcagacaaatgaacttccctatccattccggtaggctactgaatcctcccaaccatagctcatcaagagcaataagattcttcatgctttcaggtaaatctgtcaaatcgggacaaccttggatttcaatgcattttagcgaagcaaggtgtccaaacaattctggtgatatctccagcccttcacatccctccaacagcagttctgagagcgataatattcttcaagcgatcaagtggaaaagtcaccttggcagttctgagaagcctcagccattctggtagcgtctccagcccttcgcatcccttcaaccgcagttctcttaaagcggtaaggttcagtaagcttttaggcagagatgttagcttgggacaattaatgatggtaatgtattcaagggaaacgtgctgccccaaccattctggcaacatttccaagtcctcccaaaaccccaattctagtattctaagagcaggagc

SEQ ID NO: 51164 - DNA, 1501 bp, Oryza sativa
agtatagcccaaaggaatcctggagtgaccaagcagcccagccatagacattggtactacaagaactgggtcaaataccggcgatggggctcggcaagcagccgggagaagatatgctggtgtttgaactggaatcagtgcgctgatgaactttcccttggctggctgtgtagttcctgcttgaaccgggcggttgtgacatgtgagattgcagaaatgtttgtcaccaatcaccagtggatgtctatggtataaatgattttcttaagtaattttcagaaacttgcaattatttgaacaaaactatcgctttgctactactttagctttttatttgagaaaaatgcaacaacagtaataataataataaagtgcaactttacccctatgtgcctactacatgtggacccaactttaaacaacacgagtatagcaaattctatgacatatggggctcaaatttgtaagacatttaaaagttgcagctttccgataatatcgttactatatttttgagaactgttgttgaggttctctaaaataacaggaaactaatagctttgataaaatagctattaatatatgatatatcactccacaaatatgtatgtttaaattcaacttatacaattagaaacaaaaacaataaatttgacattgaatagaacgtataatttgcggttaagtttgttattttttgtttcgaattgtataagttaaattttaacttacatggttgtggaatgatatatcatatattgatctatcttaacaattttttttaaaaaaaattgatgattttttaaatgccatgcaaaaaataaggggatgtcacctccctcgagataaaaatccatctcccgttctctgaatctttgattgtttgtttttttttttttttgcagaaatttcaagctcgttactacttgatgatacgtgaaacttaaaacttgatacatgccggaacaaagcaccttgaaaccttttccgtactttgaaccatctccgtacatacttgtaaagtttctggttgttgtttagaaacctggaatcaaaagaacatcagaaagcattcgtacaccgggagaaagtgacccatagacgatgcttcacccacctctaaaatcctatgtacttaacatctcttataatcatgtcagacaacccttaattaatacttccttcggaacattgttttgagatggttcagacttcagagaataatccagcccgatgtttagactccagagccaagccggattgtcagagaaatcctgcgggcatttcccctaccattatttgatctcatatttcacctagaaatacagctaagtgatccttatctaggttccttgacttctaaaatttaggttgtcaatgctaatcaacagtgtattgatacacatttaaaaggatatcgatcgtcaactcctcgacatgataaaccggtgacatcttgaccctaaataactgatcaaaaacgaatcgaataactccacag

SEQ ID NO: 51165 - DNA, 1501 bp, Oryza sativa
gtcctgcacgcgtgctctctgtccatctctgttctgaattcttcagaggttcacatctcgttgctgatgtcgttttggtaatcttttaatttgctgcaagattattccatacttttcttgccaactatccaataatcaaaccgatgtctgaagagatagaacatgaatgcgtgaggcgctcgttggcatgtgcaatcgaggtagttaggctagtagttaattccatagtgagaatttctcaggttttagtggtggatctgataagaaaattaaacgagcctgcttgcattgggtcttaaactcttaattagtcatcgtgccggcactaagaggctccatatatattgcagttcaattaatggattcatgcatctcctgcaggtcgtcatggagattcctttgagttcaaggttgtatattggtcgctagaatccaaagagttgaattatacctagttgccaaagcaactcgtggccccatttgttgagatgtttagagttaatagcatggacgcatggatgaaaacagaggaataatcaaatcaacaaggaatctgtgcttccttgcatgttgtttgtaagtatatttaactgttgattcttggagcattcagttctgaccaaaaccaatatatatatgtcaggaatctccccgttgattggaccttctatctctgttttttcacttcaccagcatggaaattacatatatatcccgctctacattttgttattacatggaagacactccatacttgtacacacgctcagatatagagatggaggtcaacagtacatcctaacatctcaaaatatctattgaatcaaaaacaggacatatgaatttgagttctaaatggataaagccgtgcacccacaactttaccaccactaagccaatagtcccttctaccttattgtcaaaccattttatatttatgtgtattgtttgaaaacagtaatcaatttgaaacagtaatctacaacttaattttatgcaaagaaaaacaagctgcttaaacgaactacatctacatgtatagcttcctcgtcaacttaagcttatgttctagaatttgagtggtacatataactcaatgtgaattagtgcatagagtttttttaagctagaatctagatcagataatgcagatgattgaagctgacatttccttatgctctagtctagctttgcttgaaacaaagaggattaatctctacaagaaattaaggggcgcttttccactgtcaagcacatctgctgtagtactcttatgtgcataggaatccacaacaagagtggaccaacctcaaagatgtctgagaggcatcatcccaaactttatgtatagtaggtccttttccctttcccctttggcatgaagcatatatatgcaaagtgctaactccatatgccacttgttgcacttcctatggtccatgaatggatagaaaagcagccacagcaacgaaagctagactcccctgctcctcctgtaagt

SEQ ID NO: 51166 - DNA, 618 bp, Oryza sativa
cactaggtcctacctgtccgatgctctcctgccattttgacacatttcggtaagctctgaactttttcatgcaaaatttgcatggaattcagtccatcctaagctaccttggagaactggcacactaacacttgcatttggtttaagtaaatcttcaggcaaatgcagaaacttacttaccaattgatttgattttaccgttgtggccgtggtgatttgcagactcatggacacatgggggggcatggcgcaagaaggcgcccaattgccatgtggggttgggggggctttgcattcattcatacacccacctgcgctgctgctgctgctgctgctgctcgttcatggtggttgacggattctttaaagagcacagccagcctcgccggccaattctgcaggctcgcgacgacgagctcagctagctagctgctacctagctaagaatcctacgacattgctgctgctgctgctggcgctcgtcgtcatcatcagtcgtcttcttcattggcagaggtaagcaaagttcgcttctgcattgatgaatgccgaagctatagcggttcttgatcgtatcatcgagggtggtcgatgccccggtcgcccggatcatggcat

SEQ ID NO: 51167 - DNA, 1501 bp, Oryza sativa
gacgacggacatgcggtcgtgctcgccgctggccaccgcccggtgctccacgctcttgtacctgccattggtgagcacctcgagcgtgtcgccgacgttgacgacgagggcgccggggacgggatggacggccacccagccgccgccgccccggagcacctgcagcccggcgaacgccgcgtcctgctggagcacggtgaccgcgctgccgtcggagtgcgggctcagccccagcaccagctccggccgcgggcacggcgggtagaagttcatcctcaccgcctgcaccgcctccccgaacatcccgttcagcctcgccggcgccagccccagcgccgccgcgatgtgctccagcagccgcacgcacagctccctgatctccaccgagtacttctccagcgtcttactgcactcgagatcgccattaaaacatgtttaaccctttgtcttattaaaaaaattaattaattattattttttttctattatttgatttagggttaaatatacttttattatacatataattttatatatttcacaaaagtttttaaataagatgaacggttaaatatgtttaattaaaaaagttaacggcattaaataaaacggatggagggagaagctgttacctaaagttggccggagttgtcggccagaggttggggcggcggatgaaggcgggctcgacgccgagggcgagcatgttgcaccagtcgagcttctggtcgtcggagaagacgaaggcgtggccgtagccctggatgccgccgggctccatggggtacttctccttctcctccagcggcagcatgaagaactccctcgccgccttctccatctcctccatcgtctcctcctccactccatggttcacaacctacaaccaattaaatcattcccaaacacaatctagctagctaattaatcaataaacttgtagtggtggaggtataatttttcgttttcctggttataatcttcagaaatataatcttaatttttttctgctatatcaatagaaattcgcacttcttgtgcaagtcgtttaaaaaaataaactcgtagtgttaattacctggaagaagccccactgctcgcaggcgagcctgaggttgtcgagctcgtcctcgctgccgcgctgcagctcgccgacgtcgatcaccggaatccgctcctgcgcgcgctcgtcgtcgacgacggcgtgatccggccggtcgtcgccgtccctgatgtaccgctccggcacggtggtggcggagcacagtcgtcgctgcagctcctgcacgtcatcaacctgaccgatcttgatgatctcactcgccttctccgcgcagacggcagcagcaccagaatccatgccaaaatttgcccagttctccaagaatctatgccctactccaaactcaccagttgatcagagtatcttggttgagtgtggtttatatatagtggctgccaggttcatcaccgccgtccattctgaattggtaactactgt

SEQ ID NO: 51168 - DNA, 1501 bp, Oryza sativa
ttttggatcataactgcctgctaactgcatagatatgagctgagaatctgtaagcgcacatatatctgatgaataatgatgctagtaagaaaataatgaaaaagtaagttgtgcaacccaaggttttcaggctctctataagcttcattccataagcagtgtttttcacaaaaaaaaaaggtcacaactacaacatagttggctgcttacatatactaattgaccagaacaaaatccttgtatgctgatattcaattctaattcagaagtgtatcaatgcaatatgtcaaaaaagagtgtaccagtacagggaaaaacaatgttgatagactactcaataataacataagaataaagacatacaaatatgtaccatcagccatcgcatgttcaaacataaacacctgcaattgaagaccttatattatttttatccctatttttgaacctcgtctacatcaggcacatttgtagaagttcagacaacagagcaaagtccattttgtgacagcacttttgaaaagttcatcttgcttaaccacatatgaacctaagatactgatttgatctaaccaagcttccggagcatacaagtataggatgtttgtatcactaaactgtgacgcaaatcttacaaggctaggattcatcatcctaaaaaaataaataatctagctactgcaatactgttacaccattaaagaaatcaatttggtcagtcagtttcaagtagaccatgccagagtttataaatatgatagcgtggatatatatggagtatttctcgaaccttttcaacacaattatccacagaaacaacagccagatcatttggcatatcttgagagctagctttagcagataatgcatctcgcagttgtttgatgaccacatttcctgtcttctcaagcgcatcgcgtttagtttcccaggcctccttaaccttcctaaagaaggcaagtgtaggcgtgtcaaattacacagaagctaagcacttacagtaaccaagtccagaattagtaaacttcagctgataccttaaaatagtcttgaatcctgttcttccgtacttatcatctggaggaaagtatgtaccacccatcaacggtttcaaattaggagacaaaaagacactcaaaggccaaccaccaccgccatacagtgctgatacatatgtcatgtacacctaaacgatgatataccatgattaataaagaacaaagtataacacttaaggaaacagaaacacaagggacccttttagtctgaagatacaaaataagaaaaaaaacaactcagcttgggacacttaggaagattaccttgtcaacatctggtcgctcttcacggtccacctgtcaaaactaataatcagaaggaaagcaatacagttacattgattctttttgaagcatcattacattgcatttacatatattttcacacagtgaaggcatgtattattttttttcgccaggagtgaaggcatgtaaaatgatat

SEQ ID NO: 51169 - DNA, 1501 bp, Oryza sativa
catggctacaaatatcaggcatgcatgcaaatttaattctgccaacctccctgtcgattacgaagttcaggacgtgaagagctggctaccgagcgtgacaatggcggtgccgtcgcccatgacggtggtgaggctcatctccttctccagaatccggtcgagctccgccgcgatcagccgcatcttcggccgccgtctcgccgacgtgctgacgcactgcaacgtcagcccgaccagctccttcatcccctccgacgtgaagctgcctcccaaccttggatccgtcacctcgttgttcgaactgaaatgtgactccatctgacaaaatttcacaagaaaaaaatgaatctctgtttctggatgaaatttacttggaagattgtacattaattaatatttggatgaatcatactgaataaatgaattgctaaaagaaatgctgaatatatgcattacccaatgaaccagaggttctcttggttctgaagaaatcaggctcgctgcttctttgccagtgatgagctccaaaagaaaaaccccaaagctgtacacgtcgctgctttcagaaagctgcgccaaggaatgcaccctgagagaaaaaaatagcccatcaaaatataaatgatggtaagacaaaaatattggtgaattacagaaagcagtgctaacatttttacagctctgcacaatgtagttgcagctcatacttctgataatttcagaggcaaaagttcagttaaaacggcacaatgttcaggcttactctgggtcttggtagatgctgctgcaagacgacgacggatgatgcgacggcgcggcgccgtcgaatcctctgagcagcctgtcgattccggcgtcagccaccttcgcgatgaagttctcatcgaccaaaacattgctcgtcttgaagcccttgtggatcaaaggaggcacgaggctgtgcagatgattcagacctgaaaattttcatagtttcagacactgtgttgtacactttggtttgatgaggaaacactgcacatgaaaattgaaatgttttgtcacctttggccgctccaattgctattgagagcctctgcttgaactctagtcttgtcattgactctttgccggtgtttgctaaacagtgtaagatcattattgtttgaaacaaatttcaagcaaattgggcttcgaatttgacaggaatcatcaactttgttatattaccgtacagatggccacagacactgccattgggcaggtactcgaacaccagcatttgtagacctccttcttggcagtagccgatgagagtgacaacgtttctatgccagatttctgatagccgcttgacctgaaattcagagcgaattcatttttctttgtcaaaaaatgagagtgaattcactcggttacaaatttttacaattatcatacaatcagagaggctatttctaagaataataaagaaaagttacagaggcattcactggcttgtctgtgatcaacaactcaatgc

SEQ ID NO: 51170 - DNA, 864 bp, Oryza sativa
cacctattaggtgcatctagtcggtgcacctgactttattttccagccctccacagtcttctgacttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgc

SEQ ID NO: 51171 - DNA, 1501 bp, Oryza sativa
cttttgtacttttaatccatcagccaggggtgaccacacacaattaaaacatatagaaaaggaatcaccagtgtcaccacaggagcatggaaaaggaatcttgcagtcatcaccaggctaattgctgtttaataatgtcattaacataagctattgccatgagtctcatactaagtcataactttctttttctttttctttttcctttttttttctcaacccaaagctttgctgatgcacacaagttgtcaccaaaatatttttcggccgtccgatgtcaaagggacggctagctggggccttgatgctgcaaaaaggcatgtcgccactgagcactagtagtttgggggtagctgtccatgctggccacaggggaggccacccggcagggcatggcccacaccatctcagggttaatgcagccattttcccctaactgtcagtgtcttaatctccttttttgcttgcccaattgccgtgctccaaccacatttttttaggtcttctctgaacctaacagtacactctcaagttgcatgcacacagggtcagcattaggggctctgccagtactgcttgattggggtgccaccatggtttgctcatgtggtggttggtttttatcaacactgatcactgatctgtactaatactagctctctgctctgaagtcttgatcatgtgtttgttgctgaggttaagctgagttgcgggtttgcaaccatatcagaagaaggaacaacttgcatgtaattccacatgagagcaaagtggctctttttaaggtgacagtaggttcatattcatactagagaaattttatggtttttgacaaagcattttgagttatctaaattttacactaaaaaatttttgataccttaagatacttactacctccgtttcaggttataagaccttttagtattgtccacattcatatagatgttgcctagacttattaacatctatatgaatatgggcaatgctaaaaagttttataacctgaaacggaggatgtagtatctaaaggtaccaaattttatcatagaaaatatgacacctcctgatacctttttaagaatgagaaaattaccctaagttctagctacaagaagtcgtgctaggaagaaacctctaatatcatcctgtaggttttctagataattataaaattatgtgccttagtttggcctctgtcgttagtcgatcacacaaccacttccattacgtagctcgtcatgttacaagttagaaatgcggttgatctcaccctgaagcaacctccaaaccttaaaattaatgtgatagtactactaattttattaagttatcttaaatccgattcagataatcatattagtgggagtgctttagtgctttcaggaaaatgttattcgtacttgggtttgtctggtccttttctaaagttcaaagcttttaggttttagcaaggagaaaagagagtgagtctgcaaaaactatcattattggagactga

SEQ ID NO: 51172 - DNA, 232 bp, Oryza sativa
cccccccacacacacacaccaaaaaaaaaaacttttcaatcaaggttttcatttagaaaagggcatcaaaatgatatagtactcatcttgctatacatagttcactaacaagcaatgctggaacggtcaatcgattatgcacaagtataactcccctaagtcatgcgcatatacatcgttttattctaacgttgcaagttactttagtaacaaatgccaacatgcttgtttt

SEQ ID NO: 51173 - DNA, 791 bp, Oryza sativa
taaatccgtatgtaaaattttcgaagggaatatagatactgtttacacatttggccggcctttgcatggcgcacagttgaagaatgacaagagaaaataagatgaagagagagatcaacgggactacatatcccaccgtctacaataataatatcttaatttgaataggaatttttttcacctgagcttatttatctatacacaaatggaggggagctgccatatctaaagtagtgaaaaaactaattttccttaaataaaataataaggcacgtcatctactaaacatggactgtccaatttctattccgaaaactttaggccgtcagatattgtgattggcgaaatatttttttattctttctctagaaatttctttgacaataatgtctttctacgttcatgaggtaaaaaaaagagcgggactcttctcgttaactagataaattaattgaccatagattatatcgacctccatattaaatcaatcgcacaattgaaaatagcattgcgtttcatctgttttatgttcaacagatggtactcataaattcacatggtacacacgtaacagtgacatatatatgggcgtacttatattatatccatgtggctgctgagatttctcgctttaccccgacctggtgacgtgctgatgatggcattaatcagcggccaggccgacaaataacgtggatgtcgatgtacaaattaatcactccacatcatcgccacatcaactgggaagttaatcaaatgacctcataatttgtcttgccttgctgcacagg

SEQ ID NO: 51174 - DNA, 982 bp, Oryza sativa
tatatatatatatatatatatatatatatatatatatatatatatatatatatatatatatatatatatatatatatatatatatgtattagcagcttctctcttgtttgaatctgctctccacccttcttcttgtagtagttgttcgaactgtatgaattttttaccgtttcgtattaaggaggagatttaattgtaaaacattaataatagaaatgcaagagtatcagaatcacttataatgtgattctgatactcttgcatttcgtgcgaaactttctatatgaaagttgctctaaaatatcatattaatctattttttaagtttgtaataattaaaagagtaaattgtattggtggtacacaaacttattaagtgggtgcaatttagtatatgaacttgtaaaatgctcgttttggtacacaaacttatctaatccgtgtgaactaggttcaacatggcttgccaaggttaattccacctaggtgatgttaattaggatatggcgtgcatacgtatagtgagtatgcataaaacatgctatatttataaatttgttctctactttattttgaatttcgtatgtttctaacccttgtatcattgttcggtttttaatatctttctctgcaatcactatatatatatgtgtgtgtgtgtgtgtttacgtagcatcctaatcagcacataaatcaacaaaattagtcatgtaatgtccttttgaccttatttcgcacgcacaagataaattcatgtaccaaaacgagcattttacaagttcatacactagattgcacccacctgacaagttattgtattgccgatgcaatttactctaattaaaactcaatcaatcatacgttaataacatctcgttttttataaaaaacttaatcttcatgttaaaagagaaaagaacaccaccggtgttaacttactaggatcatttggatgatctatcgacagccggcggacagggca

SEQ ID NO: 51175 - DNA, 1501 bp, Oryza sativa
gctcaggttgtatgcatgaaatcattagtgctttctagtctctagtagtgcatatacatacttcacaagtctaagtccttgtatatcttttggcaagtcacatactgctacatgtgttggatagatacatgccatcagaacaataaattagtttcagtctcttgtttttagaattttcttatgtacaaaccctttataatttaccttgttcatgtcactttgtatttttcttaacatgccatagcttgaatatttaagtgctgcagttaaatatctacagaacgttgcacatgatgaaaatcaaggtatgcttctcattcagtggatgaaatcttttcttagtctaagatgtcctagcatttgcaccatgaaacttgtcatttaagcatccatagaaaatgagtctgatcctattatcctagcatttatgtcttatctgaattggcagagtactacaggaagtattttcatggtcacttttcatttcagttgccatatttcattttcatgcttgtagttgagaaatttatgttgctcacttcagtttttccctgtactaatctatttgtttctctataactggggtattcataatcattgttatttattttgtaatgaagaaaattatgaaattgaacctctttttttaaaccttttagcttcctttgcccaaggttgaagcaccacggaacacggactgctgctggaagacaattttcttttacatgtgtttgatgaattgtaactgaaccatttaacttttctatggaccctttgtatattactaaatccggtttgaatgaatttgtatgtactgaacttagatggactatttatgtaagctttgcaaacttgaattttgatgtatggattgtgattgatgttcatatatttatccaaatcgccatgtgtattttttttttgggcgtggaactcattttttctgacggtggatgatggtttttcctgacgggtccacgtcaaaaataagctttcagaaacctgacgccagttgattttttctgtgagccaaccgacaggaattcctccgtggtcttttttctatcaaaaataagctttcaaaaatgatatttctgtcaggaaaccgacagaaaaatttaatttctccgtagtcttttttctgtcggcaatttttgacggtgcacccacagaaaagcattttctgatggtaattcatattattctgacggttttcggcctacagggtagacctgaagtctggtagtgcgtcagctagcaaaaattttatacgccgtcacatcaaacgtttgaacacatgcataaagtattaaatataggctaaaaaataactaattgcacagattgcaactaatttgcaagacgaatcttttaaacctaatcgctccatgatttgacaatgtggtgctacagtaaacatttggtaatggcggattaattaggcttaataaattcttctcgcggtctactggcggattctacaattagtttttttattagt

SEQ ID NO: 51176 - DNA, 1037 bp, Oryza sativa
tcgaaccctaaaccgctctcaacagtaccatgggagggggggggtttgtcctgtatgaaaattcaagatgaacgatgtctgattttcgaatttagggggggtaattcggtcgactgttatagttcagggggtaattcatactttttcctttagaatttactcagattttgataatctatagttgtggaatccagaaaataaactaaaagccagaaactggaaaagccaacttttctagattttcacctgctagattctctccggctgcttctcagaatcttaaacttcccccaaacatgacctaaatatcatgccacaatgacaaaagtaacgcaaaattagatatcacctctccaataatagttgtataattgggcaattggagaatcgaagagtggcagcttaattataagagtgttaacttacatgagtggcaaatagtcaaatgtcccaaaacttttgcggtatttttcggtggaactcctacgaggctatactgtagtatcaagcggagggcgaagaattatatgcaattattcagtaaggatgatttttttatatagatgaaaatttcttaattaaagagggtgtagcgcgcgagagattaccatttccattgttttcgctgcctcctacaccgatcacgcattaattgtatggcatgatgaccgtatgaagatgaccatataacaaacagacgatgatggttagactaagtacagtgtggaggatggataccgctacacttgttgtactcctgtacttgtaacatcattttctcgtaacagtgaagcagatcgatcatgctccacctaacacaattccgtgaaaaaaaaagataggccttctgaatattacctctaagaatgagactttgattaaccatttgaaattcaaccaccaatctattatagtatttaaacagtcttagaagcatcgcatttattgtgtaggctaaaaatagaaatacaatttaaaaataactaaaattcagaataaaataagaaatattaaaagaataatccatgttgcgaaga

SEQ ID NO: 51177 - DNA, 1501 bp, Oryza sativa
gatcaggctcatttgtgaagtagtcaaatgcatcttgtccactgaaaagaaaaaaaaacaatgtttgagtaaaagtgtgaatattgcaaaaatgaagctctgattagtgatttctacatttccagtttccaagggtaaagtcgaagccacattaggaactccaatttagaatattctgagtcatacgtgagagggcaatccatgtttttcaggcataccggttgatatgaccaataattaacagtaccgggtcagacaaagcatgaaggttaagattgatgcatgtcactatctcttagcatgattaaagatagcagtattttgtacaaaatgtaagctacaaactgtgtggatatttcaacatacgaaatttggagtatcgtcatgttcttacacttcattattggttgaagactgttcaatacagtattgataatgtaaagcattcaataatagcagcacatcattagcataaaagtagtgttatctggagaagaattcgaacctgcaagtgtatagtttctcatttaacattctgaaatgaccaccagataaccttgcacgcatctagagtgcacatcataaaaaaaacatatcaactaattagctcagagaaaaaaaattcaaagaataaacagaaggtaaaataagtaaaacattcatataataagtcatgagttatctccaaactgcaggctagttcattaattttgttttttaagcaaaagttattaaattattaaggagcagcaaataaaagcctaacgtgaatactgtgttgcctaaagaaaatgtgaatactgtgcaaattcagagcaatgtatcacattcaaccatgcataagagcatacgaagcactactgaattactgaggtttggcacttctactgtcgctactaaagaataacagaggaggcaccctatgctttgacttcacccacactgagagatcatccagattcactaaataacccatcaaccctagtcaaaatttattcccgataccaccccgaacattttgtacttccaccgactcctgctactggcacggcatatactcctgctcctacctaccaatacacgcctaggcctcgcaaacctctgctccggagagccgattaccttgtcgaggaggctcgcgggcttcggcttgctgccccgtcccttgggcgcggcgtcgtccccgcgctgccgcttcgcaggaggggagggcggggacgccgacgccgccgcccccgaagaggacgaagcctggtgctttcggcggttccggccgcctcctcggcggcgccgcttgcggccgccggctgccgccgccgccgcctcctgcagaggctccatcggggagggaggcggcgcgaggggggagggagttcggggtttcgtgccgctgttctgggttgcggcgactacagtgcagcgagagagagtggtggacggaagcgggccagggtgaatatgtatatatttcggcccaatagctttcttgggtctggctagg

SEQ ID NO: 51178 - DNA, 1501 bp, Oryza sativa
aagaagaaggaaaaactacattcattcgcttcaaaccccgtcaggagtggctgtttcggcacaagacaaggaagaagaactttttagatttttcaaggagagattggggaccaatttccaaagaactttaagtctaaattggtctctattacatttattacatttaccttcgttggaccttaatgagctagaagaagatattacggaggaagaattaaaatccataatttttgatttgccccctgaaaaggcgcctggtcccgacggcttcattggggcatttttcaaaaccgcttggaccacggtgaaagatgatctcctcacaacaattttatcctttatgcatctcaacacttctcaacttgcagaactgaacccagcctttatttgccttatccctaaaaaagatgatgctacaggcgctgatcacttccgtcccattagtctcatgcatagcttcgtcaagattatcaccaaaattttggcaaatagacttgctcctcgactaaatgaaatgatctcacaaaatcaaagtgcttttgttcataaaagggcaattcatgacaattttctgtacgtccaaaacatggtgcagatgcttcatagatcaaaaaaacagagtctattcattaagatagacatagcaaaggcattcgacactgtgaattggccatatctcctggaggtccttcgtcatttcggctttggacatcattggttaaattggatctctaatctgttttccacctcctcgtcccaggtgctcctaaatggttccccagggatgagaattaatcatgctaagggactccgtcagggagatcccctgtccccgatgttgtttattgtagctatggagccttttcaccggatcattaaagcagcggagagtgccaatgtgttagccctgattggtgtgagaagtggcatattcagatgttctctctacgtggatgatgtggcagtttttgctctcccaaatcccgatgacctgaatgctctttctcgcatcctttcgtgttttgcacaaatttctggtttacattctaacatcaacaaaactgagattttccccatcagttgcaatggaatcgacatgcaacagcttcttgccggttggccagggcagatcaagaatttcccttgccgctacctaggcctcccgctccacttcaggaaattaaggaaaattgatttccttcctcttatagacaagatcggggccagactaccagcttggaaaggtcgcttctttacctctgcaggtcaccaaaccctagttaactcggttcttagtgctatgccgatgcatcatcttacagtccttcatgcgccaaaatgggtcttcaaaagaatcgaccgtttcagaagatcttttctgtggaagggcgaagaccctgatcattcaaatccaagtgatagtctagtcaattggcaaactgtttgcaaaccgaaaagcttaggagggttaggccttccggatctggacaggttctctaga

SEQ ID NO: 51179 - DNA, 1501 bp, Oryza sativa
actagccaaccaaagaattttatttttggttcagtcggggatttccatagagaatcaaactcattggtggcaaatgagccttcgaactggaaaaggtaagcactctttgttgtgtagacgccagactcggtccaattcaaggtgatgttgtcaggatcctgggaaagcgaaaccagttggagtaatccaccaagctgtaccaaatcatggatttgttccacggaagtgaattgtctgaaggaagtgagccatctattatctcgcatttccatctgaactgatctttgctttctctttgccaggctaaaacaactgggcacaatatcttttaaacaacggttttggatccaattatcatgccagaagctagtttttgctccgtcaccaatcgttattgtcgttgccgcttgaaagagtcttgtgtccatctcatcacaaggcacattcatgcctacccagggtttatcaacttctttccacttgaaccagagccagcggagtcggagtgctctagagaacctgtccagatccggaaggcctaaccctcctaagcttttcggtttgcaaacagtttgccaattgactagactatcacttggatttgaatgatcagggtcttcgcccttccacagaaaagatcttctgaaacggtcgattcttttgaagacccattttggcgcatgaaggactgtaagatgatgcatcggcatagcactaagaaccgagttaactagggtttggtgacctgcagaggtaaagaagcgacctttccaagctggtagtctggccccgatcttgtctataagaggaaggaaatcaattttccttaatttcctgaagtggagcgggaggcctaggtagcggcaagggaaattcttgatctgccctggccaaccggcaagaagctgttgcatgtcgattccattgcaactgatggggaaaatctcagttttgttgatgttagaatgtaaaccagaaatttgtgcaaaacacgaaaggatgcgagaaagagcattcaggtcatcgggatttgggagagcaaaaactgccacatcatccacgtagagagaacatctgaatatgccacttctcacaccaatcagggctaacacattggcactctccgctgctttaatgatccggtgaaaaggctccatagctacaataaacaacatcggggacaggggatctccctgacggagtcccttagcatgattaattctcatccctggggaaccatttaggagcacctgggacgaggaggtggaaaacagattagagatccaatttaaccaatgatgtccaaagccgaaatgacgaaggacctccaggagatatggccaattcacagtgtcgaatgcctttgctatgtctatcttaatgaatagactctgtttttttgatctatgaagcatctgcaccatgttttggacgtacagaaaattgtcatgaattgcccttttatgaacaaaagcactttgattttgtgagatcatttcat

SEQ ID NO: 51180 - DNA, 1501 bp, Oryza sativa
accattgcatccgcaaatacacttccttgggggagctcgatccctttggttcatcgaacgcgcgcgtcctcgccgaataggaaaaggacgatactgcatcgtgctaccttgatgcaagaacatcgtttgctttctgttccttgcagtattggtaactaattgcaaattagggagatgaactttctgatgtttttttttttgtttcagaggaagtcactacaacaatgttcgatcgtgaggagaaatgtctggtttaggatctcttgactatcatcgaatcaggaaggtttgtactgatttcgcatcatgtacttctttcttcaccaagcacgtatccatcgttcatatgtagtgaatgcctctctagtctctactgactgtttgtggtacatgggctatcgggcttacacttcaaactagtataatttacacaccagattttcatataaagatctgacgtgccaaagtggacaacacatggtccttcttgttatactatgtgttaaatttcatcattgttggcatctggaataatacttttttttagataagggtaatttttacccggcctctatatccaaccaaatatatgcatcatttttaaattgagaacttagctctcaaataacccaattcggcaataatactggagacggatccttacaattcagcaactgtctacggttaggctgactgaatcctgccatgtactgtgtgttacagtgatgcatgttctatctgctgttttccacaccttcttttccagtgagtgttcagggatcaattcctggacatggtacaccgtacagtagcagggtataagccagagccccaggaactgaaagtgcgcagagcatgattctcgcagaaaagaaacaaccatatcttgttgatttgtagcagattgagttctgcagaaagcgcaaggcttcttgcttggaagcacggcaaaggttcttcctttgacagtggtaacaatgcccaaacataaggtgacaaaatcattcagtgagcagagggctacagcagtacaggtcagcctttccagtgctgtgtagtgttacatattctctgttctgtcatcatcaagtattgctcagtgctcactactcactactaggctatatttttgctcctatttcttgatcaggatggagtgatcgttttgtttctagaatcatcggaaccaagtgattagtcaaaaaattgttcccggatatagtatgcttgaactgaggggctgttcagattgatgccatttcaaaccatacaatttttggtaaagttgtcaaagatatgcatacatttagtttttttaatcaaactatggtaaatacataagaaatcctgccaaaattttggtaatattgccagcattttattttggctacaatctgaacatccccttaatattgcctcttcccattcagttcctgtcggtaataacaaatctgcacattgataaacagttctccagtaaggaaggctggaagaaaatagg

SEQ ID NO: 51181 - DNA, 224 bp, Oryza sativa
cgcgcctggcatgaaggcggaggcgagagcgacgcgacctcggcgagggcggtgagtgcgcccggcatggagacggaggagagagcggcgcgaccggcggcgagggtggcgagcgcgcctggcatggagacggaggtgagagtggcgtgactgtcggcacgaccggcagcgagggcgacgacgacgcggtcgaagatgaaggtgttgcggcggagacagccata

SEQ ID NO: 51182 - DNA, 156 bp, Oryza sativa
gtgatagtttcgtcaaacatggcgtatcacaaaactgccataaaacgaactatattatatatttatctacatatttaggatcagatttatcaaagaagtacaaatttagtaataatattatcacaaaacatgtagtatatattacgggtgtgaagg

SEQ ID NO: 51183 - DNA, 1217 bp, Oryza sativa
gtctttccgctatatcgactaccttttataacaagtggtatcagagcataaggtttcagcattggatcaagaagacatgtggaggaggaaacacgaggtggggatcgcgcatcgacaggagatcgtcacccgtggcgatgagatcgatgtcgacaacgagaacgttggggaggccgcgacctcgctcgcgatcagaccggcgatggcggaacgtgaccggaagacggggccgggcgtggccgaaggcgaccggagagatcggaggggtagcgccatggacggcgcgcccgacgaatgcggtgatcgcggatccgcggcggcaggaggccagtgacggaagggcgaaaccggcgagcgtggtacggcgtggcgaacgtgaagggccggggcgacggggtcgtggatggtgaacatgagggctgcgactgcggtgcgtgcataggcacggacagatagcacaggtgctgtcttatacgtacggcgtgcaaagactaaggagcaaaggcaagaagcaaaaccaaatcgagcaattgcatgcaaacaaggacagggaagctgcagctttggaactcgtgcatggctttagcgtattcacgtgaacatgagcatgcagggcatgcatatcgtgcgtgcacaagggatcaaggggcagcagtaccaatgcttcatacatatgaaaacttttgtgccgtggaagtctgacagattgatgagccaaaaaagaaatcgagtggagaagttggatgataaaacgacttgtcggagtcggacaaggctgactcgaccgcaattgctatggagtcggattcagagttatgtatggatacggactcatgatcgcatcagactcgtattgcttgccctttaaataggcagccgaaaagagagagccgaaccaaagcaacaaagcggcagcgattttttgggcggctcggcaggacattggtcagacgtggtacaaggggctcaataggcttgttgtgcagaggcttgtgacaaagtgcgcgcgtatgggtggaccaagccaggccgacgagatcgtgcagagcagaggcacatcgagggcggaagattggtcacatcggattatagcgaacgcggtttgctgttgaatatctgagattggatcacaagacgggattgtgaagacgaatacagacggttctgagcagggcgagtattctggtggcgacagaccagtcaggtcgcgggttggc

SEQ ID NO: 51184 - DNA, 1501 bp, Oryza sativa
ctacttgtttcagggtagtggaaatatattgcatcccggcctttgttatccggcatataacggtgtttagattcaggggtgtaaagttttggcgtgtcacatcggatatacggacacatatttgaatattaaacgttgactaataacaaaattaattaattacagatccccctttaaactgcgagacaaatttattaagcttaattaatccgtcattagtaaatgtttactgtagcaccatattgtcaaatcatgtactaattaggtttaaaaaacttgtctcgcaatttacatggaaactgtataactagtttttttttctatgtttaatactccatacaagtgtccaaacattcgatctaacatggtgtaaaatttttgcctgcgaactaaacagggcctaaaacttttttacctaaaaagacagttgttgaaaggctaaatcctaactaccgtagcaaacaaaattgacggataaacttaaaaaaacccatatagattctaacatattacgccactcatacagtagaataaaaagatccctgactaccaactctaagaaaagtaacactattgtgtgtaatatcatactccttctaccataacatcatacaccaatattgaagctagctgaaagatatggagatagcctgtgtgggattaaacaactttttttattaaaaaccttatcatttcagtaatgtcaaaattgaccaacaaagcacactagccctgaataaaacctttttcaagcgtctaggcacttctcggagccagttataaaaaaaaaattctggtgcttcaagaaggagtgatatcctatatatttataaagttcatccctactaaatatagttaatgctatttttttctctaattaagtcaaatcatcttaaatattttgagcccttggatggttgatctagggtctaaattatctcccccttttcttctgttataaaatcatatcaccttagtttttttttatgattaatttgtcttaccttgtttcttttccttttaaacgatcaattcatatgtgatttaaattgttataaaacacatcatcaaatggtttatatatagttttttttaatagtcgatcagagatgaaaattatatatttttttaatagtcgatcaaagtcctaaccacatatatatatatatgtcccgttaattggcatgtcggaaagattcataccgtgaaaattgatcttaatttccctctcattaagccaacctaaaattgagatgtgcctactaatgagacattgaagtgaggtttaccaaaagaaatatagtacatatgtacacttctcccaattaaggaggcagtgaccagcgctatcattatcaacttgggatgcggcttccctgttcctaatttttgttcccatccctgtttcttgccagatgtcaatcgcttattggtttcgtattttctagtgggcctccacacccttgcgcctccgtcacacgcatggcgttaagtctccgtt

SEQ ID NO: 51185 - DNA, 1501 bp, Oryza sativa
tcgatcaaagtcctaaccacatatatatatatatgtcccgttaattggcatgtcggaaagattcataccgtgaaaattgatcttaatttccctctcattaagccaacctaaaattgagatgtgcctactaatgagacattgaagtgaggtttaccaaaagaaatatagtacatatgtacacttctcccaattaaggaggcagtgaccagcgctatcattatcaacttgggatgcggcttccctgttcctaatttttgttcccatccctgtttcttgccagatgtcaatcgcttattggtttcgtattttctagtgggcctccacacccttgcgcctccgtcacacgcatggcgttaagtctccgtttaattctgagccatcagctatggtacggaggtaagctagcttcatggggttgccggcggcggctgatttggtcccttgcagccgagcacaagcgacgggcgagcagatcggcgacctcgccggcgagctcgagcaccacgcagtgcattaggcgacacaacatcaatctcaagtgcgggccaccaattcgattgccttgcttccgagttccagcttgagctcttggaactagcaggtacttgtctttgatcctaatcttcttttgtggttttgctttaaatttgttcttttggtacaatatcacaatgatattttgtagcataacaacattgcaaaaatattttgtagcctgaagaagtgaagataatttttgcaacctcagatccctagaatgtatagtttagtaacttgcaagtgtaaattgtttccgtactaaattcaactcagattcaattaatttaacaaaatgtagagcataacatattgatcttaccgtttctatttgcttcattcccaggccagcggatgaatcatcaggctcaacaagatttgtgaatgacgtcgttgcagcagatgtattgtccaagaacatgggacttgctcctgcatcatgcagttgtgatgcctttgatggaggtatcatgctgttgtttagcatagcaccaagatctggcgtcgatgccggtgcttgataagagagattaatttatcaagatgctaatgcatgtttagatgtgagttgtttggatgctggaggatttaacgggagaactgagacaaatggcgccataattctttttcccgccagcaattctatctatttggcgcctaaaatatgttagtaaagttaatggtgttgtttgtaagtattaaacggagatgtaatgccgttcgtgagacagaggcgcaagggtgtggaggcccactagaaaatacgataccaataagcgattgacatctggcaaggaacagggatgggaacatgaattagggacagggaagccgcatccatccacttgacgaggatgacaaataacaagcagatccacggtaagccacaaatcctaccaaccgcaattaggtgccaagttataaggaaaccaatattggacaagtatatatatgcttgttagta

SEQ ID NO: 51186 - DNA, 1501 bp, Oryza sativa
tcatactcctacatgagttcagtttctaagatgtattctattcttttaccattctgatgggtgttgggtattggtcagaaaaaaataattcagccgtccttaataagtactcctaacaattattagtggtctggtaccatttcttaggcgtatgtttgagctgagtatatttcttgttgttttgatgcaattattcacgtacaaccgtgcttagtatgtttattgtgatttgtttcctttatggcctcacttgtatatgctcatgtgcttacttcttgactgtactcgaccacatgcaaactttctgaatgtttccaaacctcaaaacttcttgaacattcgattatctgctagtgtgaagttccctgtttgattggtgataggaatttatttgtctagtgggatcatgatcttgggattaaatattccctgggccaggggaggtagtgaggtatatggctaatctaaattctaaaacctccagctcatgggggagaggtaataatacatcttaccatttgtaggcaaactattgtcttcagcttcaaatccgtgtaactttcacatgtacaatgataatctagaatgtacttgcactttgttcaactgtggaaatgtttttactctgtaggttttactgttgttatgcctttttctaattgataggtacgatgattatgatattactgttatttgaaatgaaatcgggccaatattttgtcctagctgagataccgagatttaacatcttcagtttgtctatgctttcagagttcatgcttgctttataaacacacgagtatattttgagttccactgttggtaaaataaccaaaacttctctaggatattttgccttttaatatactattaccttatacagtttatctacattctatctaatgatatatatgaaacaagtgatgccctcgttattgtacacttcatatagaacctttttcctgaatccggtgatgcctggagaaacattgcccaaaggaagggctaaacccatctattcaattaggagcccagtaataccataggagtctgtctgagaaattaactacccccacaatgaattattgtatagaccaagtgcagaaagtcattgagccttagcatgggtttgttttcactgctcctttttattttcatattttaatgttcatctagcttcctctttcttaatcaagttgcaacagatatatttttgcatcaaggaaatatggcaactgatgaaaataattcaatcttactatcctaggctcaaattagaatagtagacatcacaaaaaataagtgattaaactaaatcctctaccatctgaatggaccctatggatcttcaactattctttcaactgacttcctataaatatgtaatgcagtttggatatgtgttatctagtccaatttaatttcttgatggtaagaatcatacattgtctttcattgttcgtgtgttttgtgttgtttgattcaaattttgttgttagca

SEQ ID NO: 51187 - DNA, 236 bp, Oryza sativa
tatgcctccctcatatgtcggtcctgatcgaatcgcctagaatcaggtataacgagcctgttcattttgatgtcaaaaaaaaaaaccctactaaattttggtaacttaccaaaatttttgcagaatttcttatatagttaccaaaatttgggagcaaactaaatatagtcacttttttttacaactttactaaaaattggtaaggttgaaaatggcatcaaagtgaataggcccaa

SEQ ID NO: 51188 - DNA, 1501 bp, Oryza sativa
atgacaagggattcaatgacgaggatgacgcccctcacgagtggagagtaaccgcatgagcagtcaaagcatacacagcaacaatatgctgctgcagtgtccctttctgccattgccaccatgatgggcaagcaccaagcagctgctatcctccatattcacatcctcaccgagctcccatcgccgccggaaaggatcctttgacttaactgcatgtgcagttaagtcagaggatctgcttccatcgccgccgcctagcgaaagagatggggaaagagacatatggagatgtgaggaataagatgagattaatatgacatgcgggctctacatgctaactcagctagtcagccacgattaacctaccatgttagcaaaaacttttttaagatgaaaaagatgttataccagttttacggttggagacaatttaatcaggaaccaaagatgaaggagtccaaataaaactattccgagagaaattgctccagtctccatgtccatgggccggcccatcctagcagcgcatgaattgttgcctcgcatcgcattcgatcgagaaagaatttttcagagccgcaagagagggggagacgaaggttggagctccccgtgcttgtcgcttcacgttgttttcgcctgttcaagagagtgttttttttttcactgcatccttatccataaacgtcttatccagaaagatagaaacccgtggttaatctcaagttttgtttctacaaacaaatcttaagttttacgatgatctatattatatcacttcatactgtgatgatggtgtagtttttctaactccactttaggctggcagagtaaattgatttaggcattttagttcacctatattagtgctgcatgcgtactgctggactactggagtgcaaaattgccataaattttgccaagtatgcctgatgtttgtcataactcataaatacacctccaacttttattagtaaaaacataatatattgcccggccgtctcttataaaccaatgcatagaaaaaaatcaaatgttatgtgaaaaaaactactactccctttaatcattaatatatactgttgatactgtatgtcgtttgtcaaattgaaactaatgttaagaacgtcatacattaattatcgaagatagtattgcacacatacaggatgtatatcaaaatttaataataagtgggctacgagtaacagcccgtacgcgcacgtgtggtgtgtgtgcatgtgcgtataaggcatgcttaatttatgtacaaacctatttttatacctcgaggaaaaatgggaaaaaaaacacctgtcggccggaagataaaaattccacctataaacccccctcggccgttcccacctctccccttctttttcgccacccgatccggcaacaacaacgtacgtaacctcctctctctctctctctctctctccccttccagccgcgcgcgcgcacgcacgccgccgtcgtgacgtcgccgtcgcggtcg

SEQ ID NO: 51189 - DNA, 1501 bp, Oryza sativa
cgaggatgacgacgaattcgggtgtgttcgccacagcggagcgatatattagcacatgattaattaagtatttactattttttaaaaaaatagatcaatatgattttttaagtaactttcgtatataaatatttttttaaaaaaatactgtttagcagtttgaaaagcatgcgcgaaaaataatgagtgaggggttggtgccgaacacatccgcaccgggtccaggactacgggagtggggactagtctcatagagggacgattggcagacgtacggttgtgttcgggagtgagggttgggtactagaatgcaaaacgaagcagcgtttagcacatgattaattaagtattagctaaaataaatttaaaaaatagattaatatgatttttcaaagtatacgggatcgactaaatgagtacggcaaacgctaacaggtgaagtcgcagatgacaacacgagttcatttaggttgaagttgggggctactgtcatgattatggataaggcatacctcctatcttaggacttatggaatatatgaatacggtataccttcacgtatacgggttgtttccgtatgctctaagaaaattcatcagatattaaggaaaatatccttacgagtcgagagactgacaaagtcctactcggtagggatagggtccttaccatattgtacggggtctgatgtcgatctgatgtttctgagttctacttggagatcaagatgacctacggtacaaaaggcaccccctgggaggggttcaaggcatcgaatctcaccgccaacacacccatcatagtctacgaagccatgtatgagattcgaaggcatcgaatctcatagcacgtgaagccaagtcaccatgaggtctcgtcgaatccatcgactactatcccatcggtatcgccaaattcatttgttcccattgtactttgtggttttttcatatcaatcctatataaactggactagggtatgttcatttcttctataagtagaggataaaattttagatattcgtggcacgcttttcaaactgctaaacggtatgtttcgtgcaaaaactttctatatgaaagttactctaaaatatcatattagttcattttgcatgtttttagtaattaaaactcaattaatcgcacgttattactatctcattttgtgtgaagcatttaatctttatcttcaggagattcaaacaccacctaagactattacttgattaggggcctgaaccggtataattcttgtctttgtgtttgcttgatatcatatcacgtagatactcgtaccaacgaaccctaataccccaatcatccagtctacgggtatcgacaaacatttttatctctgtaataactcattcgtttgctgcctcgattgttatcagaaaatcagatattcttccatcaattcagacttatcaaaccgggccttagttcagcacactcaaacctcacgctctcttgggcctcttacatatagccagaccg

SEQ ID NO: 51190 - DNA, 1501 bp, Oryza sativa
cgccctacaatataaaaaatgagtgtatttttgtatagctcacaaattacatgtcaaaattatacctattaaagtcagcacctgcaagtatttatgaattgatgtagtagtaagtttgccaaggtaggggtagttaactgataaaaatattctaaaattgttaaggagacatctttgagttcttgtgattatgattgaacctgcagtcagtgtgatgactcatgaggagggccccatatgcatggggccaaatcatgaccatgcacaagattagaaagaaaaagaagcaaataaagcaaagaggagtcctgtcctccatcccaatcaaatctcagcccagctgctccttttctgaacttttgattagccccatgcacagtatcagccaaaccatctacttagagcaaggttaatagtgtcgcccgctaatggctgaaaaataaccacatcagcctcttatagatattgctaagagctaatgtatacaataaacaggtttacatcgactattatttattttttaatctttagctaacttccccatccaattttttagtcttattgccgttgtttcgtccaaccattactgcatcgcgtcagctcacgtggacccacaatcgcatgtcccaatcaaagctagcctggtgttgctgcacttgcgttgggacgtgtgtttagccggcaacaatttagtcgccgactcatgctctctctcctatttagctcattgacaaatccgatgtggcagttttatcgccggctaaactggcttattgtacttgctcttacttgactgcttaaccaactgagcactgttgtaattaaatcagtgcatggctagccctaccaacttcacttcagagctcagactggacctgtccctctgaatatttgttttggttgttccttgctgtagaggtagggatcaggctctgaatgagttgatgatagtacaagggagaattgattatcagcatggcaatggaggaacatgcagacatagcaatagtgaaactagctgagtactataactgctactagcagttgtgccatgaatattcaccagtcagcatccagtagtagcaggaggaggagtaagtagagactagagagcagcagttatcactggtctccttggcttggtttgcacgggcattattatatgtagctgttggctgatgctgccattgccaggccagcaccataactactcctggtactatagttaaataggagtatctgtcatgctcatgacatgcttgccttcttcttattctccttccctatggtcttcttcttcttcttcttcttcctcggagctcgttgaactcctcccgccataattgcatcccctattcttcgccaccaccatcgcaagaatattctttgaagtgttttgtgttgtacttgcattcatctctctgatcaaaagaggaattggcaacagaggaggatactaggatggtggaggcagtggcgtcttttcggagaggaggcgttg

SEQ ID NO: 51191 - DNA, 494 bp, Oryza sativa
atttgtctcatcccattttagatgtgttatattctaggacggaggtagtatgatacataatcggtatcagccgacaactactaggtatcaggtgatacttacgaggtatcatgtgatacttatcaggtatcaatcgatacctagtaggtgtcgcctgatatcagttaggacatgatacaaatggcagccgtctcatagcattcccattttaaaaaggtagcttatttttgtgaaaaataaacatttatcacgtgttcattttttaaaaaaggtcattttagattcacctttcgtatttatacgttgatctattttgggactgagaaaataccactacatcgcaatctggcttagcgctgtcgagggtcccacaagtctggagttgcacccccatcatccaattgcagggcagggaactggattggggggataaagctacggctagaagctaaaaaaaacctccgttctgaaagaacacggccatctcacagaca

SEQ ID NO: 51192 - DNA, 1501 bp, Oryza sativa
gaactactaaaataactgaaataataccaggaaataacaggtagaggaacaccaaagagcaattgccatgcagctggaacctacaagccttgaacctgaagtatgaataaaaggagaagaattagcaaatgaagcctcccatgtgaagcaagagcatttttgtgagaaaaataaatgaaatgaaatatgcagtgtgttgttgtgtacgctagaaatgttgatatagcatgatgggcatatgaatctaggtatttaagaaaaaggaaaatcacactgcacatatttgctctagtaataaactgagctgctcatagaggcacggggccatatgtaccaaaacaaagttgcttatgtgaggcaaggacgtagaatatgcatgtaattaagcgtatggcaagattatatgaaaaatagtttgtaggcgatacaatacagcaggaagaaagtgaatttgacaaaccttagtggagataggactgaacatgtaaacacaaacagaatgggacctgtggaaaacatatatgaatatattgtctgcagcttatagctagcacactaacctgaagctggagagtccggcaaaggctcctttcgtttatgctgtgatgtagttgtcgatggcccagaagagcatgacatcgtgtgaaagctcaatgaagagtgacaaggccttgctgaaacaataataatccaatgcaatatagctttagtacacatatacacaggatacaatatatctaaaggaaagtatatacatatgcaatatttggctagaagcactaacagattgataaattaagcggcagtaaatatactctcatagccgacgaaatagagcataagacaataagacaatgataaaattgattgaatatttacgaataggctggccatggtagggagctattttagcagcaaaacatgaaagaagcaagtatggtgccaataccttgatgtccccccaatgtacagcagctgtaacctctgccattgctggcttttaagacctctggtctagcatgcagtaacccataatgcaaatagctgtaaagaaatgtatatataagtggtccaatggctaaaaattttaaataggtaatgtgattcattttctacagctaacaaccaaaaaaaaagtaatagagtataaactgatcgttctatgtgagattaagagtttgctgtagaacacttcatagacattcgcgtgatatagagtatgccttgggaatggagagcacaaattataggccgaccatgaacaaaggaacatgtattagatctcagatatgaactgagtgctacctgcaagcaaagctcctgaatgagactcacaaagcaacgccaggttcaagttgtttggggacacacattatgcaacattttcaataactccgggggtgaattgatgtcgcttttcgatatttctgcactgaaatcaggcaagacctgcaacaatgctttgccttcattgcttgcaaccaaagaagtggcaatagtc

SEQ ID NO: 51193 - DNA, 1501 bp, Oryza sativa
tgatcatgcagataggcctgcagttcgctaccgaggtgcaggatagctaggaaggagataactggagcagtacttgtgtcatagactgatagacagtgccgatcgacgaggtgagctcttaatttgtagtttcatatgtaactgcattatctgattattgtcagttcatcagacagttgcatcgaggatactgggcttttggtcccatagcttcaaacaaaaagaccgctttgtagtttcaatctggaaatccattttcgttggtcccatgcggtgaaggtaaagacagtttgacctattgtttctgctattttaatatgtacaaggtgctatcggtgcttatatgaacatatgctatcagttatacatatcaactatctgtttattttcgctttcccaaataatgaatactatatgttccatggcattttacagggcactttttggggaaaccatagtaatacacttgtatgtttattattgtgggttaactgtataatttacgttcggacttgttccctgtaaagccaacatagctggactttgtattcgaaataccgatagccatctaaaacttggccaacattgtttcagatttatgggtcaaatatttttccattttttccagcatttggttgtttcttgttgttatttgagatttataggactggtcttgatctgggtgaaatgcttaattgatgtaaaatttgaccttaaattgcagccattatccagtcaatattgcacagaagtactagtaatactgttgagctataaaatacagctcatatgaagtttatttttttcacgtttctcataactttgtcgatttactcggtaattgtgcataagactgaagaccctttcccagtaactggtctacatgaacctttgtcaaagctgctaagccttttcaacaagttggatctgcaaactgataatcatctgagaaaatattaggcacaattattagactcaagtaagagtgtctcgttacccatatttgtctatatgattcaagaattcaaaatatttgcagccactgaatccttattaatacttttctattcttctatgtagactttacatatatatactaaccctctactgactggacgggtgctttgatctttgcatataatgaccctgtactgatttgttttggactagcataattagtataaatggtaatactgttctagcatatttatatgccttttcacatgaaaaactgttgtgttttttatttaggagctccatagcattggtgctctgagcacttaaatgccagcatagaactcaattcaagtacttgagtgatttgattgtctgtcttgaatcttattagaaaattgggctccactctgcgccggcaaccccggcgagcaacctctgcaccgccacctcccccgtcgtctggtctccaccaccggtaagaaattgcagaaccccacgtttaatttaattaaaaatcttttctgttcagagctgcagattaggt

SEQ ID NO: 51194 - DNA, 161 bp, Oryza sativa
gaaatgatgctcgaacaagggtacatcccacaaatggccaacatatacaatatgcaggtcaaataccaaaccaaaccttccaattctagcccacactaccttactttcaaccaaccagagccatagatacaaaaaaaaccctttaagccaaaacctacaaa

SEQ ID NO: 51195 - DNA, 1501 bp, Oryza sativa
gattcttatacctaactacagattcgaaagtgaagtcggcaaaaggagaatcagccataagaaatcttgaaactgtgcacgctttaaagacacaatacttcatccacaacacacgacttgcagggaaaaaaaaaatgtcgacctgagccctggccaactcgatgagcagaaaatgtgtctagtgcggtgtctgctaaatgataaattgtggccaatctctagtgatcgtagaagacaagatcaagtattccatacctgataaattgtggccaatctctagtgatcgtagaagacaagatcaagtattccatacctgatacagggacaaagacgctgattattcttctcttcagcatccggcctggagcacacaagttgattttctgttctgtggtccttggccagcagcgctccaatcgctactgccaaacgggaaccaccggtccatctcaccaacaaaaagaaacacgaagcaaacgcataagcatgcttacaatcttattcttggaccacagctgcgttcacttgttaaacatttattagtcgaacaagaggaaatatgcataccctgatacccatgagaagccagaccagtgttgacttcctctgcaattaaatagatttctgagcatggaaaatcttgattactaacaccgactgtatatctgaagagtcaccgtttgtgtgtcataagaacagtacgtttttctgtcataagaacagtacatataacatgagaacttcacatgtaactgtattagtttcatttatctgcacagtagatggcatcagctttagaaccacagacgcaagtatcttcagaagccttccatattaaactgatgcaagatgttaatgtcatgctaaatattgcactggagaatcaaaacaacagaaacagacaacagttagatctttaaaaaagacgatggagggaagggtggccctgatggtaacgcagactgaaaacagtcaagtggtcagctgcaaccccaggttatggattaggctggaatcttgctcgtatccccttccaccactcattccaagccaccactcgttcatctcagcccgagctgggccaccacagaaagcaagccctttcctccatccacaaaacaatgctcacttcattccacaaacacctatggccaccgcttctcattcaccttcctcctctcctcccccttaatctcatctttttcttctcggtgcttctctgctcaaacctgtactttgcttctgccactccatgtctcaatcttcccctttcttctccgttgcccgagcacatgctggagcaggagggcgagctgcggctgccgctctcctgctccgtcaccctgttgctcagctgccacctcggattcatggcctgaggtactacccttcagccattgtgtcacctgccaagacactgaactcacacctgagccttccccatgccacaatatcctcctttgccaatgctgataatggctccagcgggcaagcagatgcc

SEQ ID NO: 51196 - DNA, 1501 bp, Oryza sativa
ttcaattacttttaaagaatatgaaatgagaaattcttggaagacaataaagaaaaataataagcaaatggaagaagttcaagtaaattactcttctgtattaattcaaacaaatcaggttgatttgaaattttatcgtaaggctgcgtttgttctagcatttggattgggattttcagcggcacgagaagcaagacaagccgcaaatgatcaaccgaatattaattattacaaacttaaaaattggatttatttattttttaaaagatacttttttatatacctttttttgaaaaaaagaatatcattaagcagttcgggaaatgtgctcacgtagaacaagaaagttgccggtccaatgcaccttagactcagcctagtatattaactgaggtactacttgacagattaattcttgtttttactatatgcttttaacatctatttttggaataacagttggctgccttaggatataagccactagtagttttccttaggatgtatgccactcctagtttttcttagaatgtaagccactcctagtttcttaggatgtaagccactagcctataccttatggtgtaagccactagcctatatatatgtatccaaccagccatagttgattgagtggagaatagaaattaaactagtcccaaaacctgtattccttttgctaacaattggtatcagagcaaggtttatctgagttccatcgattccccatccaaaatgtctctccactccattcgttccccctctctctcgtcccatgcctcaagcacttccagtggacgaggcagcaggcggtcggcggctgacgctgagggcgacggcgatgcgactgctgctgcgcgggtcgcgcaggaggcgcaagcggctgcgcgggaagcacgcgcggcgtgtgaggaagcggaggcgcggctgcaggcagccacaagggcggcgcgtctcgcggcggcagaagctgaagcagcgcgcaccgcggaggcagccaggcaggctgcagctgctgctgctgttttgcgagctgaggaggaggaggagtggcgtgacctggagcgggcagacgcggcccgcgtgcgacgcgacgcggaccgggatcgacacgcaggtcgacgcgaccgcgacttcagcccccatcgcggaggagcagatctccaccgcggtgaggaggagcggcgcgatccatggcgcgatcctcggatagaccgcgccctggaggcccagcgactccgggagcaggcagcggcgattgaggcacaactggacttcgaccgggagcagggtggacgggacgttggcgcacggagccctcgcaggcagcgcgcctccccttccccggacaggcgccgtggtcgccgtggaccctccggctctcctcccgttgtgcagaccgtcgtcaaggatgttggcggcgcatggcccatgctcaccaagactaactacgtcgagtgggcgatggtgatgaaggtgaaattgcaggcgcgccacatgt

SEQ ID NO: 51197 - DNA, 1501 bp, Oryza sativa
tgtaggcgtcttttctcgttgttcataccggtaggctgaaagcaaagtagatctatcaagctgagcaggtgggcctcttgacaaggggctcacatctttgggtgtagatccagtggctacccttgttgtcactgaagaaggcactttctgattctctggtgtaacctcatcatcactatctgtttcatccatgtcatcgtcattttcaggagctgaaacattctccttttctgttaaacacatgtcttcatcagacccatcgatggctgggtccatttccttcccaggatcttcaacgctgttgatggagaaactgcattgttgagggcagtacagattctcaataccttcccgtaaagatagcaaaatggcatgctcagatgagaagaaaatttttctcttatcaggcgcaacattcacatcataagatgtggttggaatacagaaattcaatacagccacagggtattgcttggcatttgagcttctgtacagctcattgacaagtttggaaacctttggcatatccacaggtctgccattaacatagaagaactgtctatcccctgaattgcgaccactaccaggtccaggtttggaaagaaagccatcaacttggcagccttctgagattgtcacattgaagggctgcaggcacttgaaagtgttcagaccaaatacggtaatgatattatctttcagtgaactgctcccttgagtcctaagcaccgccgatttagaattcttgccaacagtatttgtgcaaactaatctgacccctttggcaatcaacgcataggcctaattagggaaagaaaaaaaataaatcacagttcttagcagaaccagaacgaaacatgtgtagagtaaaacagcagagtggtataaacatgtgtatcaggagatgaactagattctaataacatacatgagctttacgcaaattgaaatgcccgcaaaacgaacatggactaataagatgggcagctcacattcagcaaggagatcactttcccgtactccttccgaatgttcctgctgaactccttgctccggaccggcagcgtggagaacagcttctcgacggtcacggcggtcccgaccggccgcgccatcttcctctcgccggtcaccacgcccgagtgcgcgaactccaggcgcgtcccgacgggctcgtccttggtcctcgtctcgaccgtcagcttccccagcgcgcagagcgagctgagcgcctccccgcggaacccgaaggtggcgacggaggcgaggtcgccgaagtccgagatcttggaggtgtggtgcttcagagcgagcgcctgagaagcgcacatggcggtcagcaactaaatcgcgagagcgaagcagcaaatgggagaggagaagaggggggattcgtgcctggaaattggtgggggagatgccggtgccgttgtcggcgacggtgaaggagtcctcgccgtaggagcggagggtgacctcgacggtggtggcgccggcgtcg

SEQ ID NO: 51198 - DNA, 1501 bp, Oryza sativa
gcctcaccatgaaacgacattcggaggaacagagcaagcatgcatgttgctaagcattcgtgtgtgtactaagccgcatgcagcttgcagtgcttcatcacttcgatgcatgcgcgtatcacagtttgtcgttcgtatgtgacgacacagcatatactccggagtagtatattagaccaataatgcatcaaatgtaaaattccggatccctgtcaacttagaaattgtcaggcgttaagagctaagacagcatatgcaaaatttgaaaattcaaataatccattcgattaaaaagatgaaaagcaaattgatctccactgtagtagcagccacaccgtaccacaccacgacacatcaatcacaatgtgtgggggcagtgggagacatctcagttcggaatagaagacgactcgatcgcaagtactctctccgttcaaaaaaaaaaaaagataaacactagtttccgtgtccaacgttttaacgtccatcttatttagaaaaattatgaaaaaaattaaaaagataagtcacgtataaagtattaatcatgttttatcatctaacaacaatgaaaatactaattataaaaaaaattatataagacggacagtcaaacgttggcacggaaatccaggatttgtcttttttttttggacggagggagtaggcaagctgctgattatcatcgatccgcccaccgtcatctcggagtgcgccactgccagagtttagtccccacatcggtttccggcgcggaatgcgcgcccgataaagccgcggccatcccccggtagcgcaggcttgtccaacgacggttgaattggagggcaggagagttggcgagtgacagtgtttaggcatggtgcgcgcccaccgtgatggtacacaccgtgatgtctgttcaggtcgtcggcgattaagttcgtttgcgctcttgtcctcgacgtataccacggtctccggtcgagcctatggtcggctaggtcttttcatatagaggaggtcccaatgtaacctaccctcctcgccaactctcttttttttcttacttctagttactaagcaaaattttccatgatcaaccgtttaactggattctgtttgctcagatgagttacttcgctcactactactcatcaattgagtaagtcagaggctcaaatggacaaaaacagagccaaattatgattaactttaagtattgttcatgtattattaatcaacaaattaacttttgtaatgcaagtatattttaatattttaattgatgcagtgcatcaaacaaagtaaacacccgctcccgtttgaacatatactgtaagtaaacctctcaattgtagtactcccgtatgtgactgcatgatggtacacaccgtggtaaaggtgattattactgcatcatgcggctaatcgcgcgagggcttcgccggcgtgctccccggtggactgcctgagccgccggtagtcgtcgtagccgaaatccctgaaccggcgcggccgc

SEQ ID NO: 51199 - DNA, 1501 bp, Oryza sativa
tacaaagggtgttgattgatgggggaagctcggcggatgtgcttttttttacagtaaatctaattggagaggcctctccaattagtcttaaccagagacacccatgtgctagtactttaggagttttggttgctattaatccattgagcaagtaggggaaatattcctatcatctatgcttcaaataaaattttctcttaaattactcatccgatttacaatccgattacaccgttgtgttcgtaataattaaatctttacaacaagatctcacatgattatattttgatgaaaaatcataaattacttttatgatatgtctaaattacttttagatttcattaagttacttcttagacatataaaagtaaattcaataaagcctaaaagtaatttacatatattatagaagtaacttgtaacaaaaagaaagtaactttaattaatgccttttttcattgaacaaattatcatattatcactaagtaaatttgtttggtgctccatggtgcccgggctccatgatcatccaccgtctagctgctttaggattcgtgcaaaccaaaaaatgggtattaatcaaattagcgggtttaacccgttaagaaatattagcatctgaaccattccatatttcatttgcttgcatgcgttttctaaacgtagtattgaacgtgattataattacgttgagaagactaggaatatgcccgtgctaaacgctacggtgcaattcaatttgtcacacaaggcacacgttgaccgcagcccattgagaacatagcataagggcgtgaatataaatccaaataacagtttgatatgatataaatatcaaagtaatagtttcatgatgtatataacaattgttggtcatcgcgttaacgtcttcttcaatatctacatggagcgactactaaaatttaccaatggcaaagtacatatttagacacaagtgttaacatatagtatgaaacagagcagaccatgagattgatgtggcagaactatatgctcaagtggaacttaagtgtgcatgttgtgctgctgaatataaatttgtcgagagcctagtgaaaaaaaaaatcatagtatttatgtaagatgacaatgttatccatgcccattaagacatcaacaagcaacatatatttttacagagcactaaataattttatttacacactgtcaatcatgccatgtaaaagccaacaagatggtaagatcacccaaatccacatcacatacttcctaacatcaaacacacatcgcatacaattttttccatgatgtttatgtagtcatcaggaatgaggccaatccaatttggagaaagttctgtgcgactgatctagttgcagtacctatatcaattttgttcaccaatgtaactggaaagaaattggtacagctagtgatccctcaaatagcttcacttgtgtctgatatgagccgacagtacgagtaaggatataaaacagttattagtaaaacgtgatgg

SEQ ID NO: 51200 - DNA, 1501 bp, Oryza sativa
tggccaaaagggtgaagtgaagtaaaatatcgatcaaaagtgtatcacagttgtgtacgtacatgctcattttccattcactgggactaggaggcactgggaatcaaagaatcacacaaaccaacctgaccgcctacaagaacttctgtgttggtgaagaactgctcagacactttgcgtgctgtccaggagccggtccagtggcgcagtgatcatgatgatcgtttggtgtggatggatcggcggatggctccggagagaggtactcgccgttggagttgtgtggcttgtgtccatggagcgagggagctcgcgatcgatcgacaggcgcttgcttcttcacttgtggttgtggacacaatgtataggccttttgtgtctcctgtacgttggccttcttcctcgtatcttctcgttatcttaagaaatatttgtcgctgatgcatatggtattgtatgctctcttcgtatggaagaattagagagtagtagtaaatctgaaacacataacatatgaatgtgtgtatctgagttttggatgtgttgagcacgttgatcagggctgatcagtctatatgtttgggtaaatatacatactgctcttcggcggacgatatgcaagtgctaagagctaggctaagaagtagagttaatatgaggatattgcacaggtggaagacgaagctttgcccagcatcatgatcagcaagccatttcgagttacattggagctcgatcgattgctctgaagaggatgcgttctaaagatggccaaatgggccgcctgatacgggcttgggctgaggtcagtcggaccggcacggcccgacctacatgctagaccatgtcgtgccagcccacgggctgcatacacggcccagtaagactcgggacgtgccgggctggcctgaaggcacaacagctatcattcttctccacagaataagtctactttttccctaaactctataggttgtgtccatatgactgaaaaataagtctattttgtatttctcatgtttttgggccttgcctcatatggttaattaagtgtattttacgtgcctctactatttttcttgatcgtgccgtgccgtgccggcccaccgtgccgagagagcagcccaagcgcggcctggctgtcgggctgggccggcacgagcatgaccccaatcgggccgtgctgtgcttgggccggaccaaattgacgtgacttgggctgggccgtgggactcgggccatatggctatctatacacgaagctgccttgaccagaacggggggcttactagtcacgttggttctgaaagtctgagaattaagtactggacagtagtacagcactagcttctcaatccttattatcttttttttttcgtagagcttttgtttaatccttttggcatgacacagctattaatctgtaatcagtaatggtacctaaaagatctcaagatcaaagtcttcacttaattaaatgcatatcgaccaacactggctc

SEQ ID NO: 51201 - DNA, 1501 bp, Oryza sativa
ctggaagagaagaggaagatgacgggaggaagaagaagaaaaagaaaaaaaaaagaaaggctgacaggtgggcccatgaacagtacattttcgtattttctagatttaattcaaaacccaatctttagaagcccatatctcctaaaccgtagatccgattccagtgaaacttggacctaaattcatctaaattcaaaccctatcttttgaccccaaatttgctattttaatattttcaaataccgtttgaatttatatttgccttttcaaatattttcttttatctcaaataacccctttagccactaaaaagccgccggttggaactttacgccttccatggggacattcacggtttactatccccgacgtcggaccgttggttgtaaagcccggcaaaaccaaacctaaggtcgaagtgctgctcctggcaccccacgcctcgatgcgtatagtggtcggagcttcactatttcctcaacctccacagcacgccacacagttagctcttgggctctgtgtgatcctagccgctctgccgccactcacggttgtcggagtaacacttctgccccactaaacccacacaaacctcctatccctctagctgttatgctgtctgttgacaccggctagagaagataccaattctagtcgttatactgtccaactctagcaacgactagcaaacacccaaatcccagccgatattcatcctacctcgatatcggcttaatcaaatgaaaccccagccagcctgctgtccaaattccataccaaccatttacccttctactacccatagcctatgcatgaaatacgagatgatatgctatcctatttcagcatcgactcgagaacaactaaatcctaaccattcttctaccaaagcccaacctcgaccaatgctagccacataaccacttaaccagttagactattcgttaaacccacacatgaaatataagtgacaaatgttgcttaatctcctctagcctccaaccctttagaacctacacatgaaatgttagcccaataattcctataccctataaaggagatagcttataccctaaaccctagctctcttagccgcttatcgatcttttgttattttatggcttttattgaatttggctcttcctcttcttcagtagagtttattttattttggatggcaacctgtggtatttcaaggatcggataatcaggttgcctaccttggatttattcgcgttggagcaaggcaagttattattcctcccctttgagcataattatcctatattcttatatctctattctatgcattagtcatacatgattttgaatgcataacctgaacatagcaaaccagatatgctagctttgcttagccctgcctagttagtctgcataaaaatataatgaacttagattgggacagtacgtaggaattggttgatttccgggtggctagtactgtctcagtcgatatagttattaccaagtacttatgtca

SEQ ID NO: 51202 - DNA, 1501 bp, Oryza sativa
tcagatgatgcaagttgattccatagaaatttagaattccccggaaaaatcttgaggttagaagggagaaaccgccacagaagaaatgagcaaataccacgatttcatgcgtattgggggttgggaatgcttcgccgaatgccggtcgccacccgatgatctccttcgtcggaagaacgccgtgtgccaccatctccttcagattatcttccgtcacatcggagggcgcccactgactctcgaagctttctctttcttccgccatgaatgtgaactggatggtttaatttggtccgagatatggctggaaaaggatgaggaatcggagcagtggacgcggggagaaatttcgtgaagtttttgaggatggattggagcagatcgatgaaccctagctccgacggtgcggtttgctactgtagcgaggagtggggaaatgtcgagagtctcggcggggaagacgaagcgacgcttggactttggtgctttgttagggtatcgggagtactaatgggcctaggcctgtacagtacttcagcccaatattataatcagcgtggcccgttgtgatccctagggacttaggcgctttttgctttggcaatttgtcctcacaatgatgtggctcgatgctgctaaaatcctttttaacgcgattcaataattctttggaattattatgatgcacataaaaaggtgcccgacagaaaggtgttataccgtttttgtaagctttcttaggctgcaaaagctgtttgggtcgatttaagatgactggtttattaatagtcattcttttagcatgttatatgcttatcttggttatggtaagagtcatagcctaggctattaaactcgtgaattaccatgattccttttatcatgcttggtggatcattttaagagtttcttactcggattcctatcaaatatgtctatttttggaccttttgagtgtttatcactcggccctttttgtattttttatccttgatatgttcaagttgagaagcagtcggctgggtattttactgactaccacgcggcgtgcttcgctataaaaccacttggttcttgactacatgtttagtttttcaactaaccacatagtcgggggctacacctaattaggtgcatctactcgatgcaccatgttttattttcgcccttcacagtctttgattttagcactcggcaggctggagcaggttgaattgaagcactcggattattgttttttgttctgagatggctatttcgtcgactgcaaaggtctcgggggctactgtggagattatggataccccatatctacatgacagttataatttaatcggatatacggtaccaaatatagatataatatctttatgaggactcgggttagtttttaacttgtatgtcaaggaaatacctgagatcttagtcggttacgattgtattttatttgtaattacatattccgttagggatatggactgtactatgtaaagcggactcc

SEQ ID NO: 51203 - DNA, 248 bp, Oryza sativa
agttcctctgtttttctactctgaaacttcagactactaagtgagggagtgtgagtgaatctgtgagattgatcttggcgttttgcggacaaaataaaatcgcaccgtagcgtttagcacgtgcatattagtgtttacctgatggcactctctgtatacccctgtggaattgtaaagcacgagaataaagaactgttgtctgaagatacaagtggtcgtctaaagttggggattagaagaaacaacaa

SEQ ID NO: 51204 - DNA, 1501 bp, Oryza sativa
ctctatcacctgggccttgtgtagccgaccattccaagtcctacactcggactcaaatcactcaattgtcctttcctttgcagacattgatccttcctatggccggctgatttggaaaagcaaagtacccggacattgtgaattgtttgtgtggctcatccaatcaagcgatttcaccaatgtttaaacggccgttgtatgtgtaatctttgtacatcatgtatacttaactagacgtcatgtaatttgccttagaaagtaacaaagccttctctaaataactatttcctctggtcagaaagtggtgtttcgaaatgtgtgtaattaacgttattaaactttgacacttaagttctctttgaatatttcaactgaatatttgaaagtgatatggttagagttgtcttaaaatagttcaaaatatgtagagtaaatttcataaattccacctattattatggtccaagttacacaaaatcacagggattttgacatgtggcatataaacccaggtattttgtactaaagcttcacaaaactacatcgttaactattttgatatattcctatttgaaaatttcaaaaaaagtaatatttatatgatggataaaatatttataaatttgagatgtgattgtagaactcaaaagtatagtagatcaaaatcaaaatgatcaatgatcaatagtatggttttgtaaaactttaggatcataatatctggggttatatgtcacatatcaaaatccatgtggtttgtgtagcttgaaccataatatgtgaggttttatgaaatttactcaaatatgtattatacatttcatttaggttttatattagtaattatagtaattaaacatgtggattggcaactgtgtcgcggtctatgcgagggggtatgcttttacagtagggtagaagactacttcgaatgaatacaactcagaatgaaactcagaatgaagactactctaggttcttatattttggaacgaagggagtattaggttagaaattctgtgactcattacgtgttacagcaaccatgatgacaaaagcagggcaacattgtaccgtagatttacatggaaaccgtcaattttacctcaaactagctagctaagactgagaagattgttatgcgaacaaacgcacacaagcttaccgcgcgtatatgacatcctttctcttttcgttacaaccgtatttgcttttccgactatcctaacattttacgtgcaacatatcttgtcaggagttgagagcctacacgtttatgtgtcgtagcttgtttggctgagttggctcaattactagtttggatcaccttaagacaagaatacatatacttttttattatttaattcaagaattagttttaagatatttttgaaaattcaagtatcattttattcttgtacaaagtttttgaatataaagtttttattcgtgatgaaagtttattaacataaagttatacaatttagattttatatggtga

SEQ ID NO: 51205 - DNA, 1501 bp, Oryza sativa
tctttttttttacttccgatttttctgtaaattgtatttctatatagactttatactcttcttccaatattatttatttttatttctgaattttcaaattatattttatatacgtgttagttattaattatttttaatatcaaattttagttatttgtaaattatgtatattcctatatggactctagactcgtcttttaatatttctttttttaaaattccgaattttctatagattgtatttttatatagactctatgctcttcttccaatattatttatttttatttctgaatttttattatttctaattgtatttctatgtggactctaaactcatctttctatattctttaatttttaatttcgaatttcaattacttctaaattgtattcctatatttatattcctatattgaccttaaactcttattcccatgtttttcttaattttgaattttagttatttgtaaattgtatttttatacggactctaaacactacttttaattttattatatttattctaaattttagtaagttttaaattcctatatggactctatactctacttctaatattccttattttttagttctgaatttatatttttttcttaattgtgtttctatatagactctatactctacttctaatattccttatttttaattccgaatttcagttatttcctaattgtatttctatatggactctatactcctcttctaatattccttatttttaattccgaatttcagttatttcctttttctattcctttaattataaaatagatttgctaggtaaactatctttaactattgtagaaagtttgtgtataaagatttttctcctgtagaaagtttgtaaatatattttttattcatgtagaaaagcttatgagcagaatttttattcattttgaatagactttaataggaatggaaaagtttaataatctagtaactatttgataaagttttgctatctaatattctcttcatttgtgtttaatagacatattagctctgaaaaagttttctattttgatcatcatctttttcttttgccacacattcttgggtttggatgctgtcgttgctttgttttagtcatgcatgcacgcagtaggtcttgtgaatcgaatgttcacccattccaatcatatgcagccacgtctcccgtacaaatgcaactacttgtggattcccctatgcaccaatgtcccgtgtattgagttgcgtttttcttggtcactgcgttagactcaaataggtcaatcatacatgaatagaaggtgtagaacattcttctagaaaacatgagaccctaattcaattcacatgttaaccccgggtgtgtttagttcacgtcaaaattaaaagtttgattgaaattgaaacgatgtgatggaaaagttgaaagtttgtgtgtgtaggaaagttttgatgtgatgaaaaaattgaaagtttgaagaaaaagtttgaaactaaactc

SEQ ID NO: 51206 - DNA, 1501 bp, Oryza sativa
ggcgcctgtccggggaaggggaggcgcgctgcctgcgagggctccgtgcgccaacgtcccgtccaccctgctcccggtcgaagtccagttgtgcctcaatcgccgctgcctgctcccggagtcgctgggcctccagggcgcggtctatccgaggatcgcgccatggatcgcgccgctcctcctcaccgcggtggagatctgctcctccgcgatgggggctgaagtcgcggtcgcgtcgacctgcgtgtcgatcccggtccgcgtcgcgtcgcacgcgggccgcgtctgcccgctccaggtcacgccactcctcctcctcctcagctcgcaaaacagcagcagcagctgcagcctgcctggctgcctccgcggtgcgcgctgcttcagcttctgccgccgcgagacgcgccgcccttgtggctgcctgcagccgcgcctccgcttcctcacacgccgcgcgtgcttcccgcgcagccgcttgcgcctcctgcgcgacccgcgcagcagcagtcgcatcgccgtcgccctcagcgtcagccgccgaccgcctgctgcctcgtccactggaagtgcttgaggcatgggacgagagagagggggaacgaatggagtggagagacattttggatggggaatcgatggaactcagataaaccttgctctgataccaattgttagcaaaaggaatacaggttttgggactagtttaatttctattctccactcaatcaactatggctggttggatacatatatataggctagtggcttacaccataaggtataggctagtggcttacatcctaagaaactaggagtggcttacattctaagaaaaactaggagtggcatacatcctaaggaaaactactagtggcttatatcctaaggcagccaactgttattccaaaaatagatgttaaaagcatatagtaaaaacaagaattaatctgtcaagtagtacctcagttaatatactaggctgagtctaaggtgcattggaccggcaactttcttgttctacgtgagcacatttcccgaactgcttaatgatattctttttttcaaaaaaaggtatataaaaaagtatcttttaaaaaataaataaatccaatttttaagtttgtaataattaatattcggttgatcatttgcggcttgtcttgcttctcgtgccgctgaaaatcccaatccaaatgctagaacaaacgcagccttacgataaaatttcaaatcaacctgatttgtttgaattaatacagaagagtaatttacttgaacttcttccatttgcttattatttttctttattgtcttccaagaatttctcatttcatattctttaaaagtaattgaaattgtgttctttaggcttagtaatgcttcatgttgcacctaaaagctgatgcccagaatttttcgtatggttgcacctaaatgctgatttgacttaattttgtttgtttttgaaaaaacttaattttgtttgttatactgtagg

SEQ ID NO: 51207 - DNA, 1501 bp, Oryza sativa
gaaactttatcctctccttacggtggattcgaacggggcctaagtggatattgtattttagtactcacgatgccctgcagtaaattgccacactttttagatatcattagacaaattttcccaaaatggcaagcaatataatgtgtatgaaactagttattacaaagataatataaggtgtatgaggaccaaagtacaagatatagtcatccgtttaactaagagctttagtatatatcttctcaaagaaagtccaaacatcggtagatatagtatatactccgtattaacgtcccgaacaacaaaacaactttgcagtctctgaaaaaaaaggtacaactataaaaatatttgctcataaacgacaatgcatgagtaaaattgcaacgtcgttcttttcctcctcataaaaaaaaaagagaaaaagaatcaacgttcacgcccttcaattttgtccggctttgcaaaactttttgcagccctcgccaacgcaattcgtacaaaccggaagggggtgggtgtgacagcgcagaggccaccgaatccaacgcgaaaacggcacgtttctgccttggacggcggccgcgcggtcaaacctcggcctccccctccacgcagctccacctgacccggcggcgactcgtgagtcgtgacacccccccccccccctcgcggaagtggctcggcaggtggcgaggccacggcggcatagttggattcgccacgtcatgttaaaggaaaaactttagtcaaattatacataggtatcacatcactcaaataagatgataataatatggaagaatctcatttacacttgttttgtaagttagaagatccgttgtactcccttcgttctaaaaaaagaacctacgatgtgacatagttttgcggagagagtatctggttttcctgtttaagaatgaaaattggatttaagggctatttactttggtgctaaaataaaccatactaaattttgacaataccaagactttggtaaggttagcaatattgtcaaattttggcaagatggctattttggatgcgttcattttgttgccaacatacatgctactcacacatattgctgtgcagttgctaaattttagttattactgtgcagttgccaaatttctgatatatttatcaaaagttagtaagaaactaaacatatgcaacttaaaaaaaaatggtatgatttaaaatgacatcaaagtgaaagttaagggatctcaaatgagcttattcccgttccggtttggttggcgtagcgaatttgtcggccgttcgacgagcagctggctgggccggctcactcacaccagccgcatcgaggcccaactgagaggctaatgggcctcggccctcgggacggtttgcctccggctccggctgcggatggccaccaccaccaccaccatcatcatcggtgcccgccgcggaagaggaggagaaagggaaaaaccccgcgctgtgtagggttttaggcgggtcgagg

SEQ ID NO: 51208 - DNA, 1501 bp, Oryza sativa
gattcaactataacaaatcatttaccctcatgttgcacgactgcacgtgtagttcatatgtttattttgttatcttcgtcagatccgtgcactagagaagcggaagaaggccggcaagtatgccaagaaggtcaaggctaaggtgaggaggaagatgcacgagatggagaacactctggagcctgatgaatttgctgaactttggaaaggggaggactagttcagctatagtgattgaaccatcaacccccgttaaactagttgctctcgctgtcacccgacacgagttttgtttactatatctcgtggaatttcttgtatgacaccatgagtctattatttacatgaataagattttagtgtcctatcctaactccatctcgtctcgtgcttaaaagtataattcgcattagtagacttatatgtgcttattgcttgttacgtttttttgttaccactgttttaccatgtttttggcacaatacaatttgaagggcctgtttgggggagcttaaaattctgagaagcagctgtcagcttctggcttcttagttcatttttcagaatttgtaactatagattctcagaagctatggattgtttggggcagcttttggaaaaagctacagctgggacaagctccactaaacagggccaaaaacgaggacccgatgtgagcaagcttataggaaggggaaaaaagagtcactttccatcgtttggcgctctgctcataagtcagttctaaagtttaaattttaaaacttaattttgaagttgattataggtttattttttatgttggtttttaaactgcaataacacaaacataaagtttaccaacaaatcttttttcttctgttgcttatatgtcgttttatgccctatcagacaagatcatgcaaccgaaagtaagtaccaaggatagccgtgaggtaatcaaaaaagatttgaaattactttttgtcaaaataacgagggggaaaacatctacccgtaaaaatctgtctagagcaaacgcttcgctcttattatgggctgtgaacttagcaaaacaaaacggacggattagtttcatgtgcgtccctgatatatgtctgagtttcatttgcatccctcaatcatataataaaaacgtttattttacattagttttacgagttggagtatactctatatctggttttgcatccctcaaccgtaaaccaaatatagattacgtccattttgtacttagttttacaagttggaggcatacccagttttgcggttaagggtcaagcaatcaatactttttgagggatgttaagtggactttttttccacggccgaaacataccgcgtgcatacgtgctgcgttaaacgagcccaagaccaaaatccaggagagcccaagaagctagggtttccgcctccacgccgccgcacgtatataaacctgcgaccaaaccctcccctccattctccttcccaccccaccgccgcctccaccctctctctc

SEQ ID NO: 51209 - DNA, 1501 bp, Oryza sativa
tttcagtctcggcctagcccactacccctctacttagcctgtgtcgaaacaagatttcggcaataataaaaggggtggctatcaagctagaaaagtggatgggtttggagacaaagaattttatacaggttcaggccttcttattcaagaagtaataccctactcctgtccggggatgattccgccgtgtgtgttattgattgtataaactgggaaaaagaatcgtgccccgagaggcacacggaccctccttatataggggaaggagtccgctttacatagtacagtccatatccctaacggaatatgtaattacaaataaaatacaatcgtaaccgactaagatctcaggtatttccttgacatacaagttaaaaactaacccgagtcctcataaagatattatatctatatttggtaccgtatatccgattaaattataactgtcatgtagatatggggtatccataatctccacagtagcccccgagacctttgcagtcgacgaaatagccatctcagaacaaaaaacaataatccgagtgcttcaattcaacctgctccagcctgccgagtgctaaaatcaaagactgtgaagggcgaaaataaaacatggtgcatcgagtagatgcacctaattaggtgtagcccccgactatgtggttagttgaaaaactaaacatgtagtcaagaaccaagtggttttatagcgaagcacgccgcgtggtagtcagtaaaatacccagccgactgcttctcaacttgaacatatcaaggataaaaaatacaaaaagggccgagtgataaacactcaaaaggtccaaaaatagacatatttgataggaatccgagtaagaaactcttaaaatgatccaccaagcatgataaaaggaatcatggtaattcacgagtttaatagcctaggctatgactcttaccataaccaagataagcatataacatgctaaaagaatgactattaataaaccagtcatcttaaatcgacccaaacagcttttgcagcctaagaaagcttacaaaaacggtataacacctttctgtcgggcacctttttatgtgcatcataataattccaaagaattattgaatcgcgttaaaaaggattttagcagcatcgagccacatcattgtgaggacaaattgccaaagcaaaaagcgcctaagtccctagggatcacaacgggccacgctgattataatattgggctgaagtactgtacaggcctaggcccattagtactcccgataccctaacaaagcaccaaagtccaagcgtcgcttcgtcttccccgccgagactctcgacatttccccactcctcgctacagtagcaaaccgcaccgtcggagctagggttcatcgatctgctccaatccatcctcaaaaacttcacgaaatttctccccgcgtccactgctccgattcctcatccttttccagccatatctcggaccaaattaaaccatccagttcacattca

SEQ ID NO: 51210 - DNA, 1501 bp, Oryza sativa
ctgttatttcactgaacttctcagaaaattaatcagtattttatctgattactggtcacttaaaatgacggataggcatatcaaaacagataaagaaaaaaacaaaaaaaacaccatttgttcagaagaaagtccctcgttgcttcttactaacaaaattcagcgattttgttgcagtgacagaaaagatgcccaattataaccagcagtagccagaagacacttaatttgctagactgcaactattgctagtaatattcacaataggtaaccaagacatcctcaactcaagcctaatcacaatttcagaatcatgtgcacaacatttagcattaccatatcaccgtgaacatatcatgcatcaaatataacctaacctgaacacaacaatatattgacacaaatcctcaagaacataccatgcataaaaacctaaagtattaaaacatgatattagcacaaaatgaccacacaattttacaggattcagagaacatccaccacaaagcccatgggaactgttcatcaccttgacgactgatgtgatatcatggagtgggctacacgacatataatgcaaatttgtcatgaattatgatgattcatgttataacagaccgaattccccaagtgtgtacaaccaaacaagtacaacaaattagacatgtcatagttgattactcacatcagaagagcattcaaagtttaagcctgttatttcactgaacttccctgaaattttgcatagtatgtcatctaattactgatcacctaaaataagatagacagatcgaagaagatacaaaaaagagcgaagaagcatcggttggtgaagtccctcattgctaattcatttatagtctgatatgattttgcaagtataaaaaggtactaattgattatagtatcaagcaattgtgttcctcattttagtgattgaaatgcttactaacaaaattcagggactttgttgcgataagcagaaagaaatgcatatttatcatcagtagtagtcgaaggacaccttaatttcctagactgctactcttgctagtgatattcactatctgtaaagaattcaacctcgaacacaagaccaccacaattccagaatcacgagcacaccaatcttagcactatcatatcttcaagaacataccattcaccaattataccctacctaaacatgataactgacacaaatcctcaagaacacaccatgcatcaaaataataaaaacctgaagtcctacacatgatatcagcacacaaaaaacgaccacaccaatttcacaggattcagagcacatccaacccaccacacagcctacgggaatggttcatcaccttgacgactgacgtgatgtcgcggagtgggctcctcgggtaccactcgggcagggggctcctcctcttgggtgtagccctcacggtcacagcccaggacggcggcacgttctccttgttgctcgtcggcggcagggcccgccgagccagcggct

SEQ ID NO: 51211 - DNA, 1501 bp, Oryza sativa
atagcatcttcggctttggcatactcattggctttttcaaacatctgcttgaccgtcttgggaggtttgcgtccgaacttgccgactaggtcctcgtggcgaatgcctttagtaaaggaggcaatgatgacgtcgtcggtgatgtcggagatcttgttgcgttgctcagagaagcgtcgaatgtaatctcgaagagactctccagacttctgaatgatgttgtagagatcgaagtgtgtaccaggccgttcaaaagtgccttggaagttggctatgaagtggtcgcgtagctctgcccatgatccgatcgtgccgcggggtagctcgtggagccatgaccgggcagaatccgctagggccacaggtagataattcgccatggctttgctgtctcctcctgctgcgctgattgcgagaccatagacggtgagccaagactgagggttggtggtgccgtcatatttctcgattccagtcggcttaaagccagctggccaatccactcgatgcaaatcacttgtgaaggcagcaactccgtccacatcgtcgtcgtagcgatccggtgaatgatggcctcttgctgcgcggtgctggttgatggtgtcgcgaagatcgatggggcgccttcgatgtggggagtatggtcgttcaactcgacgctccctatatcgttcgggaggcgaacgaacagaccgttcatcatgtcccctgcttctgcgactagatccggcgccggcaatgctgaggcttggctggtgatagtcttgagatcgaagatgagggactcggctaccaatcggggtgcaggtgcttgcggagttggctgggaccgaggcagcgattatagtcttcgtctggttcaagattttgacaacatgatcagcttggttaagtgcgtcttccttgaggagggtgtcgaggagagtgattgctgcaaccgcgttctgctgggggtgcgaaagaccgctgttccatcgatgtcttgttgctcaatgagctctctcgctcgtcgccctgattccaaggcgcgttgccgtcgatcttcagcctcctttgcaatccgttcgcgatcttgttgctcacgctgtagtcgttctcgcccctgtcactgtcgctcttcctccagtcggcgacgttcagcttcttgccgtgcgcaatcttggtccgcttctcgggctcggcgctgttcctccgtttcgttgtcagccatgaatacgccgaagaagaggggcgtgtagttatcctcgaagctgtcgtcgaagttgtcgaggtcgctgtggtcgtagtggtagccgaagtcatcgtagttgaggacctcggttggttgagaaccgacgccgggggagctgaggtagccatccaactcttctgtcgagactgtcctaagaggttggagtataacgccaacctccctggatctagattggatcggggccgaagccggagctcgcctagatcttcgagtgggagatgtcttggctgtgaagacagcagccaaatc

SEQ ID NO: 51212 - DNA, 1501 bp, Oryza sativa
ttcttcttcttatagatatggacggactgggacggggttgagcagcaaagcaatggacacagcaggcgccgccgcccaccaccgcaggtagcttgaccttctccccttccgaatcctctcttagatttgtaggaaatctcaaacctaccgtttcctctgaaattaacagcgacataatcttcttcttcttttaccgtttcccctgaaattaacagcgacataatcttcttcttcttcttttactcaagtttctggtggcacctgcattattacgtcattgcaaaagctgcttcttctggataacagtcaccctcttctctaatgaaaatttagaatactttttgcttggatggctggcgagaatttatcttaccatctgtcatgactaaataacaagtgggattgtaactagactatactggtgtttatcaccactaatgccagtgtttgaactcattctcaggaaaattattttattctcattttgtccaagacaaattttgttcacttcattgaacgcatgcatattctagttgtaaacttgggaacgttctagttttcactcagataggaattaggagctatttatccttttcttttcactgtcctttgataacaagttaacaacccatagatcatcccttaccttttcctcattttttttccctgtttggttacaaatgaacagaaatactaactgcgatagcgaactcttaccattgcacttcagctgttcagtgtttacgtaataagtttaagaattatattgataacatctaatctctggaatgcatcatctccaaagattcatagctagacaacttattgtttattatcattgctaaaggaatttcttgcactcttgcatatgcgccatcctgaaccattgctcattgtttctagtcttcataggtagtagcatgccagccagaagagcacacatggaggatgggatctgtccagtaaacaaaaggaggagattggcgctcagcccatgtgctgaagtatataacagcaagcggataagatcacaatgggttgattttcaatctctccctgaggtatgtacgttaaacttaggatcaactctactaaatgtgctttagggactgcctgatgttttgtccacactcatcaccaggacattctgtcaaggataatgtcaaaactaacattgaagcaagctgttcagatgagcatggtatcgagtgtgttcagaagagcttggattttccatcctgatcttctttttggcactgaagaattgtttggaacttctgatcgacagttgagagcgctgagcaccaatgggtttattgacacaatcaattttatcttgaggaaacacagtggtctaggagtgagtgattttggtgtgaagtttgagctgtggaaggagcatgcacgtgacattgatggatgggtttcctttgctattgcatcgaaagcaagggttctcgtcctgaacttttctccatatataggattgcgagaaaacagt

SEQ ID NO: 51213 - DNA, 287 bp, Oryza sativa
cccggaatgtcagtaacagggaatcccgaaaaaaatgcagctatgtgataatttctaacgctaatgttgcagttttctaaaaagtggcgcaaaggttgcagcaaagtgatagtttagtcaataaaagtgcagttttctgaaatttactcttaattatatgcacttgctttagcttgtggggggctattgcatatctgccactagctagtgaagattttgtgcacttggttgtcatgctattgatttgtttgtattgacagaaggtgacatataattttgtgtgcaga

SEQ ID NO: 51214 - DNA, 253 bp, Oryza sativa
atcattgcccctagtgtcgtgaggttgggcatttggtgaatgattgccccggtggtaagcctcctaagacatgcatgtttgattctcattatatgcttaggaaggctcatgatggtagcattgttcctagatatgtgggttcccctatactcggtggtaaaaagaatgacatttgggtgcccaaagctttggtctctaacctccaaggacccaaataagtttgggtacctaaaagagcttgatcttcttttgt

SEQ ID NO: 51215 - DNA, 1501 bp, Oryza sativa
gcagctcactctggtatgagctggcgtacaccgaggcgaaggggaggatcaggaagcgggacaggatctggcagattgcatttggatctggtttcaagtgcaacagcgcagtctggaaggcgctgcaaacagtgaatccagcgaaggagaagaacccctggatggatgagattgacaacttcccggttgaagttccaaagatatcaaaggttggaaatgcatgacatgaaatgccttgtttgtctcaagagtagtaaaaagtatggtgggttgagtggcattgtgcattggcattggtagggcaggaagttcatcttcagggttctaaatccatttgcaattgttcaagagttctttggttttcagttgtagcatctgtgaggggaactttaaaaagaaaactgtagctgattcaattaggtagaaaaagggtgtgttttcttcacttagggctgtctgataatgctgtatttattcagattggagaaaacaattggagtcttcatgtgacgtttattcatcgttgcctgattgtgattgcccttgtagcactgtcacattctcattaaatttatctcattaaattgattggtttaacatgatagtgttgtcttattcttctgttgggtttgcttgggttgttcgtccgagttcgtgtgccactgaatgcgatgtcgccatatgtctgaatgccgtggttgtgcaagcaaacattcaacatcctctctatagatctggacttgctgccagaatgatcaaggccatggagaaatgaatgtcaaaatctgcatttaagcttgtagttaatatgcaagctgtccattactgctatgtaggagtagtagtaattgtagtcttgtgtcaaggatattgaatggtggcatgccatggcacttgtgggatgtttcaagaatactgaaatagttggatgttactatctggtttactgcatcattcagaaacaccaaataccatgacatgtgcatgctcatctacagtgaaaatacaccaaattcacatatgtatctaattatatagccaggctgccaatgcaagtgtgtgctggagcggtcagcacaatgcatctgggctgggtggctggctgctgctgccttctgtagctgcaggaggacatctgcttggctgtaattgccaaactactacgttctccgtcctaaaaggaataaacttcaagggataattattcagatttatcctcagaaatcggtttctttgggtaccgcttctgcagactgaaccaaatggaccattctgaaagtatacttatcatattagcaagtggcaaaacagaagcctttacaataatgaataatcctgtactagcacccacgtgagcctgattgaggcgccgctagcacgcaggaaacaaatccaggctgctatgaccaacctttcttcctcaccacgagttcgttgacagcaaatcattttgcggataaaaaaatgaacacatgaggtttagcaagaaaccaacttggcg

SEQ ID NO: 51216 - DNA, 1501 bp, Oryza sativa
ggaattcgaagttatacctcaactaggtgatgtgtttccacagtgtactatggacctataatatttatattttaaaacggagaaagtataattttcaaactatttgcaacgtgttaatcttatcccctctacctccaaatcttatttatggtatacaccaccacccaaaatttttattagtggtagtacataaaatgagtttttttatgtgtttgtttctgtttttggttccttttgcaacatgaagttttccatgcaaactaagaggtgagacaaacaaatcaaaactacactaccaaaagccataattagatggtccaaatgattttgcttgttacaagactgaagagatgttatgcagtccacaaacaaaaaggaaacaatatattctaatataatataaaaccgtttataccagttatcaattgtttgccaaatccatataaccatataaacgcatttgctacatgctatatcaaagaaggtgaaatttacccatccacaaaatgcaaacaactggaagttgaaactccaaatataagagaaattgagggtgagatttactcatccatgaaacacaaacacaattggaagtcggaattgtaaatagcagaggaatagaaggtgagatttacttgtccataaagatgaaaaaacatatagtgcaaatcacatatataatgaaaacttgtaaactaacattagatctaaaaataaacgcttcagatttatccactgcactcaaagtaaaattttactcccagattcaaccatgagtaatttttttactctcggtgacgtggacaaatcttatgtgtctatttctaaatccaacggtagtttctaagttttcactagatatatatggtttgcactaaataccttgctataaaacataagataactggaagttgagaacgcaagcatgagaggaattgaggggtgagatttactcatccaaataaaaaaaaacaaaatgcaaacacttgggaggttgaaactgcaaaatagcacaaggatttagggcgaattttctccccctcttccagtagtttccaccttttccctctcttcctccgcttattaaaaggcggcgtccctccccgtggtgctcgccgccgtattcaagcggaggaagagagagagagagagagaatcaaggcagtagtcgtcttcctctcctctcgccgccgcatccgaccggagaaagatcccttctttccctcctccaagcccgcctcggtatgtatgtactcgctttgcctcaaaaaaatcccccccttttctccgcccccgcattgcggccgcctggaccttctcttcgattcgcaaatctggtttcttttcgcgatttcgcatctcatctcaattcctagaccctcggagatctcgccatttcgcttctcgcggcgcaaatctgcgatcttttttaaacctcttgtttcttgtttttttcttgttttttgcatcagccagagatggagacctcggcggcggcggc

SEQ ID NO: 51217 - DNA, 1501 bp, Oryza sativa
tcaccgactgctggaagtccggcagccgacgccgctgctgctgctccgccgccgccgcgccgccattgggcgccgccgccgccgaggtctccatctctggctgatgcaaaaaacaagaaaaaaacaagaaacaagaggtttaaaaaagatcgcagatttgcgccgcgagaagcgaaatggcgagatctccgagggtctaggaattgagatgagatgcgaaatcgcgaaaagaaaccagatttgcgaatcgaagagaaggtccaggcggccgcaatgcgggggcggagaaaagggggggatttttttgaggcaaagcgagtacatacataccgaggcgggcttggaggagggaaagaagggatctttctccggtcggatgcggcggcgagaggagaggaagacgactactgccttgattctctctctctctctctcttcctccgcttgaatacggcggcgagcaccacggggagggacgccgccttttaataagcggaggaagagagggaaaaggtggaaactactggaagagggggagaaaattcgccctaaatccttgtgctattttgcagtttcaacctcccaagtgtttgcattttgtttttttttatttggatgagtaaatctcacccctcaattcctctcatgcttgcgttctcaacttccagttatcttatgttttatagcaaggtatttagtgcaaaccatatatatctagtgaaaacttagaaactaccgttggatttagaaatagacacataagatttgtccacgtcaccgagagtaaaaaaattactcatggttgaatctgggagtaaaattttactttgagtgcagtggataaatctgaagcgtttatttttagatctaatgttagtttacaagttttcattatatatgtgatttgcactatatgttttttcatctttatggacaagtaaatctcaccttctattcctctgctatttacaattccgacttccaattgtgtttgtgtttcatggatgagtaaatctcaccctcaatttctcttatatttggagtttcaacttccagttgtttgcattttgtggatgggtaaatttcaccttctttgatatagcatgtagcaaatgcgtttatatggttatatggatttggcaaacaattgataactggtataaacggttttatattatattagaatatattgtttcctttttgtttgtggactgcataacatctcttcagtcttgtaacaagcaaaatcatttggaccatctaattatggcttttggtagtgtagttttgatttgtttgtctcacctcttagtttgcatggaaaacttcatgttgcaaaaggaaccaaaaacagaaacaaacacataaaaaaactcattttatgtactaccactaataaaaattttgggtggtggtgtataccataaataagatttggaggtagaggggataagattaacacgttgcaaatagtttgaaaattatactttctccgttttaa

SEQ ID NO: 51218 - DNA, 1064 bp, Oryza sativa
  unsure (1)..(1064): unsure at all n locations
ttataactgatccgcgatacttttttcgggtggtacacccaccgggcctanaatttattcttagtcccaagttgttacaccacnngggactnaagataagnagggggtttgacacatgcttctcggtgatgtcgttttttatcccggttggtctaaggatgttaccaccgggattaaagataaatgaggggtctgacaccacctgtatttttttttgaaccgggactaaaaatgatgtttactcctggttggtgttaccaacgggtactaaaaatcaaaagtagctctaaccttttgaaccgggactaaagatgttctttagttccggtttttattacaatcgggactattgtggaatttggtcgactgaccaaagatggtttttccagtagtgctagatccgcctatgcgaggtagtacatacttcatactaatcattaattatctaatggtcctaacgctaattagttcttagtatcaggtagtgtaacttctagctagaaggttgtatggtacatacatcattatagtactaggcatgtagcgtaagcgtcaacttcatggatgttcgttgcattcaagcgaacctgatagctaggctagggggaggccaataacggggtaccccatgtatcttagttagggaagaccagccttaaactccctgtcccaagagggtataaatgtgtagtgtcgttgtcctaatggtccttaattaggacagcttgtagattcagctaatcctcaagaaaaaagttgaagtgatatacatatgcacattttcaaaccacttcaacatttttcttatatagtctatggtcttattttgattaattggaggatttttgaaaaggaatttcgcgagaatggaactaatttgtgcgaaaatcctataaaatacatgctttccaacagaactcactaattatagttctagcacagtacgtaaatacatgatatgatatgaagggctagtttagcttgccccgatgccaaaaaatttagcaacttcaaatcataggcaagttctttctgaaaagagtgataccaatatcttatcagca

SEQ ID NO: 51219 - DNA, 201 bp, Oryza sativa
ctgattagaaaaaaattaggggtaataaaaacgtgtaaaggcggtttacaaattcaaaagataagacagacctggtttaagatttgtatcagaggtggctccggcgaactggatgaatgaaaaacgggaaagctctaaaagtaggttgggtcccttcttaacggagtaagaaaaaggttggttttataggttaaataaaga

SEQ ID NO: 51220 - DNA, 195 bp, Oryza sativa
ggaaaaaaaaacccaaggttcccaagcgtaatccaattctacctctcctcctcaatataggcccatcccctcccctcccctccccacttctcagccggcggccggacgggaggcgcctcctcctcccatctcttcctctacctcctctcctctgtatccgccccatccccttcccttcccacctcacttctcagg

SEQ ID NO: 51221 - DNA, 310 bp, Oryza sativa
  unsure (1)..(310): unsure at all n locations
cgcggacgncccgncggcangtcagcaaaaacgncagcctttcggtcagatcaggcgcgcgccagacgacgacgcatatgaatgatggcgtaacgagacagcagcgcgcggcccccccagctcagctcagcgcggacgcgacgcgacgcgacgggagacgagacgacgcgcgcgcaggcgtagatcgaccggtcgacgcnacgtgtggtgggtgnccgcgcgcgcgccgcacgcaagctagcgtagcgcgacggacgacaccgccaaatcgggcgcggtccgcccgcgcgggggtgaagagaaaggaaaa

SEQ ID NO: 51222 - DNA, 1501 bp, Oryza sativa
tatatggtagataagagtgaaagatgagtatatgagttggtgaattataaggtagatagggtagataagagtgaaggatgagtaagatgaattggtaaattatagggtagaagaaaaaaaatatagggtagaagtaggccgagatccagcaagctcgtaattgaccatcaagctccactcaagctcgagccgtgttcgagccattgctattccacttttttttaagcaagctcagtttgagctcaagcttggccataaacatatattttaacaataatatcttatcataattatttttaaattaatcgcactaataagaaaagaaaattagctaagataaatatatttgctaacccatgctaattttattgtgtacactaatgtatatttatctattagtttatcaaatgatgtgacatactgctccacgtggctaatgcgtcagcttagacatggcttgctgatgtagccacatgggacttcttttatgatcttttttagtagtatttctgaagagagccaacaactttttttttcaaattattcattctttgtatagagattttgcaggagtaacccatcttcagaaatatttgtagaagtatacccgttcgtctatcctgatgggtgacacgcaccttgtcggctgagtaccatttctatactgagtaccatggcgacaacgtctgatctttctatatgatggtgagtgtgcgccacaataacgacgtgcagtgttggatacagaaaaaaataataacaggggtttaaacaaactaaacaaaactatataaaactatatagccctccgtgcatgtatgtacgataaaaggctcaagccccactgctcttatgatatatcccttgtgaccctgccgacgtagtttatttagaaaaaaaaaagaaaaaaaagaggggatagaagaataaagagtgctaatatatgggtctcacatctactccctccatctcaaaatatttgacgccgttgactttttaaaaaatgtttgaccattcgtcttattcaaaaaatttaagtaattattaattcttcttctatcatttgatttattgttaaatatacttttatgtacacatttcacaaaagtttttgaataagacgaacggtcaaacatgtttaaaaaagtcaacggcatcaaacattttaggaatgagggagtactttttagttttatctagtgattgggtgtcatatagacgccacatcattcattcaatatcacccttaatactaccttagaaatcatttcatatcgttttaataattgaaggaattgttatatccggttttctatttgggcaacacgaatcagattcggagcccaaatagacttctcccaaacgaaaacgaaccgcacggagatcggggttccaatcctctgcgcatccaagtcggcgtgacagcccatcaataaataccgaccctgagaaaagcccacgaagcccaacacgaacgaaacacaggtcgagagcggccctc

SEQ ID NO: 51223 - DNA, 403 bp, Oryza sativa
ttgcacatattggagtgtattgggggcgttcttggcaaaaactcacttcgtgagtcgcgcggcgaacttttggcacacgagggtgcgatgttttctactggaatcaaaaagttcaaaaaacgccaaaacatgatttttggacatattggagtgtattgggtgcattcatggcaaaaactcacttcgtgattcacgcggcgaacttttgtcaattaatgccaatattggcacacgagggtgcgatgttttctactggaatcaaaaagttcaaaaagcaccaaaacatgatttttggacatattggagtgtattgggtgcgttcgtggcaaaaactcacttcatgattcgcgcggcgaacttttgtcaattagtgccaatattggtatatattggcctacacagg

SEQ ID NO: 51224 - DNA, 1501 bp, Oryza sativa
gactcttgccgactagaagtagaagcttttgctcatcgatgacaagatatcttctactgttaaagacttagctcttcagatgtacttgtcctttagattgctgctatctgtgcactatattgcttgctgcttctcctgcctactatgaattagagttgctgatgagatctaccccctaccccctctctggctgtgtttcttccagctgcgctggctgtgtttctgccaattgggctgtgatagtagaccatttactctatgtcgcaggataatgtgtatctgttcaattggaatgtaagaggcttgaatgtcaaggccaagcaagatttcgtgaaagtctgtattcaacaacatagcgctactattgtttgcttacaagaaaccaagcttgctgttgtgtctgaccaaataattctaaacactctcggccaacgttttgcgcgtcaggttgctgtcctaccagctgaaggcacaagaggtggagtgattcttgcctgtgatgacaacttcttttcaatctctgatgttcatctgggacgtttctctgtctctgcaaccataactatgcgagaagaagctcaacaatggtcaattatagtggtttatgggctgcaattagaaactgaaaaaattgctttccttgctgaattagaaggccttcaatctttaatgaaaccggcctggctcatcattggagattttaacctcatttataaagcttcggacaaaaacaacgatcgcttaaacagaagaatgatgcagcgtttcaggggactcatagataaaatccaaattaaagagctgaatctcccaggtcggcgctttacttgggtaggtgatggttcaaaccccactcaaaccaaaattgaccgtgcttttgcgactacggactgggattccttgtttgcaaattcatgtctttatcctctatcctcagcgtgttctgatcatgcccccattttccttgttggaaatgaacaaaggaaaaattttccaaatttcagatttgaatctttttggctccgtatccctggcttcttggaggaagtccaaagttcctggcaaaaaccaattcttgccacgaatagtctcgtgattttgcgtctgaaacttcgtcgcctagcccgtgaccttagaagatggagccgctctcaggtaggggacattaaactacagctagcaatagcatcggaagtcatccttcgtctagagatagctcaagaaacaagactgctgagcgatggtgagcgtcaccttctgtcaaatcctaaatcaagatttctgggcctttcagtccttaataaaatacaaatcaggcaaagatcgagattaacgtggctcaaagaaggagatgtaaactcaaaattcttccatatcaaagcaaattcaagacggagaaaaaattatatccattcgctccaaacaccttccggaatagccatctcatcaagacaaagaggaagagcttttcaggttctttaaagatagactggggacgatc

SEQ ID NO: 51225 - DNA, 1501 bp, Oryza sativa
tattaaacgtaaattactgacaaaacccattccataatctatagactattttgcaagatgaatctaacgatgtatattaatctatggtcgatgtatattaatctattttgcaaatcatggattaatatacctcattcgattcgtcccgcaaaatagcacagggattatgaaatgtgttttatcagtaatctacgtttaatactcataaatagcaagatttgggagggctatttaatagcccggaggatccaaacagggccatgtaatctgtgcatatctagagtaaaattatattggttcaaacaatgaaattccacaagtttgttggatggaataactagtggagctaaggcctattttgatttagattatctcaactcatctacttgattacagggagagattaaatattttaagaaataaacttaataaataactttacataagtagtttaatttttatttcttttaagaatatttatcggattattgaaacggattatttcctccatgtttcaaaaaaaatatttttttctcaaaatactttcttatattgtattacgtgtaccataagtttgattatcaaatatttgtttaatttatatagataatctgtaacaacaattcactcgataatatattttaagaggtattttaccatctttgagaaggtacaggaggtaccaaattttaaccgttgatctgttataatcgaaccactgagaaagagtcggtacctgttggtaccgtccatcagtctgtgcagtaccagccgcccaagggctaaaattgtatttttgcattcgcctttcgtcccgcaagccacaggagtccggcggccgacgcctctgcccgttcatcttccctcctctgagcaaccgagctccacctaaacctcaccgtcagctacgaggaggcggtgcgggattttggcgctggatccgaccgttccaaatcatatgaagcacggtagtgcagccctagcagggatcgatgagggcattggatgtgttctccctcaccgccggtggcaagaccttgaccaatcctctcctggcgtccggcgacggcaggaccttgagacccagcaacaacatcagcgccgcagctgcacgcacggttctttgcaaccctacccatccatatgcttcttcgtattttcacaaagacaggtagttcatgtttggtccatcgacgccggtttaggttttttttttgctgcctgaacctcacgaagacagggagctcatgctcaggaatcctaattggcgtggcggtgcgcacgcgccggtccacacggcccaataggtgatttttctatatatgtgtaaactttcaacccatatttgaatactttcaactccgacttgaaaactttcaactccgatttaaaaactttcaacttcgacttgaaaactttcaactcatatttgaaaactttcaacttgagattcaaaaactttcaacttcaaaaactttcaactcagattcgaaaactttca

SEQ ID NO: 51226 - DNA, 1501 bp, Oryza sativa
ttgaaactactagcagtaggctatactattaaacttacttttagtcaatcaaaccatatataatattgggtgaacaccaccacatctattttatcaacggcgtttgttacacgtgctgacgtgcatgcttaataagttagcatgctgtccctttctccagcgtcgcaatcagatcaggcaccacgggatcacatacagataggaatgcatgtgtcctgtgctgtgagcctaggcaaactctttttttttcaaacttggtgcaaatgcagacactcaaaatgcgcgtatactgatcccaacgcatacacgtacatcctacccttattatcaacttcggaagactggaccagcatatattaagatttacgaaatcaccataagcgcctcgctatcaacagatacatcacttaccactgaaaaaataattagttgtaaatgtgagcgctcgtgataagtctaggacttgtacctaaaatcactcaattggaaaattgattgtgaatataaaaatactatttagagtttaatagttgttttttacaacttgtacaaattaaattagaactggtatgtctgtttggtatctaccttatcttttttttttatttttttcataataattatttagttggaatacagtaaataatgaaatttgctcgagtgattagaatctttttccagtgagggtgtgtttagttccatgccaaaattgaaagtttgaagaaaaaagttgaaagtttatgtgtgtaggaaagttttgacgtgatggaaaagttagaagtttgaagaaaaagttgggaactaatcaagggctgagccagttcttatatgtcagaaggaacctgttagtctgcaagatgattaggccatccactgccttgattattagggtttgttctcctaccaaggatataaatccggggaaagggacgcagatcgaaccggtgcacaaaattgtccaatctaaacttatagttgtgtacgaaaaattaagtgtgcttaacaaaccgactgtggagattatggttaccccatatctacatggcggttatattccagctggatatacggtaccaaatatagatagaatatctttatgaggactcgggttagattctaaacttgtatgtcaagaaaatacccgggatcctagtcggttacgattgtattttatctgtaatcccatattccgttaggatatggactgtactttgtaatacggatcccttcccctatataaggaggggtccgggttcctcttggggcgattcttttttccagtttatacaatcaataacacactcggcggaatcatccccggacaggagtagggtattacttcttgaataagaaggcctgaacctgtataaaaatccttcgtctccaaacccatccactttccaagcttgatagccacccccttttattattgccgaaatcttgtttcgaccgttggcgcgccaggtaggggtagcgtcaaattctcgccgactaagtgcga

SEQ ID NO: 51227 - DNA, 842 bp, Oryza sativa
tgtgtttctctctatgcttaatgctgcatcagataagtttgatctattaagtaatacctagaaccataatttctagcttgctccatgattgttaatagagatagtatcggagtttcagccgatcttacctggtttatctatcttgtccttcatttatttacttcctccgtttcataatgtaagtcattctatcatttcccacattcataactatttgctaaatctgccctttatattaagatctcactaggattaaatatattaagcttgatatcaatctatttaggtcatcctaataacagatttatacttgtttaatatagttaatctataatgatatcttagtataaagaagtatcggaataatagcatcaacacgctagatttacctatcggctatgacatgaacttatataatccgagcttatataatctttgatttgaggtacttttaaacataagtgatttatactgtctcgatggctgtccgatgtatccaaatcgcttggtttaaacatattttaaagtatatattatatattgttaatatctacaaccgataaagtgaatttagctctttatttactatatacttcattgccgatctgaatgatatcgcatcggcttgatctcagacgatacgtctgaaagggtcaattaggcctagagggggggtgaataggctaatttaaaactttatgcggaagctaaaactgagttagggtcggaaagtctgatccacagtcagactattcgaaaatatcagatagtctgatgttggatcagactgtctgatccactaaaagaacactacaagaagatctagtgcacaaacaagagta

SEQ ID NO: 51228 - DNA, 472 bp, Oryza sativa
tgctcgagagaaggagagaagagaagagaaaaagaaaagaaggagagatgtggggtctacaccattttctctcacttacatgtgggccccacatatttattatttttatttttattgctgactaggatgccacgtcagcaaaaccgggcgcaaatactggcatgggatctttttcgaacggtttgagtgagtttaggggtgaacatttctggttttgtggttgatggactaaaaaaatctcgctgttaaattgagggacctctggtgtacttattgcatccacaaaacatgaagcaaaaacatcgtgggtcaacctaatcgacccatgttgatccgctggctcgacccatatatccatcaaaccactatatacaagattccacagcttatacgcgtagtacacacgataaatatcgtttcgtatggctaatctgtgatgatttttttttgctgtattgatctattataatta

SEQ ID NO: 51229 - DNA, 1501 bp, Oryza sativa
gcatcttcggctttggcatactcgttggctttttcgaacatctgcttaaccgtcctgggaggtttacgtccgaacttgccgactaggtcctcgtggcgaatgcctttagtgaaggcggcgatgatgacgtcgtcggtgatgtcggagatcttgttgcattgttcggagaagcgtcggatgtaatctcgaagggattctccagacttctgaacgatgttgtagagatcaaactgtgtgccggggcgttcaaaggtaccctggaagttggcgatgaagtgatcacgaagttccgcccatgatccgatcgtgccacggggtaggccgtgaagccaggatcgggcggaatccgctagggccacaggcaaatagtttgccatggccttgctgtctcctcctgctgcgcggattgcaagtccgtagacgatgagccaagactccggattagtggtgccgtcgtacttctcgattccagtcggcttaaaaccggctggccaatccactcgacgcaggtcattagtgaaggcagctactccatccacgtcgtcgtcatagcgatttggtgaatggcggtgacctcgtgctgcacggcgctggttgatcgtgtcgcgaaggtcgacgggacgctagtgaggtggagagcgaggccgttcgactcggcgctccctgtgacgtttgggaggcgagtgaacagatcgtttgttgtgacccctgctcctgcgactagatattgtgccgatgatgctgaggcttggctaatgataatcatgagatcggaggtgagggactcggctaccagtcggggtacgggtgcttgcagagttggctggaaccgaggcagcgatcatggtcttcgtctggttcaagatgttgacaacatgatcggcttggttgagtgcatcttccttgaggagggtgtcgaggagagtgattgctgcaaccgcgttctgctggggggtgcgaaagaccgctgttccatcgacgtcttgttgcccaatgagctctcttgctcggcgcccagattccaaggcgcgctgtcgtcgatcttcagcctcctttgcaatccgttcgcgatcctgttgctcacgctgtagtcgttctcgctcttgtcgctgtcgctcttcctctagtcggcgacgttcagcttcttgccgtgcgcgatcttggtccgcttctcgggcttggcgctgttcctccgtttcgttgtcagccatgaatacgccgaagaagaggggcgtgtagttatcctcatagctgtcgtcgaagttgtcgaggtcgccgtggtcgtagtggtagccgaagtcatcgtagtcgaggatcttggttggtcgagaactgacgccgggggagctgaggtagccatccaactcttccgtcgagactgtcccaagaggttggagtataacgccaacctccctagatctagatcggatcagggccgaagctggagctcgcctagatcttcgagtgggagatgtcttgactgtgaagacagcggccaaat

SEQ ID NO: 51230 - DNA, 340 bp, Oryza sativa
  unsure (1)..(340): unsure at all n locations
cgagggacttgaanttttgagtgagaactatgccatnacaaaccgtgaaatgtataatgttatgaatccaattaaccctaaataattaacaccagttcaatacactttcggcgcatgccaccttttctacttttcattgactcgacgagttcttgcattcgagttgggctgcatcggttgcgatctccgacaagaggtaagacttgctatggtggctagcgttctcagggattagtagccacatctttatgacactctaatcttgtatatgtgaatcactgagttatcatatatactatataatctaggttgatattactatctgatcttgtcgactagc

SEQ ID NO: 51231 - DNA, 1501 bp, Oryza sativa
caaactttcaacttttccgtcacatcgaacttttcaacacacacaaacttctaacatttatgtcacatcgttccaatttcttcaaacttttaattttaacatggaactacacactgcctgaggaaaaaaacatggcatggaggctgtcatgccaagaataaggtaggtgatgtccaatcaagcaaactaacgagagaaattaagaaatggacacaaatcgttattcaattttcagtgcctttgcaatcacggacaattttgcaatcagttaacacaaagcacaaatacttgaatggagaacttttttttaacgaaaataatggagaaatgctccgagtgcatcgaatgcggtcagcaggaggcttgccatcgcggcgaccaccacaacatagattcgatctatagctggcgatgaaccacgcgcgcagcaagcagcagtacgaccgtgccggtggtgaaggacggcatcaaagcggctgcggcctgacctgggcgctaccccaccgttgcctatagcccagctgtgctctgatgctgcttgagttccgcccagttcaatgtctagctagttgcatgattatatgaacacactacaggcgccaaaacgccagtgatgcggcctgccctagacgtgaggatggccgatggccactacaagaaatatgaccttctgtgacaaattcctcgtgacatcagagctattctttattagcatattccattttatgatgatttgtatgagatggggtggcttagtgacaaaaaaaaaagatgttcgttgttaataccaactagaaatcgtcataaagtatttcaatggaacattatgacgaataataatttgtcataagggggacaaagaaaacgtagatttatatattgcatttctagaaaaatatattaagagttaaagcaatttaatcaagtgaattaatgaggaaactaaaattttactttaaaaatcatggtcggaaatatttttgtaatattctacatggtctaaattattctctgaaattttcctagaatttttggagctcaataactaatttttacatcacaaagttcatttaacctattaaaataaatggaaaacaaattaaaatctctttctatccttgggcctttttcggcccaagtgttattctctccctccctcagcccgcagcccctctctccctcctcgggccggcttccccttcccctcctcccttttcggaccaccagcccagccgagaagtctatattgcttcccttctctcaattaatttcaaaatattaaaacttcgaattgaattttatcatactaaatgaacttatgtgaaaaagttatcaaaaacaaagttgtataacttattgagatctgccaattttattttgattatttctccatctgagtttgattgacctatataaaatttgaattttaaattatgacaacttcaaataacattttcaaatactaaataatttcaactgaaaaagtcatcaacaacaaagt

SEQ ID NO: 51232 - DNA, 1501 bp, Oryza sativa
aaacacaaaacatatcagaccaaatgaaagtcacttcctctccccccagctcccagatctagcctgtcgcgagagctgaccggcggctaggacggcggcggcggggaggtggcaaggcatcggtgacggagtctctttggacggcggtgggggcggcggaggacggcggaggttggcggcggcccgacggctcccatcggtggaggcggccttagggctacggcagaggacgtcggcggctcctgtcggcactgcggcggcggcggttcccgtcggcgttggttgccctagaggatgcggcggaggacggcggcggctcccgtcggcgccggcggccctagaggttgcggcagaggatggcggcggctcccgttggcgttggtggccctaggggctgcggcggctctcatcggcgccggcagccctaggggctgcgacagaggacgacggcggcttccggcggcgccggtggcactatgggctacggcggcccccgtcgacgcaggcggcactaggggttgcggtggctcgagacggtggcggtctgagcactttagatagtagatgcctaggaatccggtgaagtagaagccgatcccgtcggtttgtgtctagttggctagttccgactataccacgaatgacgacggtttagagtgggcttataagcggtgcatgacgttagcttacctgaaactgatgaagatggcacaaatggagatttgcatcaatggcgcactagcggcggcagcgaccagtagacttccactcatcaaatctggctgtttcaggagaatatggcgggaggcagagaagtaggatgtgctgaggtcgtttggttttcttttcttttttggttgtgtgtctcctccttgttgagatgtgagtctaagtactcttgtatccttttggcggtgtatatccttcgtggatatagaggccggattaatgaaaatccattatctaaaaaatgaaagtcacttaactaaagaaaaacctgttgatttcatgtttgaagacaattaattactcgctgttaacggcaacacattgagatgactttttttatgccaccagatacatcagtggcacataacaactacaatagcttcaaaactcacaaaaatgaatcatcaaacagaactgtcctgatagtcgtagcgagcagcaatagcttcaaaggttcagaacgaatgtaaatcattttcagtagtactgcacatgatttttcagaaacatcaggtggtctcaactcttcaaattgaacaactgcttccttgatcaaacggttgagacgattattagtacaaatttattaagaaaaatttaatacgtgtagcagtgcttgtaacaaaataagatgtctacggttagacatctacctaccaagatcaccgccagtgtcgacttcctagtcaaatctctgtgcataagttgagggaggagctgagaggatgcatgaggtgctgccggtgtgggacaacatatcctatgcatacac

SEQ ID NO: 51233 - DNA, 1501 bp, Oryza sativa
tgatcccaaggatagcttcccgccattgagtcatcatggttttctgaggacgtccacattcccgcctctcaggaagtggctccatcagtatagaaatcatcatgcaatatcccatcccacacaagttaagaatttagagtctagccaagtgtaatacatgtcccggtgctcagtaactacgggcacggctattcgaatagatttggtttactcacactgcagtggatgtacactttacccgtactccgcgactgcccaacacatgagcctcgtcccaacacatgagacgcgccacggcaaagcttttcgataacctcgcattggcagtacccgctccatgaactttacatcctcatgcactctaggcgtacatggtttctagcagtgagaggagttctggcgcacccgggaagggaagactcacacatgcattaagttataattatgtttagattctcacatggcagtcctaccgatggcgacaccactgtagacacccgcctcgcagtcctaccaatggctgccccaccgtagagcccctacctcacacatcaagaaaccactatgtatggatactgcctccgctcagctatctattccgctaggtctatacccatacgagaagtgcggttgtacgggggtcgtttcatgcttaacttcatggctcggtccttaattgaccggggacggtactagccttttccggataccacccaaatcctccatccgccccagtcgaaaacagttgtttaattttatttctcctttcataaatcatgtcatcaacatcatggcaatgtggcgctcatgtctccacatgccgcatctcaattaccttcccaaaggtaattggccaagcatatagcattcgataaatatgagtatgcatgattctagagtagcatctctaagcatttgttatagttgaccaaggactcatacgtaatcatggttacaagggaataagggtaaacaataatcaaggtatggcatattcacaaataggatgttcatcattgcatgcattcttatttgtaaataaaaataatttcgcaattgggatcaacatgttcaagggatagtgatgacttgccttgctcaaagtcttgcgggtcttggccttcacttggatccgcaactccctcgggctctatagttacgtgcgaaaattgatttgaattcggttagaattcaaataaaaatccaaataaatccaaatggaagtcgaatgcgaaagtcgattcttttatattaactttactattcacgaactagggcatacccaatttcgatttatacatcctaaactatttttgcgggtataaatattttgttatcataagtttttaatttaatctacccgagtattatatccatataataggttagaaatttctatcgcgagctaaatatcggccggaatccaaaaattatcttataatattatacgatttaatttagtctatgactaaacgattaaatataatatacgtctaaaatt

SEQ ID NO: 51234 - DNA, 1501 bp, Oryza sativa
cgatgatgtccatcagtagtggtagcggtataaaccagacgtagaggcgagggcactagtcaacagcagacgagacgatcggcggtgaagacgataaggccaacaactagtggcagaatcatgcagccaaggaagtgaagaaaccagtcggcagcagacgtagacaaattgagttgaaggtgataacgcctattagcggtggcggcgacgtggccggctgtgaagacgatatcaccagttggcgtcatacaaggcggcgagccggtcggtgaagacatagacgcccaacaacggtggtgtgaccaaccaaccatataggcgagggcaccagtcggaggcggtgaaggcagccggtggcggcgaaggcaaccggtcggtgaagacgtagacgcccaacaacggcggcataataggctagccgtgcaggcggagacaccagtcggcggcggcgaaggctagccggtcggtgaagacgaggatgcgcaacaacggcggcataataggccagccgtgcaagcggagacaccagtcggcggcggcgaaggcgagccggtcggtgaagacatagatgcccaacaacggcggcataataggccagccgtgcaggtggagacacaagtcggcggcggcgaaggcgagccggtcggtgaagacgtagacgcccaacaacggtggtgtgaccaaccaaccgtataggcgagggcaccagtcggtggtagcgaaggcagccggtcggtgaagacgtagatgcccaacaacggtggcataacaggctagccttgtaggcagatacaccagtcggcggcgacgaagacaagccggcggtgagaatgtagaagcccaacaacggtgctgtaaccaaccaaccgtgtaggcggagataccagtcggcggcgacaaaggcagaccagtggtgaagatgtagacgcccaacaacggtggtgtgaccaaccaaccatgcagtcgaggacactaatctgcggcggcatcgtccgacgtgttctatggaaaccacggcgaatttggcggtggctccaccagtacatgcgaagagacaaaaataatctctaattagtatcaagaaaattaagaaaattaatgatgtggatgtatatttgcatatatgcagcacgcatatgttatttcactggccgattgatctcctgtagcatgaacattagacgcatccatattccacacaagcagatcattggaccaatctcctgccatgcgtgcgtataggtcacaggtccgagtccggaacgaatccaagtcagagagaatcagactcgggaaacgtggtgcatgcaaaataataaatcacagatcgaactgagattgagattagtagtagaaacaaataaaaagtgcagatgattatggatattaatcgatgcatgtatgtatgcatgctgtctgccttcttgcttctttatatgctgtgaaaccatcaggagcctgcggcaattggagtatttcacgtgtggattccactgtgtgt

SEQ ID NO: 51235 - DNA, 308 bp, Oryza sativa
gcactttactccataattaattacgttggtagttggttatgggcttgtggcttacaactttcagaagcttagaatatgctgggctgcatcatgatttctggccccaattagtattaagccactagcttaaccgggagaagatccaggccactttgccctaatgcccaacagatctccagaggctggcggcccatatagtttagttagtcaaagggtagcccaacaaaaaaatttctcttttccataaaaaaagactaacaaatctttgatttttcctagaagacttttgtaatttcaacggggaaaaa

SEQ ID NO: 51236 - DNA, 1501 bp, Oryza sativa
aacgattgacttacaagccgtaataggttattagtaaaaaatattttgcaaataaaacttttacatgtgtattcttagcaatttaaaagtaaatacagaaaaataaaattacaataaaaacctatgaaacaacacataattaagtttttaaaattaaatcttagttacgtttataagctgaagggtaaacgatgagactgatacctcggtttatattaacttgatcattccaaagactcaatgatcaatagcacaagcagagtttatattaacctgatcatttgaaagaacttaatgatcaatagcacaagcatgcaaaaagttgcattgttgcaacaaatataattcatgcgtgtcggtattgggcaggtaactaaatgaagtcaagagaatgaccgggtagatgatactcccaccgttctaaaatataggacacaactgctttttaaagtggtttcataatataagagtaagtttaatagcatagccaactgctaactcaaattcatctatagctaacctaatagctcatttatacaatagttacatactacaatatcaatatctggtcccatttatcatacacacagtgtgtcttggagtccgtgctacaactggctacaaatctgtagcccgctgctcttctctcttcttatttatctccttaaaatatgtttgcagctggtttatagcatgctattgtacatgctctaaggcgtgtatgcatgcatgcaattaattagcacgttctctcccctaaatcattattattttaaatcctatactcgtaagattttcaattctattggttgcatgtattgtattaattggagtgattcatgacaacgatgagatattaattatttcttggtctttgggttaaaggtggttgtgccttaggtcattcccaacctaagacactagatatagtttccataaactccacgtcatcaagaaactagtactagacactactcttctaatgcaaacaccactattccatacttaaatttaatgtcacttatctcacatgatgtcctggatgttgtgtagaaaccatgtctcatgcaagacatgatttccttctctttcctcatttattcgtttgccacattatttttcatcctatgtggtagcttatttaatgctatggacattatcctagtcattgggttaggaatggtcttagagcaggtacaatagcaggctattagccagctgtaaacatattttaataagataaaggatgagagagaaaatcagcgggctacagatctgtagctagctgcaacgcggactccaagacgcagtgtgtttatgacaggtgggaccatatattaatagaatagtaagcaactatcgtatgaattgactattagattagttatagataaattggagttagtagtgggctgtactattaaacttgctcttatactctagatatgtaccaaaagaaaattccacatttaagggacgtgggccacgtggcaatataaac

SEQ ID NO: 51237 - DNA, 540 bp, Oryza sativa
ttgttcaggacaagcatagtgaatacttgtgaactatcaattacacgctgaaacatcctgcagcattacttgcagtgagaatgtcaaaacaaggtacatgtgataatttcaaaatgttccagccaattcacgataatctaaagtagaatggaaagttgaatctagaataattataacatgatggtgtcaccatgaccatccgatacagtttccttgtcttaattcagtaattcttaagagagcacatgttgtcagatagatgttttcagaaagtgtaaaaataggtataaagctgaggtgaacatacagggcaactaaaactacagagatcgactagttgcttcctttcccatatggtaccgacaacaaattatttcagaggtgttatgtagtcgttagaatagagctaacgcaaggtgcgaagccaaaatctcggcaaattatctagcaagaaaatattgtaaagaacagatgacctattattaacctcatttacattaaaaaaagtggatagccacagttagattaaattagtttaaa

SEQ ID NO: 51238 - DNA, 1501 bp, Oryza sativa
ggctcatttgcaaaagcagcatttagcaaacatttgagaattataaaacaatagagtaattaatcatcaatattaatcaacactgaacagtacacccatgctgcacaggcccaaccatcctgaacaaccatacccggctgcacagatctatctccaaaccaggagctaaacaaattattaccaattatatcatcatttattatggtgagaagtgtgagactaatcacgaaagacattgttagacccgcccatgaccgcgggcacggctattcgaatagttttactctggccagaggtgtaccactgtacccacaagacacagccccacaacatgtcaccatgcgcctcaataccaccacggtacctcggaaaggagctgtgacattacccctcgcacaacacaatccaccacagtgcaccgttccttgatcatagtcacccccttataaataaggcatggactccccagcgacccccgtgggcttatctccgccacttctcagtccggtgctccgcaatgaaccatgctatacaaaaggtaaagctgttgcccacgctggcttgtggttggcacggttaatgtttcacaaccgaaaatcgtgaaccggtccttaattgtcatgagcacgactctcaaaaccatgtgctcacaacccaccattgtcaagttttagttggcaatttaattaattaaccaatcacgattgaccatcgtgaactatcattaagccatcattaaacaatattgaatcataagttatcccaatagtgtgctaatgtttctaagcatggctaagcaatcatatctaatatctagctgaaccaatatataaagctcaactagtcaagttatgataacccaaggtatcaaggaataaagtaatcaatgcaaacaggctataacaaaggaatagattcaccccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacaacggaaacgacaagctaacacgcaaaacgaagaaaaagactaataaaaaccaaataaacagtacaaaaacaagcataaacagtacatgtggatatttttaacatgtagatctcaattttagaaaaatttagagacttgaaccaactaaatccgagctaagatgaattagttatgaattttcaaagattaaatcagattaaatcaattatttagattttaattgaattatgacgcaataatgaattatttttgaaaaggaaaagaggattattgcgtcagcggctcgggttcacggtggaccgggtgcacggcggcggctcacagaaacgaacggccgagatcgaccctatccaaaacggacggccaagatcgatccagaccacggtggtccacgagacacggcgacga

SEQ ID NO: 51239 - DNA, 366 bp, Oryza sativa
gagattcagaatctcatattacttactgcattgcatgcatgtcccgcgctctttgggtgcaaatgcaattcaatccaatgcgtgttgggtaattaattagggtcggatcgtagagaagatttctaccgtccagtgatttttccagctagcttcacaaggtggtgggctagatgatttaggttcgaaggctcccccttctaattatttaatattaggtttttccctagagggctgctatataacggaatcccatttttgaacgggatgataccggttaggtgtcaagtccggtatcagatgatacatatcaggtatcagacgattctaccacgtttttatgatacttgcgaggtatcagatgatacc

SEQ ID NO: 51240 - DNA, 242 bp, Oryza sativa
aattcctttgattataggagcggcactgctttgctaattttctgaaagaactgaaaacaatgagtgagagatacatgaatagtccgctgcatgatatcaatatgcaccgccaacatgttcataataggcataaagcaatgcaatggcaagaagattgagacagtgatatgaatgttatgagtcttatgactagggatgatgggaagatgtgaaagtgtttgcgttgaggaccaaggaaatga

SEQ ID NO: 51241 - DNA, 343 bp, Oryza sativa
tcttatttaaaaaaaattgtgtaaatataaaaaacgaaaaattgcgtttaaaatactttggataataaagtaagtcaaaaaaaaataaataattctaaaatttgttgaataagacgagtgttcaaacaatacaagtaaaaacttaaaatcccttatattatgggatggagggagtacatggtttgcattcggttagctagcttcttcagcttcaagcttaatatattctttagggcaatttaatctgtatggtggtatcatatggtgtggtgtagcttcatgtgacaagcaagggcgcaggcagcctagctacttctcgtggcacaaggccagcacatacaca

SEQ ID NO: 51242 - DNA, 642 bp, Oryza sativa
ttgtaattagacttagcatgtaagattatgtagggttctaatatacgacagttacacttagcatacatggctattttagtcttagcatataatattatttgagttttaatataagattattatatttgtaattagacagtatataattattgactagctagggtcctataatatacgtcacctagatttagcatatatcatcactatttgagttttagtataagattattagatttgtaattagacttagcatgtaagattgtgtagagttctaatatatgacagttacacttagcatacatgactattttagtcttagcatataagattatttgagttttaatataagattattatatttgtaattagacttagtatataattattgactagctagggtcctataatatacgtcacctagtcttagcatatatcatcactatttgagttttagtataagattattagatttgtaattagacttagcttctaagattgtgtagggttctaatatacgacagttacacttagcatacatgactgttcgtttagtcttagcatataagattatttgagttttaatataagattgttaaaacataaatgtctcatgacttagcaaatgtttcctgtatgaacaga

SEQ ID NO: 51243 - DNA, 414 bp, Oryza sativa
tcatttgtttggagcacagtttagaacaacttacaaagtaatttgtaccacagacttcacaagcattttgatagccataccaatacggattagtatgtttagttatggtaggaatggttttctatgtaaattgagctgtctttatgattctgatataagtaacaaatgtggaaatcctatacttagccatggcaatgcattactagaagcaagcaaactgtatcaccatgtataagtagtcttctaaaagtccatttgaggtgggctaatttgatatgaaaaacccaggaaataaagtgcaacaaatatctctatatataaatagtaaaaactactagtagcacaatgtgtgtccacgcacaaatcatgatttaattatgcaaaaggaagaaatataaaacgatgtacaatagg

SEQ ID NO: 51244 - DNA, 450 bp, Oryza sativa
tcccctttcttcttcgcacacgagtgcctgatcattgagggctcctccatggcatcaatgccggccgtcctctgaactactactagtgtaccacacccttctcatctcctttccatggcaatgcattttctccattggtccagaggccaactgcatgatcagagcatgacaagggcaaggcaccatcctcttctcactcaccggccgtccatgattggccattccatcccttcaaagttgggatttaatttgccatggccaagttttgaccgggtcatcaaggtatctatttgtcacacccagaaattctcgaaccagaatttctaagctgaatgtgcattaaatccctgtccaggaccagccagggtacacaaacgacaattgttgacatacagacccacatcttacaaaaatataaaagattacaaatgcagcgggaaagattaaagc

SEQ ID NO: 51245 - DNA, 156 bp, Oryza sativa
tacatatacactcctccgcgtcgcaccaccacatccacaaccagttgcgccacaggcgcgcgagccaccaccgcaggcgagagattgtcgtcgtcgtcgtccgttgctccggccgtgacgacgacggcgtcatggcgtccacggatccgctgctcg

SEQ ID NO: 51246 - DNA, 373 bp, Oryza sativa
tgttcttgacatgtgattaaggtgttcttcagattgatatcatttcaaaccataattttttttttggtaaagtttcaaatatgtgtatatatttggtttcttaccaactttggtaaaaaaatacataaggaatttggcaactacgtagtagtggctatcctgccaaaacctggcaatattgccaacttacaaaaatttatttattttggctacaatctcaacagccctaatttatatgcaaataaattgttcctgccttataaatctctgcggttatcttttttcctcctgtcatgttttggagttcacactttacaggagcagttatcagttttcctctatctctttctgaaccttttattctctttccaga

SEQ ID NO: 51247 - DNA, 1501 bp, Oryza sativa
tattgacaatcataaaacaaactagatatttataattatggatattacttaatagatcgaacccaaccgatgcagcattaagcataaagataagtataagatctaggcaagatgatgaaaatctctaagagatagtagatatacaatataatctaaattaataacgagatttaactctatcggctactttccaacagtaaaaatcagccaattgcaagttatatagcactgacggagcgtggggctcctcaccgggagaccgcgcaggcccccctttgccggttcggccgggggcgctaagtgaggttcttcgccctcgatcgatctggagaatgttcgcgagagagcaagtgcacgagacacgggcgatgtagacaggttcgggccgctgagaagcgtaataccctactcctgtgttctggtggatctgtgtgtgaaggatttacagagagccggagagccagagagttcaggctccagaacccctctcgcctccttttttttctttttttttttctttctctttggtgggcaaggtcctccttttatatctcaaggggatactacatgcaccacttctacctacttttcttctgggtggggacctaccctctcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgtgggagcacggttgtctgccgatgacgcgaccggcgtgtagacccccgtttttataacaggaatcaatcgtgtaaacagtaccatttccctggatcaagtagtttggtacacacggattcatagctggaataccaagtgcacatacacgagtgtctaatacgaattattacattataggcccgcaggcatagtcttaaatcatcggaccgagcggtccggaatacatccaaaagcagaaatagataaggcagcggaattcaggcagcggcatgccattgccacaggcaacgaccgtactaagacctactggacgccttcgtcttcatctccctcctgatagtaggcatagggatcctccgaggcttcatcttccgcttctgataaattttatatttgcaaggatgagtaccaaccgtactcagcaagccaccacagcaatgatgcacatgacagaggaattcaaaggatggctatggttcttttgcgcaaagcaaattttgtaattcttttcacaagcctaagacctagcatagattgatcacgttttaataccagtgttcatattaaacaatgacggttctgtccaccatccattgtgatcccaaggatagcttcccgccattgaatcgttatggttttctgaggacgtccacattcccgcctctcaggaagtggctc

SEQ ID NO: 51248 - DNA, 1501 bp, Oryza sativa
gcatagatggttcacctctgagtgaggcaggtgcgctacattgggacagccgttgaggtagggccgagaggcgtgccctccatcggtgtcgccattggtaggactgccatgagtgtgtaagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattatacttagctagactctaaattctttaacttgtgtgggatgggatattgcatgatgatttttatgctgatggagccacttcctgagaggcgggaatgtggacgtcctcagaaaaccataacgattcaatggcgggaagctatccttgggatcacaatggatggtggacagaaccgtcattgtttaatatgaacactggtattaaaacgtgatcaatctatgctaggtcttaggcttgtgaaaagaattacaaaatttgctttgcgcaaaagaaccatagccatcctttgaattcctctgtcatgtgcatcattgctgtggtggcttgctgagtacggttggtactcatccttgcaaatataaaatttatcagaagcggaagatgaagcctcggaggatccctatgcctactatcaggagggagatgaagacgaaggcgtccagtaggtcttagtacggtcgttgcctgtggcaatggcatgccgctgcctgaattccgctgccttatctatttctgcttttggatgtattccggaccgctcggtccgatgatttaagactatgcctgcgggcctataatgtaataattcgtattagacactcgtgtatgtgcacttggtattccagctatgaatccgtgtgtaccaaactacttgatccagggaaatggtactgtttacacgattgattcctgttataaaaacgggggtctacacgccggtcgcgtcatcggcagacaaccgtgctcccacgatgcatctgcctccggtggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagagagggtaggtccccacccagaagaaaagtaggtagaagtggtgcatgtagtatccccttgagatataaaaggaggaccttgcccaccaaagagaaagaaaaaaaaaaagaaaa

SEQ ID NO: 51249 - DNA, 561 bp, Oryza sativa
caaattgttaaaagactcctgttactaactagatacacagcaggaaaatcaaagtatcaaacatttcaatttggggctgaacgtcctaacctaagatccaagaaagctctaagcattatgacaagcaagcaacagcagtgaattaatattaggcacaaggaatatcatgaaacaaaagaagtaagtgcaaagaagataaggcatgatcaaattatatcatatggtttgaatagcatatcattaacttataatcttcgaaagaaaaattggtagcactaaaattaaatcattccagcacctaaaatgcaggtacagtactgaactccagggaatagagggcagttcccatgtttcaaataatattccaagagcaaatagcacatacttaattcctggaatacctacaacagtagatcatccaaacacatgcagcggcaataaaatgtatggcaagcgaaagacaacatatcactatagcacatgctgtagtgatacaaatgttcagctaaagaagcaggtagaacatcgagtgtgtaagtgtaactatgacccagaagttac

SEQ ID NO: 51250 - DNA, 272 bp, Oryza sativa
tcagggagcgcgtcgcgtccgcaggggccgcctcctcctccggatcgtggggcgatgaggtgaggacaccgaggcgcgattgggaggtttcctccccacaccatttctgtcgcgggggtttaggcgaattcggtcccgacggggtagtgcaattgaagagaagaggccggggggagttggggagagatatatgctttgctctgcgctaaatttggtactccatgggtttaatttcgtagagggcttattttggtgccttgtttccttgcagt

SEQ ID NO: 51251 - DNA, 202 bp, Oryza sativa
tcacggaaaattccggagagtacattagggcacaaagaatattacaaaatattcccggccaataatttttaaaggaaatttttaattccctcaataattcacttgattaagttgatttaacttttatttaatttccagaaaatgtattattaattgatttttattcccgaacgaaaatcggggcgttacaagtaggaggaca

SEQ ID NO: 51252 - DNA, 483 bp, Oryza sativa
ttcctgcacccctagtcgatttattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaatgcgatcttccgaaacacgggaactacacgctggcacgcaaaacgaggaaaaactctaataaagaccaagaaaacagtacataaaaagtaaacaaacatgtagagctcaattttagatgaattttgcaagttgaacggctcaattcggagttcgaatgaattagatatgaattttagaagttttgagccatttaaatgaatttctataattattcacgaattattgcgcaattattatttattttctcaaagg

SEQ ID NO: 51253 - DNA, 252 bp, Oryza sativa
caaacacaaaccattttacttcaggaacctgatattactggctaagcatgtaagcaatagccaataggtagctcctttagagcctataggtgattgcattgttctttaagcaaattacatgagttaagtatggttgcaagctgatgagaaaatatgtagctccttgtactaatcttgtcgccatcgtcctcataatattgcacaaagaattctttctgtttgtgactttgtagtttgtactgccatactagt

SEQ ID NO: 51254 - DNA, 197 bp, Oryza sativa
tggggtgaggagagatttttcatgtcattaccgaatgatcttgcttgtcttccttctctatttgcataattgcatagcagcagaacacatgctatccttgaaatgcttatctggtggcttgactattgaaatcataacatatggttcttactgctgctttttttacgtcaaacatgaatggctctcattttgacagc

SEQ ID NO: 51255 - DNA, 804 bp, Oryza sativa
gtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgcgcaaccaagtgtctttaaatgctgtttactgcaaccctaaccctttatattataactcctttgtactcccttgcatttattctgcacttgtgggtgtgtcttgttgagtacggtggttgtactcggtcttgctcaatttttcccaaacccagaagaggagtctctggaagatgaaggctttggtgtctagctcgtgcctgctgtcaagcgcctgtggtcgtcgccctagtcttccgctgtttcccgtttgtctttgtgtgtgctgggccttcgttgcccatgtaataaattaactatttacgcttccgcttgataaactctgaaatgtatcaactcttggtgtaccttgcctcctgggacaaggaataatacacgcacgtaaggaacgcccgttgggttaattccggtcgtgacattcggggtgcatggttttgatagtagcacctcggccatataaggaccggt

SEQ ID NO: 51256 - DNA, 590 bp, Oryza sativa
ataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccacccttgaccctaggacgagccgtagatcccaagccttagctatattttcaaaaaaataaaaatcctttattatttgtgaaaacccgctattctctcttgtcttgctgcttcatttatcgtcaaaatctggtctttaaaatgttgtttctctttttgtttttgtttgtagatggccggtagcgttacccgtcgtggtttggacatgactggcttcgtcttggagctgcgaggcatgtgcgtggtcttggggtatccacatggagtggattaccaggccaggccgctcccggagcaggagggtgaggatgcagagcctcacgctggttgggaggtcactgcagtgatcctctccggctctcccgagcggacttcgctggcagtcaccgcgggtggagattccttccccgccgcttgccagaacgccgctctcctcgccatcggcacc

SEQ ID NO: 51257 - DNA, 298 bp, Oryza sativa
ttattattattaccttgttcaccctagattaaacaaaaccccaactagtggacactcttctcatggtaccactagtatgattttaggtagatgcttcgctatttaattaggtaacattaggtggtttttcaactctagactttgggaatattcatatcacctggacactatggaatggtttggttattgtggaattggcttcacaccgctccttctattcaaaatccccaaaatggttttaggctgggctcggggtgcatggttttgatagtagcaccttggccatataaggaccggt

SEQ ID NO: 51258 - DNA, 1221 bp, Oryza sativa
ccagccaaatgctttttagggctgcaaagggcggcaagaggctaaatgcaattttcgcagacggcggcagatggtgccgtcgagccgccgtctgccatgttagcttgtcgccatccactagggcggcagggtctatttttataattttttgcgccgatagattatttctgtaaatattaaaagaaaaaaattaaaaatgaaaaaaattcatgttctccccctcgcgactgcgatgccggacctgcatatggccggtgtcatcggctcatcgctcccatcagagtttgttgccgccttgaaatctgcagtaaaagctccccaccccccaccccccatccatccaattgatagatgcacctatatagtccgtatttcattcgtcccatataaaacgaacatataacttaatgtgatatattctaacacaataaatctaaacggatatatatctaaattgataacaatataatgtgtcatatctattattatattagatttttatgaaacggatgaattatttgtgagtagtggtactaagggcaagtactataaacattttattactaattgcaagataccatgtagactcgtataatgatgtggaggagagaaaagaagataagagagaggagcagccacccatcatgtaagggacaacctctacacaaaaatcaagaaatatgagagaaagagagaagtgtattgggtgtagtgtaagtagatgcaatctattcagagtatgtattacctctaaattaatatgtaaatgatttaaacaaaattagatgtgatcaaacttgtctaaggaacttcagatcacgcgcaattcagatcacgcgcaaatcaggttacaacaatcctatgacgcacgaactaacgcatacaatgattggtgaagggcagctggaccgtctacaggatagtttcagacttgtttcctccctaacagtgtgaccacacttgtgacttattttattattatcgttatgagattatcgtggggacttttcctaagtcgtaaacagcgccatgtttatgaaaactttcttcaccgatatttttcaaactcttttagatttacttatcaactttctaatattaatgcattcgtgtatgtcctcgaataattattactgtcgacgtttgatgtcgtcattctggtatttgcatagtatggggatcatcaatgctaggatatacgcgagactgaggtaaaagaga

SEQ ID NO: 51259 - DNA, 1003 bp, Oryza sativa
tgatcactagtactgtagtaaaaatactgcgatcattgcaagtagtgcagtttttgaatttcaacaggtcaagcacggagcagatcattccaagctttgttataagcaagcgatactcagtaaaaatcatgagacgagggcacctcgtcgcagtatcagcaattgcagtcctggagttttggatcgcatggataagccaacaaccaaatgacagggcaggacaccaaggacgccagaaatgcgtcagtcttggagtatgccgttacataatctcgaatgcaaatcatcaaatttggaccacctgtgatttaacaataaccatatagaggaaacaaactgtcccagtagaaatatgacgagaaaactgaaagcaagcaaagaacaaaccattacaatttacaaatacaataaacagcaacagccagcaaacaagtagtacaaactagatctctgcaaccatgaaccggcaacggcaagagataacccaaggttaccaggattaacagcaatagattaccgtgattatcagacacattctttcaagttgaagaaacagtaagctcactcagctgtttgaagccgaggctaccttttatagttctttttagtaagtgaatcaccaaggctttgagattagttgttcaactacacattatacatatggaatagcacgctggaatgagtcagatgcaaccacccagcaatgattgtaaaaaacaactggaaaaagaaagccacacaatcaatgaaatattatgttgagatgtcatatatcatagatcaatcatctagtaatttatagcataagggtcgtatttaagctacttagcaatgttaaaagacatccaaagtatagctgtcagatgcaaaacatgaagactattaattattactccatacaaaataaggagagtttcttatatgaaccaaggtaggagttggagttctggtgcaaagaaaaataagtataatcactatattgtgtagcaactgcatcaaacca

SEQ ID NO: 51260 - DNA, 817 bp, Oryza sativa
tattttaagcatttttttatttttgttaatttgcactcttattttgagactgagttggaggaagtagtgcattagattgattatgaattactactgaccatgagtatatggggaatgttgtgaagttataataattatatttaacgataaatctaaatagaccaatttttaaaagttgattcgaaatgttcaaatactccgtatgtcccataataagtttatttttagcttattttatctgttccaaaataaatttatttttaaagtaatcattacatcggagtttgtgaaagtaggacatacttgtattgagagtaaataaaacgaataatagttgcattgggatttgataaagaatgaggattatagtttttttattttatattagtatgtgtgtgatgattgaaaaataaacatatttcgaaacggaggaagtacatattagtaagtaaaattaaaatttgttgactgcacatattagaaaatgccacttccttttgatgaaaaggagtaaatggtttacttgtgataaatactgatgcagtgaaattcattaagtcaaggataatacaatgtactccctccggttctataataattgacgctttagacaaggttaaggtcaaacttttataactttgagcattaataactttaaaaatatttagtttaaagaaactagaacaacatagatttgtctttcaaagcactataataaaagtaaacatgcacttatttattgtgtatattataatagaaaaataaggttaaagatatattttgtaaatcgtatcattgtttaaaacgttaattaaaa

SEQ ID NO: 51261 - DNA, 955 bp, Oryza sativa
gcgcggttaagcctgaggacttaaacttctatgttgggtactctgcctgggattacgaccagttgttgagcgagattgatcaaggatactggcatgtcacttcctgtagctcaggcctgataagcgactcccttgcaacagatccttcttgcctatggactgagatattgaagctgatgggaggccagtacgcagaactgagtcaaaagccaaaggaagatggctcgtgaaaattcttgcttgctagcatagtttggcacaattgacgtgcttggtttgtacataattgggaataatctcgcccggtcactggccagggtaattgaacagtcctagtagtagtttcatgtggtcgtctttgtcctctgtattacttgaacaaatattatggagtactggtgatagaacggtgtgggctgtgaataattactggaattacatgcttccatcaattttctatgtgccacataaaaatccgaaattgagataattgccttggctcatttgaccgagttttcataatgctcagtcctgtgttcatggtgtgtgattactgatatttactgtacttcactctctaagtgactgttcaagcaaggcttaagtggcaagtagtacaactattgcccgagagattaaatcattaaaatgttttgcttttctagtcaaacgtgtattgcacaagattaagctaaacgcgtcaggcacaaaggtagggagattcagattgcgacagtgagaagcagatacttcagatgcgccacaatcctgcactcactcacgaacgcctttttatttcgtgccaatacccgcgttcgtttcagtacttgtcctcactactcgtctaatccccctattgattagtaattcattaattcacagtcacagcaacggctatggaattaaactactgtgtgaaaggaagacacaggaactcaaaagggttgaaaaaaaa

SEQ ID NO: 51262 - DNA, 336 bp, Oryza sativa
acccaagatgatgaagacgagccgaacgagccttcaatcgacctccgatgcttggaagaactagagtgacttgttaagtcgttgtcttagatcgttgtgttagtttgtttgctttaagtttgcttgtgtgtggctcgcatgtgatttacatcagtggtgggatgtaattgcatgcgtttgtttgcttttgagtgttaggaagttggtgagtttagtggtgtgagagtcttcagtttgtaataatgaaactcagttaagatcaataaaagttaaagtaattctctatcctaagtagttttcccccggtttctcttcttgtgccatgttcctgccaga

SEQ ID NO: 51263 - DNA, 767 bp, Oryza sativa
aacgacgcctctttctttttcttggattttccttctctgaaacccccaatcttgaggtccttgatttctctaaggtatctatgatccggtctctaattttagttgtgttttcagtcccttcccctgttctgattgagattttttttattgagataataagggcgagaatagtttgaggtttttcttaattgggttcggaatagtttgcaattcttatgtttcttagccaactagactactagagataaagttggcgctgtctgtcctaggtactgtttattgtgaaggtagtgaattgtagaaaataataatgagtcactgcacgtctgcaccttgttatacgcgtgattttcattcatgttactagtaaagtgcttccaaatatgttagttcagtttcagcagatgaatgctagtatttctggacttgcactgctcatttgcttgttagaaacttccctttttattatctgcttcagtaattcagttgatcaggttgttagactaattgcatattctttatttgcttagtcatttataaatgcatagggaggttccctcatttaaagttatttgctaatctaaatctacctcttagttgaattggaaacactcctgccatcttatcgaaagtattacctctaaattaatatcattaattccatctgactatcacatctcatatgtttcattcttattacttttaggccagtccgtagtgccagctgaacattgatattgcttaagtaaggcaaccgtattgcccaa

SEQ ID NO: 51264 - DNA, 1227 bp, Oryza sativa
gtgttgtgtgttgtgtgctgtaagcagtgtgctgtatggaactagtgtattgtgtgctgtatgcagtgtgctactgtgttgtgtggctgtgtgctgtatgcctagatagctgtatgcctcattgcctcatgcgtgtcgtattgatgagtgaactactgatctactgaactgaacactatatttttaaattttaagcaacacagtgaactgctgaactgaacacttatattatgtttttgatggatgtgttatattaagcaaaattatattattgatgtgttttggttggtttttcctagagagctgaaatcatgttcatatgttgttttgccatcgtattgcggctaattgtattgccgccctcttgttgtacggattgaatacaaacttaacatccgacaactttttgtccgtttccgaaccgagtccgcaccgactccgcaccgaatccgacgtccgaaataatccgctccgcatccgcatccgcacgtcatccgcacccgctccgcatccgcttaaaaaaaggtttaggatatggtatagctattatctgtccgaatccgctccgttttcacccctacttattatatcgtgagctgaaaatgtggagataaattagccggttcgttagatgtgaaattttggcggcagtctctagacggaaaatcgagattggcgggaagtattttcatgtaaattgctcataaaaaatagtacggtatttctttttcaaaaaactacgagagcccataagttaaaaaaatcggtccacatgtaagtattaaattaaggtaattttgattttgtttatatatataacatgagatttaattctacattcttgtttttgagatggaagtttgatcacaattcttttataaaatataaatttatagaaatataataagtttatgagattaagaaattactttcaaaacaaaaatgtacatgtatcatttgttatgtgtgcaaactatcattttcatttatatttaaagttataataatttagttggaacttgtctaaaacattatatattttcttgatcaaacgtattaaatggtaaacacatccattaatttaattctatgttatttgactttaccatgctctactgtctcaattggttcctcgtctattggtctatttgagtctggctatcttcggttcctcgtctattggtctatttgagtctggctatcttcataaatagcttgaagtgcgcc

SEQ ID NO: 51265 - DNA, 1501 bp, Oryza sativa
cgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgca

SEQ ID NO: 51266 - DNA, 1501 bp, Oryza sativa
acaaaaagatatggacaacgtcttgagattgttgctttcaagtattgtcaacaagtcagtacatgaaaaccgctccttttcactaatgaggtgaaaaggaggggaaaaaagagataggttaaagattcacatgttgctaccatcatgtgcttactaactaagctcagatgaaattcagtatctactacaacctgcagccgctgactagctaatatctaatctattctgaacaaaaagattgagaagaagaaaaaaaaagattgttttctcttcagtggtgtctaggtgtatggtcactgggaccatagtagtcttcatggaactcaggtaacttgtgtgctacagccctaacttcattcccagcaatgcttctcttcgcctcgcctagtgagtcaccggaatcctttggcacattctctgtcgatttctgtttttcagaacaaaacaaatatgtcagcacacacatacaaaaagaaaagaaaaaggaacagaagacaattccatgatgaacaaattcagtgaatcagaatcacttacattgaccatttggttgctggttgctgcgcgagtttctgcatccaatcgaatgccctcaacctccatggccatcactaccaggagcaagatcacagcagtagccattgacaacttggacatcctcatcttgtctcgcaggaaattttgaagaagctgggagagattgagagttaagagagtaggatgagctatgcaggttgagtgtgtctgaactctgaatgaagcatttgacctatgacaggtcatatatatgcatcttgccatcttgcttttagaacaacccccagtgtttgctgtgctcatgtctatcaggattcaggagtgggttatcttcgtcaaataaaaaaactacctctaatgtctggatcattgtcgttaacccattttttaacagaaaaaatcattgtcgttagctcatgcaccatgcaaacccaagacatagtttacagggttcttgtcaccctttggggaaggatgcctgcacaaaagtcggcctcctgtttgatcaagccaccggattaggtactaatcctgtacttacaactgctactaatcacgagtaacaatgctgtcaggtcttgtgtttggcatcaggtggtgccccctggaaagtagcgaggctgtctcacgacagacgcacagaaaactgcgtatttgttcgagcgtttcttcagaaagcatgtacatgccttgtcagttgggttggctgatctggacatggcaattggaagcttctgaatctgagcatacatggatacttaatatcaggggggaagaaaaattatgaatacgggagtacggattacggaatgctgcttgttggttgttgcagacttgcagttgcagatcgatggatgacaacacaacttggcgttgtcctttcatggcctcctgggccattcgtgtttcaacggcaactgatgttgtttctttttggctgttgacaagttagggattctaagga

SEQ ID NO: 51267 - DNA, 224 bp, Oryza sativa
actatagggcgaattcgagctcggtaccgtgttacagcttggttttgttagattctcagttagccgatctagctttccaggatttgctggctccaattagagaaaagtttctggctcaggactttgaaagtttggctcatctggcctagaaggtaggagtacatgagcaaagatttcaggaagcaaagaaggttgtggctttcaagaaggtgaacaatgtccat

SEQ ID NO: 51268 - DNA, 1501 bp, Oryza sativa
aagttctcccattatttcacttgattaaattgatttatcttttatttaatttctagaaaatgtattattaatgatttttaatcccgaacgaaaatcggggcgttacaccggtcgtcgtcgtcgtcgtcgtcctctcgtcgttcccggtcgtcgtggcgttcgtccctccgtcgagccgttctcgtccgtcgtccgcgttcgtcaagcgagccgctgcagccccgtcctcgcctccgtcctcggctccgcgtcgtcaagcctcgtgccggccgcgtctcgcctttgtccaaggatcgccgccgaagccgtcccctcgccgttcgtctccgttgtgcccgtctgtctccgccgcgcccgttcgtcgttggcgttcccacgcctcgtcgcgtggtggtaaggatccgtcctctcgcttccccgccctcgtcctttcggtgtcgccccgtacccgttgtgcggttgtcgacaccggtacccgtgtgccggtgtcggtagtcgttcgcttgtgcgtgtggtgtccgtgttagtgtgcccgctcggtagccgcgtggtttctacgtgtgcatcccgtgtggtgtctagtggagtccgtttgttggccactcgcctcggttgacacacggggtccgcttccgtcgacccgtggaccgtctctgtgtacccggtctaccgcggtcctttaggttgacatgtggggtccgcatgtcaacggcgcagccttcctgtcttttccaggctagcgcttacacatgttttatagttgcaaagcttaattataataatccgcaaatctccatataacagcattaaacttcggatgatcatatcttggtcatacgaactctgaatcgacccgttcaagtctcctaatgtttgttataacctaaagaaccctgtgctttctttttatgtattgttattgcttctttataggtttgtagctttgcttgtgtgcttcgcgtagcttctgtcgttccggaggttcccgaagcgtggttcgcggtcgtcgccgaaggttcggaagtccgttctctctgagcaaggcaagtcacatcatccttgagcatattgaatcccagtttataaaattattttgatttaaattattgcattaccgctttatttaaattcccgcgttatcactgttttatttagccatgcctatttacctttgttatgaccttattattgttattgttattattattaccttgttcaccctagattaaacaaaacctcaactagtggacactctactcatggttccactagtatgaacttaggtagatgcttcgctggttaattaggcaacattaggtggtttttataactttagactttgggaattctcatatcatatggacactatggaattgttggtttatggtggaattggacatacacctctcttcccctttcaaaacccctaaaacctgttttcggtggggtttgggtgcatgccagttgtgggaagtagcaccccggccactataaggattaa

SEQ ID NO: 51269 - DNA, 505 bp, Oryza sativa
cgaattcgagctcggtaccctattctagggtgaacaaggtaataataaaaataacaataataataaggtcataacaaaggtaaataggcatggctaaataaaacagtgataacgcgggaatttaaataaagcgataatgcattaatttaaatcaaaataattttataaactaggattcaatatgttcaaggatgatgtgagttgccttgctcactttcccaaacgtcggcttcaacctccacgaagagcggatcttccgaagctgcagcgtctacacgaccaacggaaaagaaaaaggcttttactctaataaactccatataacaagtaggaacaaagcacaaaaatgggttcttgacttcttaaggaaaaattagagacttgaacggtccaattccgagttcaattggccaagttatggccatttgaagtttatatgctctttaaataaatatttaagaatttcttcatttaaattttaatttaaaaagggtttattgcgtca

SEQ ID NO: 51270 - DNA, 1501 bp, Oryza sativa
aaagccttgtggaggctatggccagttcagtttaaatcaatcaacaaccaacaacgcaattatccaatcgaatcgttctttcaatttcacatgtaccttcgtcctaggtttaatcctaatttatccattttgtcggtttgctctataagccatccttcatcgtgggagtgcaaattcttgtatttttttccccaaaccttttgttcctcccataagatgggtgtttatcctaatctatctaaatcggccctgttaaccatatttgatctctaaactcatcttgatcacgagcttcttaaggtcaaggtggttggcgacttaagtcaacaccacgaggctttagatgatttgtcgtggtgactgaaaaaagcgtcaacagattccactttacactaatataaaacaaaataagttttcttacgaacaatgtcgtgcatctatatgcaacagccggtttatccattattaaagagaaaatctacgctaagtgattaactatacgaatttccctcaacgagcattagttgtatgaattgccgccatgcacaagcgtttttcctctttgctatcgccatcagttgaccattagttaacctcgtgtcctttatttccatgaaaatgtacattttaccaaatacatatgagatactcttatgtactccttgtattggtatcgcacttctaagggtaatggacattttgacacattaacataggccaactaacgattaactgacggtgatggcaaaaaatgaagtaaacacttattggcatttcgattaatatgataatccttagaatccctaacttgtcaacagccaaaaagaaacaacatcagttgccgttgaaacacgaatggcccaggaggccatgaaaggacaacgccaagttgtgttgtcatccatcgatctgcaactgcaagtctgcaacaaccaacaagcagcattccgtaatccgtactcccgtattcataatttttcttcccccctgatattaagtatccatgtatgctcagattcagaagcttccaattgccatgtccagatcagccaacccaactgacaaggcatgtacatgctttctgaagaaacgctcgaacaaatacgcagttttctgtgcgtctgtcgtgagacagcctcgctactttccagggggcaccacctgatgccaaacacaagacctgacagcattgttactcgtgattagtagcagttgtaagtacaggattagtacctaatccggtggcttgatcaaacaggaggccgacttttgtgcaggcatccttccccaaagggtgacaagaaccctgtaaactatgtcttgggtttgcatggtgcatgagctaacgacaatgattttttctgttaaaaaatgggttaacgacaatgatccagacattagaggtagtttttttatttgacgaagataacccactcctgaatcctgatagacatgagcacagcaaacactgggggttgttctaaaagcaagatggcaagat

SEQ ID NO: 51271 - DNA, 448 bp, Oryza sativa
aagtagcgaaggaatttgcgaagattatatagaaatagatacattgcacaatttatctaccagagctttgctgctgaaaatgtgacttttttctttttaaaagatatgcctatgaatttctttgttcaaagatgtaaccaataattctgtaaatttccttatgaaattcaatatattatgcggtagcgttattcagcgcacttgcgcacggaacattgtttcgagcaccgcatgtcaaagcccagtgtccgcaaaaaccgtgttcggttgcccacgttcgtgccatgtagattagatctatttgaatcgcatggagctatatgaaggcgatgactcccccctgatacaagtcgctgaatcggtaaaactgctacaaccatttacgttgccggggaaaacctttagccaccttatttaccctgctgaatctgttctcattttgtgcagg

SEQ ID NO: 51272 - DNA, 1501 bp, Oryza sativa
ttttgtatgtgtgtgctgacatatttgttttgttctgaaaaacagaaatcgacagagaatgtgccaaaggattccggtgactcactaggcgaggcgaagagaagcattgctgggaatgaagttagggctgtagcacacaagttacctgagttccatgaagactactatggtcccagtgaccatacacctagacaccactgaagagaaaacaatctttttttttcttcttctcaatctttttgttcagaatagattagatattagctagtcagcggctgcaggttgtagtagatactgaatttcatctgagcttagttagtaagcacatgatggtagcaacatgtgaatctttaacctatctcttttttcccctccttttcacctcattagtgaaaaggagcggttttcatgtactgacttgttgacaatacttgaaagcaacaatctcaagacgttgtccatatctttttgtgattgtgtttgttcccatgatcagcgcagagcttaatgtgacgattacaaatccacaaggatgtcaataccatgatgtcgctgatataactggaattgacttcgtcagtatgattttcggcaaccgttgtgcaatgacaagaatcactgaatcaagcatactgacaagatgagagaagaacacacaattaagagtgcaagtgcttttatttctacatgacagcataagcgctttattattggcaatgtaaaagcagcaaaaggaaccatcaagtgagtagcctcacttaaaggctttgtttcacttaattatggtgaaaaatgcctgcaccgtaagggagtcatcgttaaagggcatatttgcaaacgaaaagtaatttgtgaataaaatttttatatacgtgctcttagcgatctaaaagtaaaggttaaaaaataaacttcgataaaaaaacctcaaaatcagtttcaaatttaaggttgaaaatttaaattttaactgataagtataatcataaacgaaaaagatgaggaactaagttgattagtttgcttaagaagtgtcgtttggtcggcattaagtaaaacaaattactccagatagctgcactacggcatttgataggcattaggcagtagtatgacagtacagtggtactaactccaacattccaagcgtacattgaggaaaggaaagcaaaacacgagtggtcggcattgccggatatgctgcagtgttcttcgccattgctgtagtctactttacatgtccacgcaggatggcacgccgattagagtattccatcaactgttccgttctccacatgcttaataatgatggcttgatgattgagaagctgattagccagccgcctccaaaaaaacacaaaagccacagataatgatgcagagaaagttgtccgtgacgttagcgagacaagaaacgggagaaaagaaagtgcaaaagtacgagattgtggcccaagagggaggtggccgaagcccacgtagccaatgtggcctagtaaca

SEQ ID NO: 51273 - DNA, 342 bp, Oryza sativa
cggcgcaacttggcttaaagcaagaagaagtctgcaggtttgtcccactccatacggagggagcagttgtgtgcactctgtactaatccacgtatggcgtcgaaaataaaaacgacaataacaacacactaacacgacattagcatgaggatgggggtttatggattggttcagctaaccgcccgaccgaccaaatgatgttgtgctttttcgtgttgaaagatgattaattaactcgatggcaggaaattctaaccaatgtgctgtgtagctaagatcatcggatggaacttttgttgattgattaggacgttggatatgctgcccatatgctgcttcagt

SEQ ID NO: 51274 - DNA, 1501 bp, Oryza sativa
ccaatcccaaaatttttagtgggctgtgtggtcctcaggttattggtcatctgttccttgtctctttcttcacaatttttctttgagaaaacattgatgtgttaatgttctattttttgggggtctgggttttatgtttgctgagaaacctgtgcctgtctcagtttcttatcagcaaaaaaggggaattcctacatttggtgaaagttactgtcttgcgtttctctacgaatattgtttgttttaagtagatggtttagcatcttgtctaagcaattcatgacggaattatgtttttcaatccgctcgtatgacagtgcatcgatttttttttcactggttttctttagcaagacatatcaagcattcccctttttcagttgctgggtgccaacagtgctattcccaatatatttcaagtatcacaagtgggatttgttttaaatgcctttccctgtcaagtatgtggtgcctctcgttatcccttgctccatccacaaatgatattttcagtaggttgctccttttgattcggtaggtacccgaatggtagttttgtccataattttgatttggttgccgacagttttctagttttgattagtgagtgtcaaatatcttctgtaattatctttatcttaaattgcaaatataactctactttctgttcgatgatcgtttttatcaatgtcaaataactgtaactgtaactgaaaaaagcagatagatatggatttgtggcaagaagatcaattgctgaagctcctgttgacgtaaatgtcactacaaacagttcctttgtcttggcgcaagagcgaacatatagaaaagaccccttgaatggattcaggaaatatactggcggttggaatattagcgaagtgcactatatggctgtaagaatgtttacaacctgaaattgcacctcattcatctacttgcataacaacatgtacttttttctgtttgcagtcagttggatacacagcttttccactgttcatcattgccttggtgtggtttgtgctgttttttctggttatgcttggaatttgctgcaagcattgctgttgtccacatcgcagttacacatactctcgggtagcatatgccctatctctgatacttctaatattgttcacttgtgctgcaatgtaagtactcttatatttcaaagctaatccattttcatgattccttacatttaatatatttttagctgcgtttactaacctagttccattcaatgcttacagtgttggatgtgtcatgctgtatgatggtcaaggaaagttccataaaagcacaacgactaccttgaattttgtcgttagccaggccaattttactgtcgaaaaccttaataacttatccgatagtttatctgctgcaaaaaaggttgacatagggcgatcctttttgcctaacgatgtgcaaaatcagatcaatgaaattcaaggaaagttgaactcatcagctactgagcttgctactagaacta

SEQ ID NO: 51275 - DNA, 729 bp, Oryza sativa
taaaatttaaatgaagaaattcgtaaatattcatttaaggagcatataaacttcaaatggccataacttggccatttgaactcggaattggaccgttcatgtctctaatttttccttaagaagtcaagaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgagcaaggcaagtcacatcatccttgaacatattgaatcccagtttataaaattattttgatctaaattattgcattatcgctttatttaaattcccgcgttatcactgttttatttagccatgcctatttacctttgttatgaccttattattattgttatttttattattaccttgttcaccctagaataaacaaaaccccaactagtgggtactctattcgtggttccactagtatgaatttaggtagatgcttcgctgtttaattaggcaacattaggtggttttataactctagacttttgggaatattcatatcacttggacattatggaatgattggattattgtggaattggatgcacaccttcccctctattcaaaaccctcaaaatggttttaggctgggttcggggtgcatggttttgatagtagcacctcggccatataaggaccagt

SEQ ID NO: 51276 - DNA, 506 bp, Oryza sativa
tagaaggggtgaggctcggaatctagatcgtctagcccaccaccttgtgtagctagccgaaagatccctgagagtttctctaactcgcaagctaatcaagggccaacctgagggagatttagattctgataaacaactagtgggatggaattcagctaaagagaatctgaaaaagtaaaaaaaaaagaactaacttttagcttttttttctatttttttttaaattctgtaactatagcttttatttggacaaaatgctaaactgtgaagactgaagagtaactttcaaattgtaggagaacctgcatcggccataacctcccccaaagcctaagaacgcgtgattaattagccagtaaactggggcacatgcagcatggagatcagcattgtactgctcttgcagctgactgaatccttttggtaattaattggtgctaccatacacattggccgtcagctttgacgcctggtgattcttcagcttaaattgcccttcgcccagg

SEQ ID NO: 51277 - DNA, 1501 bp, Oryza sativa
agaatttaatttttgaagcctaattttaaagttgattttaggggttcataaaagtctatcttttcaacatttgcttttaaagtttcaaaccgttaaaagattataaatataaatgttttatccgtaatcttttttatcatacgtttattgaagacaggtcctgtttagtacaacttcacatttcttatttatactggatttgaaatttgtatgctaaattatttataagtgaaacagaatagtttatcaaaatattattatatgatcatatattcagatccatattagatttgtaaaactaaaaacatccagcttaaagaaaatattactccatccgtaactgtatcaaacaaagtgaacggctaaaccgtagcttacacgaccctaactaaggcctggtttagttaccagcttttttttcaaactttcaacttttctatcacatcaaaactttcctacacacacaaacttccaacttttccgtctcatcatttcaatttcaattaaacttttaattttagcgtgaacaaacacaccctaaacctgaaaccaaagcctaatcttgtagcgtgtgtttgattctgggactaggtgggatgggatgataccattccagattttgggatgagatgattccattcgtatgtttgatttaaaggatggaatgaacccagttttttttgtttagtagaaggggcgaggaagggatggaatggccgccgtttgcagttaccgtcaagagagtttggtgaggtagcgcgagtcctcgtcgagcgccaccatcgcctgctctaatcggaccaatcggcagtgaccggtggccgggagagctagcacggccagcgagcaggctggctgcttgcgagagagcagcgggaggacgagcacgcggagaagaagtgacgacgctcatgccgtgcacctgatccattgctggatccgccgtcgccgagcaccccgccacccgctgccgtcgccgatcccgccgccgcttccctcgccctccccaccactggagcccgccatcgtcgccgtcgcccaagctgagcccgtcgccgttgctgtcacacgagctgtcttccaccatcacgccgagcacgcggacaataagcggcgagcagggcggcgagcacgcgagaagccgttgtgacgccgtttgctcatcccaagttggtccgtcatattttcccggatcagttggtcccggatctaagaagaatattcctctccaggaccaatccatcccactcacccctcaaccaaacacctctaaaaatgggttcatcctgttccattccatcccatcccagcaaccaaactcaaactctaccgtagagtttggttaactttggaggagaatttaggcgcaggagaaggcctcatctttccgcttatgctaatacttatccgtaaaaatttaaaattttcaaccttaaatttagagctgattttgattttttttattaaaatttattttttagtctttgcttctagatcacta

SEQ ID NO: 51278 - DNA, 260 bp, Oryza sativa
atcgttaggaaataataagttttttgaatttgtttgaatgtccagaccaaaaattcattgtttagtactttaacagagcaaacctttttttttgtaagtttctccttcaggcacccaaaagaaatagagctaatctttttcgttactggctcagatattgaatccgtactcaaatgaattagagaaacataagcagctcatccaccaccaaagttatcaaaactttggtccgacgactagcttacaacccacatgtcaga

SEQ ID NO: 51279 - DNA, 359 bp, Oryza sativa
atggtgcatcacatactcataaatataatagtctcatccaataaatttttacattccaacaatatacttcattaatttattatgtttcttcatagcaaagggcaaaatggactttttcaaaagaatttaacggtcaactaacggtcaactagcggaaagggcatagaagggatccaaactaaaattcagggatatgtaagggattgagcaaaattcagaggtatagaagggattaagtaaactttcatgggtacataggggattttctccaaattaaaaggaaattcacaaaaccagtctagaaaaacgaaaaaacaaaaacaaaacaaaagaagatcatatcaaaatgaacgcaagga

SEQ ID NO: 51280 - DNA, 247 bp, Oryza sativa
atccagaaggagaagacgtttggcttataccccagttgagctgcctgtgggagtggagccggagcttcgctagattttattttccgctgcagttttcttcatggtgaggactaagtgcctcttaagtaagtatttatccttttagttaatttgatgaatctgtatattaaattgtcagtttgtgtacctcggctgattcctggacgaggattttatgcacaaataaattcggaaattactagtgaat

SEQ ID NO: 51281 - DNA, 1501 bp, Oryza sativa
taaaattctcactagctagctgtttatcttttaatctcgacctcctcgagacaaggccactagcagagagagccgctgcactctagcgtgcattagagtgaaacctttggcgcaagtgctagagggatgacgtatgaaaatgtttggaatccgcaaaccgcgttcagatctcgacgacgacgacgaacaaactgcgttgtcgtgtagttgctcacactttccagcaggcgttgcggatgatgagagagagagagatgctgaaatgcgtatcgatcatatcatctcgtgcatcatctagtgaggcttgagctgtgttccatgccgtgcttgcacgtaagcataaacgggcagatcgatcgatccccgtatcgatcatatctcgcgtccgtttctttctcatgatcgatcatctcgacgcttcgaatcttggatgatcgccaagcgtcttcagatcctctcaaactcagaactttttagttcccaactttttttaaaaaaaactttcaactttaaactttcctacacacaaacttcaacgtttcggtcaatttctttaaacttttaattttaacgtggaactaaacacaccctcaaacgttaattcagagatgagataatctcatctcatgaatcattaagagccatcgttttgttattcatgcggcttatctgaataaaacttttatatatgtgttcttaacgatctaaaagtaaagattgaaaaataaaatttgatgaaaaaactcaaaatcaactttaaatttaagattgaaaattcaaattttggctgataagtataagcatgagcgaaaagatgatgcattttgtcttctttgatttattcatgatttcttttcattttctaatgaggatgaaaaacttgtctggttcatttctttattgcggagaagtggcccgagtagtaattgcaaagtaactcaaaacattttcaagctgaaactaacccaatttcattctctaaaactgagtaatggggattccttataataaaaaaaaagtagcagcagcagcgaaaaggcaggggaaacttagccgcgtaggtgaagtcaagagacgataatcaattaaagatgggggcaaaatcatctcgaaacttcacggaaaagaacagtaaattactcacagccacagacgctgacacgcacacataaagagcatttgctttcaggccaagcttcacggccgacctgtgaacatgcgcctctccacggagctaaacccatcatttttttcccacttttttaaacaaagattttcttttttgaaaagaagaggaagagatcattaaccaaccaactgaaaaaaaaaatcaagcatgcatgcttgatctgcatcagtaaaattcgcataactgaacaaaggattttgattgaatttaattgaactgatccattcattcctctgaggaaaaaaacacacaaaggagtacagatactagtagagtagtagaaaagcaaagagcacatcacacatggcttcc

SEQ ID NO: 51282 - DNA, 560 bp, Oryza sativa
ccacattgccatgatattgatgacatgatttgtgaaaggaaaataaagtgaaacaattgttttcgactggggcggctggaggatttgggtggtgtccggaaaaggctagtgccgtccctggtcagttaaggaccgagctatgaagttaagcatgaaacgacccccgtacaaccgcacttctcgtatgggtatagacctagcggagtagatagctgagcggaggcattatccatgcatagtggtttcttgatgtgtgaggcaggggctctacggtggggctgccattggtagaaccgcgaggcgggtgtctacagtggtgtcgccatcggtaggactgccatgtgagaatttaaacataattataacttaatgcatgtatgagtctttccttcccgggtgcgccagaactcctctcactgctagaaaccgtgtacgcctagagtgcatgaggatgtaaagttcatggagtgggtactgccaatgcgaggttatcgaaaagctttgtcgtgacgcgtctcatgtgttgggacgaggctcatgtgttgggcagtcaccgagca

SEQ ID NO: 51283 - DNA, 277 bp, Oryza sativa
cccactccatgaactttacatcctcatgcactctaggcgtacacggtttctagcagtgagaggagttctggcgcacccgggaaggaaagactcatacatgcattaagttataattatgtttaaattctcacatggcagtcctaccgatggcgacaccactgtagacacccgcctcgcggttctaccaatggcagccccaccgtagagcccctgcctcacacatcaagaaaccactatgcatggataatgcctccgctcagctatctactccgctagg

SEQ ID NO: 51284 - DNA, 1501 bp, Oryza sativa
gaatggcatgtggcgactcgtgccagctccttccttcctgatgctgacggatcactggaaattaaagcgatcgctgcagcttgtaataaagcaaataagagaagagtatactagtaactgatagtttacacattattaaagtggaagattagtgatgattaattaatactaagcagacaaaatcagtcctgaaagtcagcattgttgatttgttagtactgctatataatagtactactgtagtgttatatatggtcttgtaatcttcgattatatatggcacaaattaatcagatccttttgttaccggcgacggcgagcaagaggatgaattcgctggcgcgtcggcgaggacagcgccgcagcggcagcatgacggcggcagctgctgttctctcacagaggacgcgcgtacagcgcccgttggttgggcccgaacgggaatccaagtacgtgcggcccatgttagtacctaagtacatgcggcttatattagttgggccggaacggggatgaagtggttggaacttggatgtcaaacgggtccgcgccgttcctgcctcgctgccgcctgccgtctccccgggcccatctttgccgccgcggaactccgccgggctatcgccgtgcttccccactacggccgccgtcaccgccctcctcctctcccgcctcaccccattgacgcccacgcacgcccacacctccccatcaacgctcgcgctgttcccgcctcgctgccacctgtcacctcctgttaacgaccaaaattggtagcatcgacacctccctgggcccatctttggctgccgcggaactccgccgggctaccgtcgtgcttccccactgcagccgccgccgccgccgccgtggcgccgcctcctcctctcccgcctcaccctactgactagcctacagacacaaagagagagaggaggaatcgaggaagagaagaggtagagagagatggctaagccaccatgtatgataaaaccggggtcaaaaccaccgaatgatctattgtgaccggttttgactagttaagggatgccggatatctggttttgcggttgggggatgattttgtaacttgatgacaagttgagggaccttcggtgtactttttccgaaagtatttaggccgaaagagtgtgtacgtgaggcccattttagtagctgggccggaagtcaacgagtcaaatactgcacaatgacaagaataccctcgccaaaccaccacctcctcctccacctccacgccgcctttcattcgaactcttgggaggtttccattcaagaccagtgctcgctgcgagtcccgacgcggcggcggcggcggagccgctctcctcacccgctcgcaatcgctgctccgttcgccgcctcacatccatggtgctcacctgcgcctcctcctccaaaccctaaccctcccgtttcctcgccttctcacctcgcctctgcattcaatccctgcaggattccaccccggctcctgccg

SEQ ID NO: 51285 - DNA, 1501 bp, Oryza sativa
agctctaagcaccttgaacctatgaacagatacaatcaaataactgtataaaattcaattcaactcagtaaaatacaatatcattcaaaactactactacctaaaagcacacaccaattaacttcaggactaaaagatagttttttgcctgtccatggactaactcatgtaaccacggtgtgagtaccaaatgtgaactaggttacatattcaataataattcttaaaaggtaaaagtacccagcagccatccaagtgcgcatttgaaatgtgagtgctggaacttgaatctattcccatttctcaaaggaaactggcaagttaaaactaataccatctgggaagtttgagatttggaggaagagcatatccatcactccaggttcacaaaacgtatgcgccccaccatctgaagctattgcaataagagacaggagctcaaaacattcttcagtaattgccagatcagacctgcacacgagttgggtagagtcataagcaaatgagttatgcagagcaagcatcccaactgaaatacagaatcggaggactactcaagcaagcatactcagttaggtagcattgttcacttgcacaattgcaaaatgttgcaacgtctgctgcttcaactacactggttttacctagcctgagtatcaatcagaacgtggtagatagcgaatttacttacgatttggagacgatctcggcgatgaggggcacagtggagacgaccccctcgtcggcggcaacctctgggaatcgagcaagcccggaaagcaccgtcaccgagagacgcaggtacgcctccctgtcctcctccttgccgccctccactttccccagccctgcatccaacaacgcgaacaaaaacccagtgacgaagaggaaccatgcctacactggagacaagcgctcccacgaggcgcggcaattctaccggtgttgaggaggcggcggaggaaccggggcccgacggcgcggtacacctcgacgacggaggcggcgtcgccggcgcggcagaggttggcggcgacgaggaggcccgccagcttctgctcgtcgcgctccccgcggaggaggcggaggcattcctcgaacgccggggcggtggtcggcgtctccgcggcggcggcggcaggagccggggtggaatcctgcagggattgaatgcagaggcgaggtgagaaggcgaggaaacgggagggttagggtttggaggaggaggcgcaggtgagcaccatggatgtgaggcggcgaacggagcagcgattgcgagcgggtgaggagagcggctccgccgccgccgccgcgtcgggactcgcagcgagcactggtcttgaatggaaacctcccaagagttcgaatgaaaggcggcgtggaggtggaggaggaggtggtggtttggcgagggtattcttgtcattgtgcagtatttgactcgttgacttccggcccagctactaaaatgggcctcacgtacacactctttcggcctaaa

SEQ ID NO: 51286 - DNA, 262 bp, Oryza sativa
cacgcaggaagcctgcatctccccaaagacccacttatacctactctaccatcatccatgaggagtagccctgagcccctgacccggtctccatctcctggctgggtctatataatataaccatcacccagggcgtctctctcaatcataccatcacaaacaccaactgcaactggagtagatagcgctacctctctccgggctgaaagctactggccattatcattgttcttccagccatggatcagctgctggccctggc

SEQ ID NO: 51287 - DNA, 161 bp, Oryza sativa
ttgggaattctaatatcatttggacactttggaactgtagcttgcatgcctgcaattggacacacacctctcccctttcaaaacccctaaaacctgttttcggtggggtttgggtgcatgccagttgtgggaagtagcaccccggccactataaggattaa

SEQ ID NO: 51288 - DNA, 325 bp, Oryza sativa
aatgctatttctttcttctgtcattaagcccatcaccccaattatttctagcctttggatgatatagatctatggtgcaaattgtctcttctttcttctctcataacaccaggcaatctcaattatttttaggctcaaaattcataagtatcaatttgttttagtttaataatcatattgcatcttatttgtacatattatgcaacttaatttcccgcagcaatgcggtgtggtattcatctagtaattataacaaatattttaaataaaacaaattggcactgcatgcaggtgctgtatgtcagaccatccgtgagagcaccat

SEQ ID NO: 51289 - DNA, 326 bp, Oryza sativa
cgcagataacgaagaagcgtcgagctgtctcaaatttaaagaatagagacacttagacagacacacacacgcagcaaaaaagagaaggccatcaaaattgatagatagatggctcgttcatccctccaaaggccatcttttctagaagattaatccccacgtatgaactgaagtgatgatcagttaagctgtaaatctggctagattaattggaccgtatctacatgcctagctgtgtacaaatctaaacacattcataaacacgatgtgtaatccaaataagaggaagatagatacctttcatgatactcctaattgataccaga

SEQ ID NO: 51290 - DNA, 207 bp, Oryza sativa
gttaagataaaaatcatgtaacccctgatttatattaatgaaatggttataatgtagaacctgctctaccttcttacgtcaaaaattatgcctataattagcaccattggtggcccacgaagctctctccgccacatatttatatagctcctttactctcatccatgcactatataatagggacatcagggcaagggaagtcatctt

SEQ ID NO: 51291 - DNA, 1358 bp, Oryza sativa
ccccgcttgttaaactctgaaatgtatcaacttttggtgtaccttgcctcctgggacaaggaataatacacgcacgtaaggaacgcccgttgggttatttccggtcgtgacaagttggtatcagagccccctttgaccctaggacgagccgtagatcccaagccttagcaatattttcaaaaataaaaaaaaatcctgtcttatttgtgaaaatcctctagtctctctctgtcctgttgcttcatttatcgccaaaatctgacctttaaaatgttgtttttctttttgtttttgtttgtagatggccggcagcatcagccgtcgtggtctggacctgactggtttcgtcttggagctgcggggcatgtgcgttgtcctggggtatccacatggagtggactaccagggcaggccgcttccggagcaggagggtgacgatgcagagccccacgctgcttgggaggttactgcagtgatcctcactggctctcccgagcggacttcgttggcagtcaccgcgggtggagattctttccccgccgcttgccagaacgccgctctcctcgccatcggcactcttcaccagcgctacccggacgagttgcagcactcgccctaccgctaccaccctcgccgcggaggagcccgcgacttcgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaagagaatctgcagctgaagaaggaactagacgcagtggaggcgcagctgcatcagctcaagatcgcccagggagaggtctgtcgccccaagcgtcgccgcgtctgccgcagccagaagatcaccgcccgcaagagcacctccaggcccgagcttgttcgtcagtccctggcgtggacttgcttcgtcgagacccctcgtgccgagcccgcgcccgtggttcctcaggagggggaagcctccggcgttggtagcacggaggatgcgctgttgctcaccttccgtcctggcccgtcgcagcggtagacgagcagttagtaggcttgcgcgtgtattctttctcgtttgtcttcttgttggagtcgtgtggggcatggttatgccggtgtgtggtataactgtgtcggagcctgtctttattttatttgcttaagcaacttgaactttaatgaactaatttaatagcagtaataaattcaagaattatggtagtcgtgggtggttagctttaattgtcagctctctctgtttgctggtcctgtgtggggttttc

SEQ ID NO: 51292 - DNA, 1501 bp, Oryza sativa
gttgagacccttgatctcttatttatttatttactccttgcagggccagtttacaatacgtacattttcagaaagcagctccaaacaggatcttgcattggatttagcttcagcaggatgatatactgcaaaaaaaaaaaggaaaaaagaaaaaagggttaaatacctactcttgtttgagaaggattttaatgacagaaggattgcaatgacaagatcaggatcacactgtaaatggtgaaagaagagcaacagcaacagggcttcacatcatattcttattcaccaaatctctctttggattccagtcacatttgcccacccactaagggtgaccggtaaaaaatgaggtgtcctttctccatcttaaattcggtccgtggtatgaacccaagattttcctccccctctatcctggtttctgcgacaactcagaattggattgttcgtcgtgtaagatttttgatcacgtatttttgttttcgcagtgttgttatcatctgtctagtcaatgaatggtgctgggattacgcagctaatacagcaaggcagccagttggtgtgggtgggtgccacaaataatgcagaatggcagccacaaccaggatgctccaaagtggctggtccctgtcttgttcgccatgaacatgaaatgcattggaggaaagctctgttgatagaaacagcacacaaacacataatggaggatcaaaagcgattgagaggtattattttccttctttgcactaagtcaaaccttgttactttcatgcacatttgccagattttgatttgctgcaggcactcagtgtggtcttgtttgtggaaaaagatatgcgagtacgattaatggattcattttttttaatctcttgttctattccaatatgcatggaaagtacatcgagacagctctgttatcgccttaaaaattaatgcacaaataaacattatctttttttaaaaaaatagtaggaataataatgagaaatgtggtgatatttgtcacgtcaggttggtcataacaaaagttaaaattcggtagaaattcctctcacgtggggccacaggaatcacataaaaacatactgatatatcctatatccatcagcctacaggcagctatgtatagaggtagctgagcaattggcatggccatgcgttagagagagagagagagagagagtgcatgagcatgatgagctctccttctccctctccttaatttagacataaacttaattagctatgccgctcctctctctaatctcccctccaaagattatggttggtaggagatggatgagttcctgatcatcttcttgctctaaaatggaaggtttccaatggattccagcttctgaatcttgcagctagctaggtaggtaggtagctggtagcttagctaggcagtcaggcagatggtgtgttgttgcttctgctgtgatcgctcgcatacgtagataaggttagaggttgatcgctcggtagatggtactga

SEQ ID NO: 51293 - DNA, 1501 bp, Oryza sativa
cgcgcgcgcggggaggagaccgaatgggccgcggggaagaggggagagagggaaagggatgggccgagccggcccaagagggagagggggagggaaagggaactttttagggtttttctttttataaaaccattttaactttgtttatttcttcttaaatattatttgtgctctgaaaattccactaaaatttatttacgcattttaggcttttaggaaatatacaaaaatcctccaagccttatttgacttttaactttgcacattttaattgttggaggctttcacatggattttaattattctaggcataatttcaaggatgtattttagagtcgttttgggacgcgacattcgagcatatcggctttgcatcttctcggaggttgttgatgtggtctaacccctcgtttgataggtagctgatgttcaacaatcgatcggctgagtcctggcatctcataatactcccaagcaaagcaatatctgaattcctttaacagctctatcaacttggttctaaattctgaagataagtcttactgataaatctcggccttggtcgatcacctggaccaatgtcaatctcttccaaatcatcggccgacatgaaaccctgtccttgcttgtcatcgagatcatctactatgtccttggtgtagacgtttgaaccctccacgacgccctcaaaataatagcttgggctctccatcttcaattggctgtttatcacaatcggacacttttagaaaatctccatcccaaacttttctagataagcaatcgagaccatccatctcccaaagagctaaattggcactggcaacgttgactgacctgtcggctggcacgatttcaatcttgtcgccttgccactgaatcaagcattgatgcatggttgaaggaatacaacaattggcatgaatccaatccctaccaagcaacaagctgtaagaacccttcccaccgatgacaaagaatgttgtagggacagttttgctaccgactgtcagttccacattcaaaactcctttggtttctgatgtattgccaccaaaatctttgagcgctgttgtcgaaacaacaactgcatacgttgaaagacgtggttactcaacggtggttggaaagaaagtaaagtgtattgaattgagaatttttcttaggatccccctgttacatgaccctaggagactatttatagccttattacaggttcttgctactagggtttaggttatacaggggaatttacttggctgcccttatgaaagggacatttatgtgggtatacagtgtaattgaggtacatgggctcctaatgggccgtcaggcgattgttggctcaaaggccactgggccttcgtgaggccgaacttgctatggcgaagtcgtctcccttcgacatacactcttcgccttacatccttcgcccaagaggtctttggctctgcgaggcacccgcgctattctccgcccttcgcggtctttgctccatagt

SEQ ID NO: 51294 - DNA, 277 bp, Oryza sativa
cggagcaccatgattcccgggtattcccgggaatacccaacttttttatcgaaaaacaagtatatttctaatatatacatatgtacacatattagtgcacctaaatcctcaattattcgatccaaacatagccctatacacatgtacatatattagtgcacctaaatcctcaattcttcgatcaaacacagcccaaccggcctatatgacccatcagacatcagttgatccacttagccacccctcttccagacggccccctctcgctctccctcca

SEQ ID NO: 51295 - DNA, 590 bp, Oryza sativa
gccaagaagaaaggactcgtcgatgttgctcgtgtttttagcgacgacgagtcttttgacgaaaccccgacttcgcccgccagtcgcagcttagatctttcgaccgcccccgttgtttcgatcgacgctggcggcgcaggtggcagtgccgccgctggggcctcagcctccgctgatcgtgtcgtgaaggctgcagctagggttttcggaagccctttgcgtctgccagttgtttcgccgctagagaagccgaaggggaaggggggggcccatcgaaacatctgcctcggagtattctctcgcggcgccccacttcgcccccggcgattttgagacccgggcggaacttattccctttgttgagggggtaagcaaccttgtctctcctgccggcaccccgagcctattcaccgagctgaatgagttcgacgaagggtgttctgctattaaaagcttggcagttcgggtatgctattcgctctctcttcttgtttgtctttattttcatattacagatcccacaactaacatttgctctcttcatccgttttaccttacatccaaattcttgcggctcattgttcgacaga

SEQ ID NO: 51296 - DNA, 321 bp, Oryza sativa
ggggggggggggtctagctgctagctatccctggcagtgacgctgcagtactgggtgccccggccggagtgatctgtcgtccagtgcaggtacacgacgagttccaactaagacgcaggtggctcgagatgtacacagtaacacactggtacgtcgtaccacctatccatcggtagcgagcacgtctccgcgccgcgcggtgctgcatgcatgtgtctccatctgcagccttgcaggtttttcgttcagatcaatcagggggggctgctctcccgttttccttcagggtgattgatcacactggccgtcgatttccaaagg

SEQ ID NO: 51297 - DNA, 334 bp, Oryza sativa
gcttttgtttcggtgtgagaactaagtgccttttctgtaagtatttacgcttttattgacgttcgggactgtaaattacttgtcgttttgtggaccctgggtggtcctggacagggatttaatacacaaaatagtttggaaatttgggctaaatttctgggcgtgacaaagtggtatcagagccaacttgactgtaggttgagccaaatggtcaaaccgtaaggacaagttttttgaaaatcctatttgcgaagtgtctcctctcgcccttcggcatttctttgcgaaacagtttattaaaatttttcctccctgtccctccaactcttttagt

SEQ ID NO: 51298 - DNA, 1061 bp, Oryza sativa
cattgctcggtaagtttccattagggcttgattttgcttgtccaaatgcctgcagatcccttgtaagtagtgtaatgaactaaaatcctcaagaattaagggacggaaaagaaattcttacttggacatttcagctgaatgctttggttccattctcaccaacagcctgataccagttcctgcaaattgctttacattttaaaaatcatttaaaagcaagctagaaagttgaccgttattttatattaattgaggaattctgagttcacgccttgagggtgcagtgaggatggaatcgtactgctacattatgatctcattcaaaaaaaaatgaaacaaatatatgcaattgtatttgtttcttacgcataggagagctgccctggtaccctaggatgcaaggctcaattcagcaatgaacgacacatgaatgacatgattatttgatttgacatctaaaaacattgcacatatagtccgatgtcatcttgtcattctggttttctagaatcaagacacattttgttctctctttattggaaatttaaaagaactaagaaatagctaagatgaaaaaaaaaacaacatgtaatcaaatggacatggcaggctgctatttgacatggctatatttcaacggaacacaaagctcgttgaggtgctagagaacagtttacatactacacgggcccagtaaattttcgtgggggcatggacacatcacgagttattaacaccactgttcataaatcatagtagtatagtattattttgagaatatcatgcgtccaaaatatcctataggcacagttgcaatacaatctgcaggggcaatggcgggactaacatgggggcaatggggttgagatgaaccctaaataacaggaatcggcgtatgaaggggatgggctaattggagggaaactgggggaaaaaaaatcgatctcctatctacgcgacgctgactcatgaagtgggcgccgaggagggaggagggatacgagagaagaaccaataataccttagttcgattcgagcagcgatggaggccggccgtgcgc

SEQ ID NO: 51299 - DNA, 1501 bp, Oryza sativa
atgcctatttacctttgttatgaccttattattgttattgatattattaccttgttcaccctagaataaacaaaaccccaactagtgggcattctactcatggtaccactagtatgaatttaggtagatgcttcgtcgcttaattaggcaacattaggtggttttataacattaggctgggctcggggtgcatggttttgatagtagcacctcggccatataaggaccggtcttcgggcctctgttgcaaagcactaccgtacttccacatgtctagtgggtaaggcttagtttttggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcttacctgtctcggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccctagcaatgtacccaagttagtgttttaattcttaaagcctgcttaacaactaaaatgtggaatggttggcctaggttggcttgggacgagctgggaccccagggtcaggttgccagttcggtctgaatcatcgtaggccttgggttaagacaggttcgtgtgggttcacggccttgattaataatgttgcatagctcgaggattgtatttacaaaatagctttgagcaactaaatgtctttaatgctgtttactgcaaaacctaacccgtatactttaacccctttgtactccctccatttatgtttcacttgtgggtgtgtcttgttgagtacggtggttgtactcagtcttgctcaattttttcccaaacccagaagaggagttcctggaagatgaaggctttggtgtctagctcgtgcctgctgtcaagcgcctgtggtcatcgccctagtcttccgctgtttcccgtttgtctttgtgtgtgctgggccttcgccgccaatgtaataaagtaactatttatgcttccacttgataaactctgaaatgtatcaacttttggtgtaccttgcctcctaggacaaggaataatacacgcacgtaaggaacgcccgttgggttatttccggtcgtgacaagttggtatcagagcccccttgaccctaggacgagccttagatcccaagccttagcaatatttttgaaataaaaatcctttcttatttgtgaaaatcctctagtctctctctgtcctgctgcttcatttatcgtcaatatctgacctttaaaatgttgcttttctcttttgtttttgtttgtaga

SEQ ID NO: 51300 - DNA, 152 bp, Oryza sativa
ttttggagaaatcgtaatttgatatctgtggtacacctattcacaagtccgtaagttaaaaataacagggcctaataagagacgatgcacttaagtacttaacaagttaacatgcataacgttagggtattttgattttctcatcgtgcagc

SEQ ID NO: 51301 - DNA, 367 bp, Oryza sativa
ctacattgttttttttcacggttattcatgtagcatgaaaagcaagaaaatattccttgtcttgttcggtttggaggggattgaaagggattgaggaagaataatttcacatcattatagagttggaaaaaagtacccttaaattcctctcttttgggagttgacgaacaaggcttttaagaacgtgttaggttaatcctcacgagaaaggtatcggagggaattgaaatagattaattccacatctcaatagaataattccacacacctaattcttagggacggattaagtgaaaaaaaatagggatgaaattaattgatatcccccaaaaatgtcatcgtgaatatatattttttttaaaaaaaa

SEQ ID NO: 51302 - DNA, 197 bp, Oryza sativa
tcacttgatactttgaaagtatcaccttctacgtggtaagaatcatatgataccttacaagtatcacctgatacttcacaagcatcacatgatacgtgataggaatcgcctaataccttataggtatcaggtatcacctgatacctcgcaagtatcgcctgataccggtaaggtatcaggacctaatacctaacatg

SEQ ID NO: 51303 - DNA, 311 bp, Oryza sativa
tgtgacttgtcttgctcgctttcccaaacgccggcttcaacttccacgaagagcggatcttccgaagctgcagcgtctacacgaccaatggaaaagaaaaggcttttactctaataaactccatataaccagcagaaacaaagcacaaaaatgggttcttgacttcttaaggaaaaattagagacttgaacggtccaattccgagttcaaatggccaagttatggccatttgaagtttatatgctctttaaatggatttgcgaatttcttcatttaaattttaatttaaaaattggatttattgcgtcagc

SEQ ID NO: 51304 - DNA, 273 bp, Oryza sativa
cgacgctgctcgcccactgcacccacagctcgattcgactcctcgccgaatagtttgagaatggaaggggttcagcgagagagagagaagtgttgggagagagactcattgcgttgagattcccacataacacgtgccacgctagtaacgaagtccttttgacttggtaaaggacttgggtcttgtgtaattttcttccctggtcgtggccttgacctcctggcctaacgcccatgacagaggatcagtagcttcattgttactacctccaga

SEQ ID NO: 51305 - DNA, 170 bp, Oryza sativa
atcatatcattgtttgataaaatttaaatatatagatacatttagtttgttacttaaatactagtattggtaacatataaaattttttggcacaacataattccatcctactaaatttggtaattctgccaacttaattaaaatttgacattcacaaatttttggtaagg

SEQ ID NO: 51306 - DNA, 222 bp, Oryza sativa
tttagatcaaccaaccaaggaagaatttgaaatttaagtctacagaaattcaaaagctacttcagttgagtaatcaaaatagtgaagcgatgttcaagattagtatagtagtgtgtgtgcatacctacttgatttctctcaaagttaaacattgtctttcagtataccaaattgttgtagagctgacttaaggttatctggaccatatccctcgattgaagt

SEQ ID NO: 51307 - DNA, 236 bp, Oryza sativa
attcctgcagcccttaaaatgtgtcacatcagtattatattagttttttatgagataaagggagtactaggcagcaggccagcagctagcatctgctattacttgaactgtcgtagtttcagcatttggctgttggtgagttgatccaaatggccaagagcccaagaccgaggcatgtatggatgcatcatgcatgccagggtgagataaaccgaaagctcattggtcattgcaga

SEQ ID NO: 51308 - DNA, 526 bp, Oryza sativa
tacctccggttcattgggtctacatgttccgagctctcttgggctgcacgcctgttcgctttcgcggcctcgtccggagatatgacgtctaagcccaaactgggttgggcttcctgatacggaaaagaaaaaaaaagacggatttgctagaaaaattacaatttttttccttccctggttttcgaattttcgaccgtacgatgatgcgccaagatttgtgctacactagacacattttagttattgtgagttacaataactatattacgtagttacaatgagttacaacgtagtagtcataattgtacattataacttctatgatttatgcataagaagttgcatatttttaaaaaatacttatatacaagctatattttagttgtagtatagttatggtagaacaatattattacatttgaaagtttttcgctcaaaaacttgtggcaatttttagatagtaaaagaaaagagaagacttttaaggacataagctcatctttgttttaataaaaacaacacgagt

SEQ ID NO: 51309 - DNA, 357 bp, Oryza sativa
attacctcattccaaaatataacaagttttaattatatatctgaataagtgtagttgtttgatagccatctataacacggtctttacctactttttttggttttatcactaacatgtctacaaaacacttaaatggccgttgcttaaaacagagtcatcatcctgtgttcaataatcaactttataggtctaattttgaactaaaaacttgtttataatcccaagtacctgcttacaaaaactaataaatcgccgtgcaacttttttaaaaaaatatagttaaaacaaaatgaatggctcaatgcgtgcacttccattcggagacctatatataaacacacgcacacacttatcagt

SEQ ID NO: 51310 - DNA, 268 bp, Oryza sativa
taaacaaaaccccaactagtggacactctactcatcgtaccactagtatgattttaggtagatgcttcgctatttaatttggtaacattaggtggttttacaactctagactttgggatattctcatcacctggacactatggaattgttggattattgtggaattggattcacacctccccctctattcaaaatcctcaaaatggttttaggctgggctcggggtgcatggttttgatagtagcacctcggccatataaggaccggt

SEQ ID NO: 51311 - DNA, 509 bp, Oryza sativa
  unsure (1)..(509): unsure at all n locations
acattttgaggttgacagcatatgtaaacatgaaaatcatacagagaaatcccataaccatgtcaagtccaatggaagtggtagaatcacccaggcaagatgatggcttctaggttgaccaatgctgcatcatgtaagaacttgagaaacaattttggagcaggaaacccatatgggcctcccaattacccgttttattccgttaatcccacctatttatatttctaattgagcccccatataatgtttaacatctcattcttctactctctttgctccctaatagttgcctctatgacaacacacagaaagtagaattgcataactccaatatagacaaagatgatactcatgtgcagaagggcagaattatacaagctctacctctaaagagatctgataatacaagaccaaggctagttaactaaactagcanntaccattgattatacaatttcgttctttcccctactttgatgtccaatattgattttgcccatgtttttagg

SEQ ID NO: 51312 - DNA, 364 bp, Oryza sativa
cttgtcaactgttctcttttttggggggtttacctggtagtagttttcatcagttcttactcttctctgagtgtactactgttgaacgtctgaatatgtccaagaaatgtgtaatacatcctgtttggtatgatcttgaataacttacaaaatgcagatgttaaataacagagaaatattctcctgtttggtttagtactgtaattatagaaactatatttctcgatcccattatataggcccatttattccaaatagcctagatgctagatgcacaaaatctactgttcatttaggcacaggctgcttgttcttttctcgtttcctgacttatcacttacgagaactgttccatctttgcagc

SEQ ID NO: 51313 - DNA, 1076 bp, Oryza sativa
taacaaatagcttagaacatgtggtctaggcacacagtagaagaaatatttttgagaaaacatatttttagaggcatggagcaaataatctgcagaaataatcctgtgaattagttgaaaagaatggggcctagcttaaaatggataacgagttacactggtcaagcccacagagttaatacttaatacaacttacttagcttctgactcgctgctcctatcactggatgtagcatttgtgttcgaacagaagaaagtcttcccctgaaaagcatttcctttgtcattaccatttagagaatatgtaaaagtcagaaaaccgcatgtttcatgctttagttgtacaaaattccgggtttacaggcgagtggcacttaaccccatgttttaagctgcaagagatccagttaggaaagcttaaacggcataaaagacacacaaatttgcgaccagcctagtagtgactacacaacctaactagtgtttctacagtaaggtaagggcacatgtagaccaattttcagagcaccaaggaaatgaattctcaccaacacaaaccctaatagatgttatagagatcaagagctgtaacagaactaaccaaatggttcacatgagaggtaacagcttctgcttcgtgcctccttgaagcgagtgaattttgacctgataagtaacagtgcataataattcaagcagtgaaaacagagagaaggcgaccaaatcaaacttccaaaaatgcaaattctcttttcaatcaaacacctcgaagaaatctacagaataagtaactcatgcccagatcccaaactccaattaattccatggcaaacacacaaggcagcagcccagtctcttgtcttcccaaagctagcgagcaagtgagagctaggcggaaaccaccataactctttatctccaatacgtatacagccaaaccctacgccatcctttgcatcccgatgatctcgagctcaaatcgctgtagcatgcgcggcagattttccggagattcacgatgagggagggagaggagagagacggagcaagcggagcccgaaccatgccattctaga

SEQ ID NO: 51314 - DNA, 164 bp, Oryza sativa
acgtacaggagaaaacggcaaggaagcaggcaatatcatatccggtcaagtgtgaggtgtggaggatggaggccggccggtgccgtgcgtggtccaggccgtgctagcgcctagcgcccggcccgatcgatcgatcgagaccacgcgcgccttccgtttctaga

SEQ ID NO: 51315 - DNA, 349 bp, Oryza sativa
atggtggaatggagggtgagagcgcgcttagaagctttgctctgaaacaagcttctgaggctgtctaaataggattcgccaccctgcaaagatcctaaagttaaaatatctctcgaagtgaacagtattgaacagtaatttaaacagtaaactgaatagtgtttttgaatagtgtttctttgaaaggcaatcttactgtatatttatttccaaaattagttatggcatctcttagttgaattattttagcagtattactgtcttttaatgttatatatatatatatatatatatatatgtatgtatgtacgtacggatgcaccgtacgccgttgcgttgcgttggatca

SEQ ID NO: 51316 - DNA, 1501 bp, Oryza sativa
cgattactattggatatgtgctattcataaccctgatagaagcctccgacttcaatgcaaatgatcgacttgatgttctcaaccgaagaccttggaatatcagtttttgtgctcgcttaaccattctcggacaaccgaggaggtgaggagaatgtgacttaattccttatcttgccgtaatcaagaatttggattgaagtcagaaaattttgtctcagcgggtacagcgttactttattccgtaatccttgtcgaactccaccaaccattctcgagtaatcgagtagttataaagtccgcgacaaagccctgaagtctgacattcctgaaatcaaaactcaaaacaaattgttagatacaaatagcccccgagcgaacgctcaagggtaacacgatataatatgaatttgaaaattgaaaataaattgaatttgcatgtgacaataaaagagtattctagctaaagctgtactcaataattggagtatggtacacttcctagccctcacctgtctttatggaaaagtcatttttccacaaaggcagcttaaatcttataacaaaccaagttgaagctaacaaaatcctagcccctagccatgaagttgggaaagccaattcccgattacacggcttagttaatatgcatttagaatagcgtaaaggaataataggacgacttcaagatagggcgatataagaaaaggggatcaacggaaaaatattgcacatacaaacacttacagaatttgacgcaaatgggttgatgaggtcactaccacacaaggcgaagaccgagtgtgtagttgtattcaataaatcatagaggtagtgggagaatcgctacgccgctgatgatcgaagaccagctgtaatcatacctcaaccactaggagttgaggtgcgaggaccgctacgtcactggtcgaaagaccagttgtagtcatcgtctagactaatagaagttgagtgataggtggcggaagattgctatgaccgactagtcgacaaccaggagtaggaatctctcgatcacctatagacaactgatagatggcgagaaatcgctacaaccgactggtcgaaaaccaggagtaggcatctctcaatcacctgaagagaactgataggtggcaagaaatcgctacaaccgactggtcgaaaactaggaggaggcatctctgaatcacctaaagagaactaataggtggagagaaatcactacaaccgactggtcgaaaaccaggagtaggcatctctcgaccacctgaaggcaaccgaagtcgtcgactagtttgttgtcagagaatccatctcttgaacccatctcgtcaaaaccttggagcaccaaaattcccctacctggcgcgccactgtcgacattttaggtcatgattatggtatttgcatggtatgggggtcgttggtaccagggtatatgtgagattgaggtaaaagagacatagacaaggatttttatacaggtttgggccccttcaca

SEQ ID NO: 51317 - DNA, 174 bp, Oryza sativa
actttccccattccccgctacagtgcaaaaccacaccagcggaactagggttcaccgattcgctcaaatccgccttccaaaactccacagaaatcttccgcgcatccaccgcatcgatcccccatccattcccagccatttccaaagcaaatcgcatcatccaattcacatcca

SEQ ID NO: 51318 - DNA, 369 bp, Oryza sativa
attttagactgaaatcagctctaagcgcaaaatgtgtgttggagatgaagtacatcaacaaagcattgcacatattttcttgacacttcgctctttctttttaaggaattgcttattattcattgttaacaaattttagacaggttatgcaagaagctgctaggttcacatttgtaccttttggacttcgaaatgcactagcgtactgtcaccacacaatgcagtgcagaactaactttagtaaaattaagagttttgagctccatctgaactccttttcaagagaaaagctctgtcccaagcaaaggcatggtagagtaatcattgcagcttaccatcaaaccaggtgcattctccatacaatgacaa

SEQ ID NO: 51319 - DNA, 560 bp, Oryza sativa
cttacgtcaccgccaacagatagctttgccctcatggttggccgacaccgctactgtttatgagtgacctcgtctttgccatatgtttcctctactactgccaataggaattcatggccatgagcctatctcctacactcaagctttcaatcaattgttatgccccacgagggtcactagccgagtatttgcactagtcagtattcaattatcacatttacttcggtatatcccacaagaaataaccacttggatcagaagccactcggataagatgcacttagtctacaccatccgggagatttgtcactcgagagtagattaaaatgcatgctacacgcttaagttttcaggtgtggtggagctgtatgtcttatagggacttaagcatactcatttttgtgatatatgcactgtgttaacctaataccttcaaaattcctttgctcgctgcaaaaaagaacttttttattaaaattcattgctatgcacagtaatttttaaaactggccaatagcatgctttcatgacttctctaaaactggttttttctccataga

SEQ ID NO: 51320 - DNA, 530 bp, Oryza sativa
tagaaggggtaagtggaggaaataaattttcgttcgctctactggtccagaaactagggtcatgcccactgtaggcttgggaccctttaccagtacctctatccgattaagtcacacatatatgggtgcttgcactatgggatgggtgtcttaggaccaattttttggactgagggtacgggctccatagtttgcactgtgagaggccttaatgagaatgcatatgcatgcaactatatacatacatgcaacagtacgtagcgaacccacacaacatacataaacacgttagcttctttctagctatatttccctttcgtttactctgtttgcatgggaaagaaaggcaatcgattgagtgcaagagagagaaaatgaagggaccaccgtgtggctattgccatgcatcattatgctcgaatccttcaccaaaggcctctctctgagtgtctcagggtacactactcgtctcctttgatgaattgagcatatgatgacactgacgagggagcgaaaaaataaagcgtcca

SEQ ID NO: 51321 - DNA, 545 bp, Oryza sativa
tctgtgatgtgtggcagtggggttactgtgcaaatagagttgttttagccaggagtttggttacgttgtttggaacgaaattatattgcaaagacctcatctccctctctacaggaccataaatcttaaagcagacctcattaactcccctaattgattagatgccatgcaacagtcatggaattaatcaaatcatgatagcattgacagattagaacatgtcgacttcatcgtttgtatagtgaggacctgaaaagctgaaaaatactatatgctgtaaaaagtttgatgttcgtagtgtcagattcttgccgttttagtcaggctagtgagctgcctttggtatacatctttttaaatgtgggttagaaggtgcacccttcgacatgttcccagggttcactttctcgccggtaaccgcgcggtaaccgcggttaccgggcttaccgtggagggtcggtaacgaaaaccggcggtagggtttgggcaaattttgctcaaattcaaaaatttgaaaaataatcgaaaaaaataaaaaaaaatca

SEQ ID NO: 51322 - DNA, 546 bp, Oryza sativa
ctactttcttcttcacttggatcgtctctctctcatcgctgtatgccttggctggatcatggatgctttgcattgcatatatacgactagctaagccatcagtgtagtagccaccactacgctaactctgatcgatcggcatcggtcggtcgataggattctctttctccaacctttcacctcctggcgaaacgagagacttcaactcttctctatcttaaagtgcatcccctgacagccacaacgtgtactgtaagagggcaggcagcgagagctctgattctgtagttgtatattgttcattaaagagaaaacgagacgatggtgcagtttttgaactacagtgtacttgtacagagaggagccctgtctccccgctcctcaaggaacggtctccatctctcaatccacaacaatgcaaatcaattaggcctctcacagtgcgtcgacctggactgtgtcttagtcgcgccacgttggatttttgctgccgtgtcactcagacccgcgtctcagctagggcgctcgtgcctaaactagggggcg

SEQ ID NO: 51323 - DNA, 252 bp, Oryza sativa
caggcaaagaagtaggtcgaaaggtgattgataagagaaatcgggaaagaacacatcaaggtcaaaggtgtaaaggaatacgttgaatgctaactgaggacaacatgaagtgaatagtggtaagttagaagtaaatgacaagcatgatattctcatgataacgagcatggtatcctagtaatgacaagctgatatcgacgcataacgtgaagtgggtaacttgtatgaggttgactccaaagatatgaacta

SEQ ID NO: 51324 - DNA, 587 bp, Oryza sativa
agcttattgttgacccaatccaacaacagccgattcaacagacgccaccaaggcagcaggttgtgcagccaattcaacaaacaccaccaagacagtaggttgtgtagccgattcagcaaacgccaccgagacaacaggttgttcagccgattcagcagtaaggtttgatgaatgcatcggctgggttcggaacacctgacaatcagctaaggcagcacgctgtgaatagtgttgtcccagagcatttggttcataatgtgcaaccagattaaacggtgatacctcaagttattcccgaacatttggtgcgcaatatacaaccaaactttcagaattatcaggggggcaatttgaattatcagtattagcctccatcgccgcaaattcaatatcagcaaggaggatcggctcagtctcagttcactcctcaatacaatcaattcgagcccgtgccacaacaagcacaggggtgcctcagcaacgaccatgggccgatatgattgcagatgtgatgagagaacagtttgggcttaagcctcaggatgctggaaatctgtatcggcatccataccctgagtggtttgaga

SEQ ID NO: 51325 - DNA, 1501 bp, Oryza sativa
accacttcagtcccggttggtacaccggttggttgtaccaaccgggagtaaagattatttagatccttaatcctggttggtaataccaactgggactaaaattcaacccatagttgttaacgaccaaatttggtaatctaagaatcggagatgaagaaggaatcgagatggagttcgagatggagatcgtcccggaaacagagtgaagatcggctggagtccgaatcggctacgactaagatcggcagaattcgagtcggacagggttagccgatcaagccggatccgataatataacattgcatatgttgtcgggttaggttgatatgcttcatgatgattgccacgcatggatagagtcctgagaaggcagttgtatctattaattaggatattttatgtaattctcttagagatatgtttgggcaaaagtctgccacaaagacttatggtatcttagagtgtgttagagataagagtcgtgtccgatatggacatattttgtaattctcgggtataaatagaccccgagccccatgtaatcaaactaacacacggtcaatacaatctcggcgcatcgccaccctttttactttcgttttgtttcgatgagttcttgcttttgggttgagctgcatcggttttgatcttcaacaagaggtaaaacttattatggcggcttgcgttctcgggattagtgcttccatctttatgatactcaaatcttgtttatgtaattgtcgagttatcacatatcatacataatctccggcaatatcgttacctaacctacaatcggctaacatctgttagtagaaggcagccgattaggatagatactgatgttgacttagattatatatgatatccaccactttatgacacatccaacggcttgattgtctagatattgtctttcttttcatacttgtagctacatcagttgagtttgatcatatgagtcgtgattagaatctcaatctctagcctgtctttggttgccaactagggtagtatcggactttcagccgatcttacctgatttaactatatttaccttatatgctttgttgacatgttaaatctgccctttatgtaagatcttattgcatttaagtatattaggcctttgtttgatatattctacttgttttaatatcttaatatagagtagtatcggagtattagccgatacatgctagatctacctgatcggctatgctatgaacatatatagtctcattattaatatatatttcgatctaattgatttatactgtctcggcatggtgaccgatctatcccaatcacttgatttaagtatatatcgatatagggactatatactgttaatatctacaaccgatcaagtagatatagttctttcttacttattaacgactgccgatcgatgtatatatgacatgggctcaaagataaatgatatgtcatcggcatctagccgatcggctatcgtttatggatttaactaccggttgct

SEQ ID NO: 51326 - DNA, 1501 bp, Oryza sativa
catttatgaaaattcgtgtataagtagtaccaatttgactgtttctgattttggccatacataaaatttgattttctttctatttctttagcgtataatacagtttacagtaaataattaaattggtaaatatataaaaaaatcaattttactcacttgaactattttgacgaagcacttaaacccctacataatttttcatctcgttttatacctacgaactattgaaagtggttccccttattgtctaacagtatttctcatttttttatctctctacatacaagtcatatacatttgttcgactatcaatctttgttattaactttctcgatgttcgtgctgtgcgcttttgcgccaatgccgtgaaccagcgactatggtttgtgtgtgttgtgccattacctaattaaggctagctctgtcgccccatctgtattttaaacctgcatccgccactcaagatggggagaaagactttccgatagaggatttgaggataagtcctagggattatatactactgttgatgtaaaaacacgaggcctgggagatctgcttaactccagtgcaggtccaaaacttgcctttaggtatgcgagcgtgccagttgatttgatcctgcaatcaacaagaaacaaagacaaagcaaccggtagttaaatccataaacgatagccgatcggctagatgccgatgacatatcatttatctttgagcccatgtcatatatacatcgatcggcagtcgttaataagtaagaaagaactatatctacttgatcggttgtagatattaacagtatatagtccctatatcgatatatacttaaatcaagtgattgggatagatcggtcaccatgccgagacagtataaatcaattagatcgaaatatatattaataatgagactatatatgttcatagcatagccgatcaggtagatctagcatgtatcggctaatactccgatactactctatattaagatattaaaacaagtagaatatatcaaacaaaggcctaatatacttaaatgcaataagatcttacataaagggcagatttaacatgtcaacaaagcatataaggtaaatatagttaaatcaggtaagatcggctgaaagtccgatactaccctagttggcaaccaaagacaggctagagattgagattctaatcacgactcatatgatcaaactcaactgatgtagctacaagtatgaaaagaaagacaatatctagacaatcaagccgttggatgtgtcataaagtggtggatatcatatataatctaagtcaacatcagtatctatcctaatcggctgccttctactaacagatgttagccgattgtaggttaggtaacgatattgccggagattatgtatgatatgtgataactcgacaattacataaacaagatttgagtatcataaagatggaagcactaatcccgagaacgcaagccgccataataagttttacctcttgttgaaga

SEQ ID NO: 51327 - DNA, 326 bp, Oryza sativa
ccgtcaagctttcgttgcttacaacattacagacaaagataataaattaaaaatcacttagccctttttttcgctcattctcttcccccatgtgtattgtaaaagtttctcaagattgctcccaaaaaaaaagtttctcaaattcttatggaaaagggattaatcgatggtgcctttaattaatgagattgtacccccttatacttgcagctattgttagttgttaactctaggaacagagctacatataagagagggagtaccaggaacccggtcaagaatttttttcaactattaattctttatatattttcatcatatgtagt

SEQ ID NO: 51328 - DNA, 194 bp, Oryza sativa
tgagcgacccaagaaagtgagcaaaacaaacaagacgccgaagccagatggtgcaaccaagatcgttccactctccagcgccaaccctgacaagactgtcaagatcggggcgtcactggatgagaaataggaactcgcgctcatcaccttccaacacgacaatgcagacgtattcgcttggcagccgtccgaca

SEQ ID NO: 51329 - DNA, 367 bp, Oryza sativa
gtccataaatttgggaaaatttaaatttttgtgctattgattgttttctctaataggatgcaagtgtgtagagtattatgtgtgcctttcgctctaaagaacaaagacaaccttggtttatctactttcaacttttcaagagacttgcaagctgttgtttttagaagttcttcgtaaaaatatatgaactactgttcttattcaataggctataactgcatgttttgcccttcttttggcagataaatatatctcttaaagttgtagttgaaatgaacactgtatacatatctaatctcttgattatgcttcaacttttgttattgtgtaatttctttttgtgccttagacatgaaaatcatatttt

SEQ ID NO: 51330 - DNA, 375 bp, Oryza sativa
caaccagacaagatccttgagtggaccgccaaacccgacctgactccctccctccaatctttcatcgacatcatcgatgacctccgagtacgggggttgtcggggtacaaagtcgctgcccacccggcctttgactactctgggccggaggacgcgacccgggtttctcctcggggtatttttcttgtaatccagattttgttccggatgtgcctgtttcccctgacttatcgagttcctgttctcgatctacaggtttggatagcgacaccgtggcacgccgcgtcggccaggtgatgatcagtggccctgcgatggcgagcgacatccccgtccctctttgcgagaagggtccggccgaacacgaagccgcga

SEQ ID NO: 51331 - DNA, 361 bp, Oryza sativa
caagaaccatgatgccaatagtccactactatgctttactactttcagattaatgaagatatcagttgcagagagggctattgcggttccttagccatggcaatgttcgtgctaccaccgtgttttttttttttgttatgccattacttgccctgcaaaaagatatgcaagagtataatggaatagatatttttgtattccgaaagatatgcgattaggtttgaggttttttattcctcatctttcctacgctgtgattatgtacaagttcagggaaatgctgaccctaaggtgggaattgttgatttgagatcgatgtgattatatctgtcagatcagctttataatattctttcaatgg

SEQ ID NO: 51332 - DNA, 900 bp, Oryza sativa
aagtcgaggaggggctacactacacagtatctgtactctgggaaggtttcctttttcttttcttgaatgcacaattactattttttttctcatataaattactattccatccgtaccataatataagagattttgaccatttgcctttcaataaaaaaaaatccttaaactaaaaggtttctcatcttttctctttcttttttttttcttttacctttaaatagtgctcttattaaccagttggcatcattgtatcgtatgtgatctagtgtctctgtctattcctctctttttttttattgagacgacggccatattgctcagtgcgtacaaactatcgacaaaaccatccacttttacattagactagagcttggcgcgtcgcctgcccgtaatgatgttgaaaaaacacatgataattagggttactgaaaaaaaagaagaaagcagatggttatagataaccaaactacagtactaattacaggccaacaaatcatgcacacttcataaaagcgattattcaaccgatgctacagccaagaaaaattttcatatctgtaagatctatgtttacatattttgatcaaccatagcgattcaaatactaatcaactggtagacaatccctgttacatgaaccgcaattaccgcatacctcacggtgtttccttggatcagcatttgcaccttgagaaaagcatgtcaaaatcaaattccctggcaagcacccaatgcggaaacctaaccaggcgggggaacaaaaaccaaggtctcgatcaattacttgagcagtcatctatggtcaccatgatggaaccagtatggttatgtccatgaacaacaccggtgttctaaaaacttacagttccataccatatccatgacctaccattgaaa

SEQ ID NO: 51333 - DNA, 169 bp, Oryza sativa
ccaatataaataaagctcaactagtcaaattattataacccaaggtatcaaggaataaagtaatcaagaacaaaagggctataacaatcaataggttaattccacccaatgacattcgaaaataaatgcaatagttgaaaagaaacaatagctttaaataggatcaaca

SEQ ID NO: 51334 - DNA, 353 bp, Oryza sativa
agaaaaaggaggcttattttacagcttgcagcagattcagactgtgatcagtatgtaatagacgttgcgcaatgacctgcaggctaggaaatcaatcgccgattcactatagctgtccatgaaataaatacctgcatgtgaaaatcaatatgaacaatttttttggagacggtgtacgtatatatctagcaacttctatgatgcgtcagggagaggagagagatattgaggcttgcattcaagtgtttttatggaggacactttctgcccggatctaacggcaaagacatcataattcagcaaaatttcgcccatacaaatgcataaatttgacaatctgtcccatttccaga

SEQ ID NO: 51335 - DNA, 226 bp, Oryza sativa
  unsure (1)..(226): unsure at all n locations
tggcggagccatcgggggtgccggagggggccaacacccccctatcccaccccccctcctttacntataacaccagctataaaatgtcagttaatccattagcaaatctataaaaaacgtcagccaagcaagaaacatgatctataaaattaattaatgagagagattagagaagcatcaaatgcctcatgttcatcacttcagttttgcacccgtatgcgacagc

SEQ ID NO: 51336 - DNA, 453 bp, Oryza sativa
tatatttatatatatatatatatatatatatatatatatatataaaagaagagttgtacctctccaattctacatgccaaatcaccgatcaatatatatatatatatataaaagaagagttgtacctctccaattctacatgccaaatcaccgatcaatccctaccgtccatccgcatcgctatgatccctccgcatcgctataatccgtaccgtccatccgcatcgctctgatccctaccgtccaccgcgatttcaccctacccacagcaactctatcctatcgagagctgagtcttcgccgttcgatcccccttcctgccactccctgacccgccaccgccgccgcgtcctactcctccccacccacaaccgctgcatcacctcctcccaccaccttcgcgtcctcctcctccccatcgccgccacgtcctcctcccacccaccaccggca

SEQ ID NO: 51337 - DNA, 822 bp, Oryza sativa
tcggaatccgatacatccggatacctttttgggttccatccagcgcaactcataataaaaatagaaaagatcaaggaaaggctctaccccaatgtaggcctcacaaagataggagaaaatgctaaggaatgcgattgaattggggttcagctgaagcaaggaaagaccatagaagttcaagacgagaagaagaaattcggaaggcggaggaagaaaaccacaagaaatgtaatcttcgaccgcaaccatactgcccaagatgggttcgagttcagtacctcctatctccctctgcatggtcccgcgagcagggagggtgtcgtcgtcctgcaacttcttcagggacgctgtggtggaggtggacttgtcgagatccatcgtcgctggaggatcgccggggaacaaagcaaagtgaaagaggcaagctagggttttctctgcgggagcggagaagacgaagggtgcttgaagactggagagttatgtggcaaacggacttcaaaatggatccccaaaactcctttaaataagcccactaccgacggtgcgtattccaaggaaaggagagagattgccgtcggaaaattctgggttgacttcaatttaaattcactcatgaccgttgaacttcgtacgatgttgtcgataactctttgtctctacagttctcacaccgagatcgaccagatgagaacgacaacgattccgacaacagaagtcgtgatcggttgcatgagttcatataagcagaagtcaagggctactgccagggttacggataaggtataccctacgtccttggatatacgttgtatactgata

SEQ ID NO: 51338 - DNA, 1501 bp, Oryza sativa
cgcggcccacctcgcggagcgcgcggcgggcagcggtgcgggaccgcgccccaccgacctcctcccctcccgtcggctagcctgcccagagaagtgggagagaaaagggaaagaggaaggtgagaagtgagagagagaagggagagaagagggaaagagaaatgtgttgacgtggcatcctaatatgtggggcccacgtgggtcctatgctgactcagcaaccacgtaggataaaaccgggatcaaaaccgctgagggacctattgtgatcggttttgtatagttaaaggacccgcgatatctggtttagcggtttgatgacgttttttatcccgatgacaagttgagggacctttggcgaaaacgcttacaatcggtcgttcgataccaccgaaaaaatcggacgctccacgtgtttctctgtttctcacacaacgagtccacgacttttcctcctccccctcgctataacttttcctcctccccctcgctgtaaccgcccctgctttccccattctcgctccatccctctctctcgccacgcgctgccgtcgtcggccgtcgagacgccgccgccgcaagccttttgtgcctccttgttcttctcctctttaactcctcatgtactcttcctcctctcccattaacatctcccccaacgtgggtgttcctcgagctagatctagccatccttgacctcaagtatcagatccggggcaaggccaccatggggatagggagagaggcacggatatggcttcagctcaggagcttcttgtagccaccaactccgtcgtcgtgccctacctatgtgatagaggaggtgaaaaagtagttgccggcgctgacaaaggtaaagctggtgtgcctaactagttgggcaagaatgttgcacaccctattcttttgatgttgcacacaatgtttacttgatgttgcaattagtcttttttggatgttgcacaaattggtataatgatttcttgatgttacaatattctgttttgtgtgttgcaacaagtgttcttggatgttgcaatattctggttttgtgcgttgcaacaagtgttcttggatgttgcatgtgattgaaacatcttttgataaatcaatgaaacattcttgatcgagttatggaacacgctggaacaattcttgttgaaacatttttttcatcggattatgaaacatctgaaacatttttttatgtgtgatggaacacgtccgatgtttcatcatccatcggacgtccgatttgtagcgctccccggacctttggtgtactttttccttttgaaggggtggacttttcgtactcgtggatgggcctaccaaaatgaggcccaagatggagtttgagatgggcccgtttctgtctccaattccagcccgtctcttatctctctcgtgtcttcttcacaaaagaaaacgacaaaaaaaaagtcattccaacacaagcccacctaagcgagcacgatgcacggcggcgcgtccttcgccg

SEQ ID NO: 51339 - DNA, 1501 bp, Oryza sativa
tgtgcgacgtcgtcgtttgggaggtgagaaggcaaggcttcttggaggcagaggcggaagcggtggctgtggtagaggcggttgcgggggaagacggggatgagccagtgagctgttggtgctcacggcggcgagcggtgggcacctaggtgctcttgacgtggatggagcaaccgaagccgcggcttttgcaacacgtgcggcaatgttggtggccacagtctttctttgcttggttaccgcagtcctagcacatcgccgcggcgccggagccaaacgatccgtcagcgatgtccagcatcgggagggggttcttgaggtaggggaaggcgctagcgctacgtgatgaagcttctctccgttgacccgttgaactacgacgacacccccatcgaagggatcaggaagatcctcgaggagttgtccggggagaggatcatgcggtcgtccaagattcccacggccaaatggtcaattggagcgggagccaagtgaatcgctccagaaatttatactcccttcgtttcaaaatgtttgacaccgttgactttttaacacatgtttgaccgttcgtcttattaaaaaaaattgtgaaatatataaaattatatgtgtacatgaaagtatatttaacaatgaatcaaattatatgaaaagaataaataattagttaattttttttaataagacgaatgaccaaacacaaactaaaaagtcaacggtgtcaaacatttagaaacagagtactagcgacttagcgaggtggagtggcgaaaacgtggctccacgtcctactctgaaaataattacagcgctacccgtcccctttcatcgaaattacaggaaatgccatcgcattaccttggatccagccgaaccgtcgcgccgcccactcgtcgactcgggccttatcgcgaggagaaaaaggggagacgagcgaggcagcggcggcagagccagaggctgcttcctccctccttctctcggtgcgacggtttaggcggcagcgcacggtgacggcggcagcacggcgcacggcaactggggcgacgcagcacggtgacggtggcagggttggagcacggtggcgagcagagcaggggaggggatcctggtgagcttctgattcatctctctctctctctcccaccccaccggggctacgtctgtctggaatttgcttgcgttcgttaacccctagcttcttttctagttctggaagaagctatttcacgagaaaatacaagtaacagtttattgtttgtttcccccaaaatttgggagttcaactgaaccccccatgtcccaagttggatccgcccctggcgctcttatccccctttgtttgattaattcacagcacagctcagtgctacaactccttctacttattacagtaatccatcacccattaccagattaatctgaattgcctgcatctacgctgctgttttggtgttttgcagaggacgcagattctgagagtacctcgaagttagga

SEQ ID NO: 51340 - DNA, 1501 bp, Oryza sativa
agcgattctgagggacacttgttattgagctagatggttaagttcacatttttgcaggcatatttttggcttatgctccttgttctgttggaaactcgggaggatgcagatgagttgaaatacaggatagtgtttcatgcacaattgtaggtaagccggactacaatatctactggcaaaacataagacccaatacaaggtgctaacttggaggatctaatcactttgattctttttttttttgcagggataattcactctgattctatgaatgacatataaacagataatcgtgttcaccgaatgccaagactaaatctgggaaagtttaacttcacaagcattacaacaaaccatgcgcgatgaattgggaacccgacgccctaatccgtaaagcacgcaccagccaatcgtaacaccaaactcgaaccggaaccctagccgcccaatcccccgccaccccgacactcgaatcggagagcccaaacgacgccgaaatcgggaacagaaccagactagcaattgagcaaatcttagatgggggagggaaactcagagcgaccctcaccttcgacggtcatcgccatctccgcgagcaagcggaggcctctgcgggggaaattttctccaaactcgagaggagcacctccttcttctccccttccgctctgacctgcgttgcgagtctcttgcgctttacccccctctctaacgagaagagagagaaatactccgtggaggctgacagtgggccccacatgtcagctgcatatcgcccttgttaggttagggtatttttctctcttgaagtctttgagacttgagagctcagctcgcctgccgccgcaacgagcgcttgcttcgcttcgccctcctcaacggcggcggccggaggaggaggagatggcgcggctcacggtggagcaggcgaagcgcgaggcgggatccgccgggacgctcgccacgtcgctcaacctctcccaccgcgccctctccgacgtcggtgctgtgtagcctctgcctcgtcgattggtgttttttttcctgccatgttttctcatccttgtgttgtgcggtgctgtgctgtgttggtttttgtgtaggtgtcgtgcctgagcagcttcgtgaatctggagcgcctcgacctcggctacaactgcctcctcactctcgaggtaactagtcaatgtactacgggttaaaacacagtattctagtgagaaatgcacatgtttatacaacaaatttagcatcggtgtagattcttggtgaatttcacctgtatggatatatgcgatgtcggtgttactgtgttctctacaagcataggcactgggtaaatccatctgaaacattgaatagttaaaaggatgaatcccgtaataaccttttagaaagtcatataatggactaatttgatgtcccattcggtctggattattctttgagttcattgaagtagagaattgatggctaatcgttccattaaatcattgctgtg

SEQ ID NO: 51341 - DNA, 1501 bp, Oryza sativa
aaaatcattatctttcaaatatggtgattacatgtatagaatagtcttaaaaagtattttaataaaatcatatatttgttaatacttttatacatattataacagaaaataatggtcaaagttattttttggagactatactcttgtccaaaacaacaaatattattaacccggagggagtatgtgcattttagatggctagctaaatgcatgtgtttgctaattgctaaaaaaatatactataatattgtataagataaataaaaatatttctcataaaatgtgtcacgcattattctgctataggaaatatgtgatttttcatttagattttaattattttttatcattaagaatcggctaattgctaaatatggaaatcaagtaataaactgtttggtttggaaacatcaagggtccatagctcagtggtagagcaattgactgcagatcaataggtctccggttcgaacccggatgggccctcggatgaatttttatttttttttctccggttcgaacccggatgggccctcagttgaatttttattttttttttgggagtacctatacatctttcgaaagatttttataatcgtatcacacagatttttaatctttagattaaaatccgatagatataataaaaagcaaaaagcaattaagaaataccataatggacactaaattaccatatcctcaataaaaagaccaaatccaatacaaaatttaaaatttacatgcgaagattcaaaaattacagtgtaacttacaaaagttacagtgtaagtttcataaattacactgtaacttaccagaaaatgcactgtaaatttgagtaagaaaatcgagtgagagataagaaaaaatctttcgagtgagatatagcaaaatcgttttttttctccggttcgagcccatcctctccaaaatgatttatgtttatttttttcctcaactgatttacattattttgctcaactcaactgatttatatttttttgttcaactgatttacctttattcaactagcaaactggtgaacaagatgtgatatttacgattttttttacctcatcttatttacattgttttcctcaattcatttacctttatttaactactagcaaactggtgaacaatgttgtgatgttagggtaaaaacaacgtcatatggaactatgtacttaaccaatgcaaaatttagtcagccttttacgttgggctatataaactgcatcgcattccaagaatatgaaaaacatctttcatcttacggtgaaccagctcatccgaattcaaaacttagatttgatatgaatactcgcatttacggctaattatttttttagtgatagactacctaccctcaacaacaatgtgttcgtgatgacttcatcaattttaagatacgccaacccaactttttaaaggtgattatagaggtagggtgtgtatttataagagtgagtatatgcgcaatatggacgtctgcgtttgt

SEQ ID NO: 51342 - DNA, 1501 bp, Oryza sativa
ctatcttgctttcagttactaggatgttgaatttattcacttggtgttatgtctttttctttagatacctcaactttatcatgctgtgctatgtgtaaccatttgtcaattttggtcatttgtatgatgtgggaaaacaagccatagttgcaaatttgtgctgacttcttcatagctgctactgtattttgtgtacactaggcaaaaactctgaaaatatctgcttgatgtatattgtatgggtccgacctcagatctttgttgcggctagcagtgcggttatattaataagtgtatctttaggagttacctatagaattagccgaccataagtggttctcctgactacacttgatgcttctaaagatatgcattgttttgattgtgtatgctcttctttctaggtgcttatcaattgccagaacaacaagaagttactaggtcgtgtgagggcatttgatagccattgcaacatggttcttgagaatgtcagggagatgtggaccgaggtacatgcaaggcgttatctgaagttttgaacttttgttccagttgagtgtagtgctgttttcagtaataacatgtgttactcttgctgcaggtaccaaagactggtaaaggcaagaagaaggctcttccagtgaacaaggacaggttcatcagcaagatgttcctacgtggggactcggtcatcattgtgctcaaaaacccgaaatgagttatctatatagtcttgtgtcgaggattgcctctttgctacgtcgctcttagcaatgtccaaacgcctttgtctaagagaactgggccagaatcagctatatttgatagttgagtgttggagttggagttgttatgacttatggatttacctctcttctaacttgcatcgttagcatctgtttgaatcatcaatatattagctgaagacaatttggaactcgactggttatgttttgtgttgatttctcactttctgaattgctagaagcactgccttgtatcgcagtatggcagtatgtgaattgttatgaggcaatatgtgcacatgtgtccagctttcccgcttcttaattcgtaactagatggcataaaataaacaaaagtgcacaggaaaaatcaaggaatggagattttaatttgatggtaaaagggaaatcaaggaaaggagaatccatgagaaactgataaaatgaagtcgagtggcatgggatccaaacccacgagggatccaaagaaaatatgattttttgaaatattttttttaaaaatatgaatttttgaaatattttgggtgtacctgtcgatggtgatggtagcaggatcaaagttgatacggaggccttccaaatagggtggatgacgagccagctgggctcggcacggaggccttccaagttccaacctttacaagtaaacaagttgcaatgggcaaatgtcatactgtcatcaactgattattttgaccgtcgatcacacaccagtatggcttatatatacacgc

SEQ ID NO: 51343 - DNA, 1501 bp, Oryza sativa
gatggtgggctattttttggcaaaacaagaatttgttaaataataattcacagctggtacacttttatctacagtggtaaaagtgtgggggcaccacagtattgtaattatccttttctttaaagctttctccatcctccaactggatacatcagacaattctactaactctaatatctgcgaactcaatgactataagataagctttatcgcatctaatgcaaagaacaaaagaagtttaatttcttacaacagagcaatggacaatgtagccacagattgtaaactggctcatgggttggggttccttagaaaagttttggcaaccgatttgccttgaatgtttggtgatattccttagaagctgattcgtttgcaattgaactgtctatgaacatctggatttctgaaataaggaagtacccttctcctaacgggtgaatgaactgtagttctctcaactctcttagccaataaggatgctctgtaagtcatgttaaattaatggagcctttctcatgtatctgaataattggtcatagtcaacatcttttcatgtagtgttagtgtaaatgttgcatctgggctgccacttcattttctgaaacatagttgattgcaacgtggtagtctatcttcacttcttcagtaaggttgttttctgttttagttagttatgtagttcttaattacctactttttgttcacttttatcagttcaaacagtagtcttggattgtgctatggtttgtctaggtatgtccatatcttaggttcgcgctcgccatgctattaccttaacatgctctactgctcttgtttgtgtatcgtatggagtcctaatttgaacttttggcgaccagaatcgttgtgggttgtgggattagtatttcattatttacttgattttctgagtctgtttacttactggagtgttgagttggtgcaatagcaagatgagttgctggattgaattcacgcacctatctttgccctttacaccttgaaatatgccattttgtcatggatattgagttactgcatgttgaattcattcattccctgcgatatcttttggtttagataccttgatatgctatcttgctttcagttactaggatgttgaatttattcacttggtgttatgtctttttctttagatacctcaactttatcatgctgtgctatgtgtaaccatttgtcaattttggtcatttgtatgatgtgggaaaacaagccatagttgcaaatttgtgctgacttcttcatagctgctactgtattttgtgtacactaggcaaaaactctgaaaatatctgcttgatgtatattgtatgggtccgacctcagatctttgttgcggctagcagtgcggttatattaataagtgtatctttaggagttacctatagaattagccgaccataagtggttctcctgactacacttgatgcttctaaagatatgcattgttttgattgtgtatgctcttctttctagg

SEQ ID NO: 51344 - DNA, 1501 bp, Oryza sativa
ctcctctcgagtttggagaaaatttcccccgcagaggcctccgcttgctcgcggagatggcgatgaccgtcgaaggtgagggtcgctctgagtttccctcccccatctaagatttgctcaattgctagtctggttctgttcccgatttcggcgtcgtttgggctctccgattcgagtgtcggggtggcgggggattgggcggctagggttccggttcgagtttggtgttacgattggctggtgcgtgctttacggattagggcgtcgggttcccaattcatcgcgcatggtttgttgtaatgcttgtgaagttaaactttcccagatttagtcttggcattcggtgaacacgattatctgtttatatgtcattcatagaatcagagtgaattatccctgcaaaaaaaaaaagaatcaaagtgattagatcctccaagttagcaccttgtattgggtcttatgttttgccagtagatattgtagtccggcttacctacaattgtgcatgaaacactatcctgtatttcaactcatctgcatcctcccgagtttccaacagaacaaggagcataagccaaaaatatgcctgcaaaaatgtgaacttaaccatctagctcaataacaagtgtccctcagaatcgcttaactgatacccatgagcatttactatgtgcatttggttttgagttctagctctaggatataaattttaccatgtgcatttaaattattttggttgtttgctaccaacctgaaactacactgcttctgagatgtatttggatatcactttcttcaatttattgctaaaagcatacagtgatactgaagcatcaaactacatggttttgattcaaaatttgtaaccaaattctacttatgattcatggaactggacaatttgaagttaacatggagctctgcacatgcttgatgtatgtttagtccatcaaaaaacaacatcccagatcaacttatgttcttctttcgacctttatttgtgcaacctcatgttcataaaaaatatcatcgaacttgttcaaaagcacttcgaaaaccatgtcgtctttagattagcctttatgtagcacaacaccaaagatgagcatgaccatcctctgaagaaaaaaaaatcatgctgaactattaagcctttgaagtgtttttagctaaactgggaggaagaatatgcattaaattatggttatgaaattcagaccagcttgttgattttatagaatagtatttcatttgcatagagttacctttctgaaaatacagttcattttcactatcagctatttgttagactctagtgctccttattaggtcatgccatcatctttgttctcctgcaattggtttgaaagtttcactaacttaatgcttcttgtctttgcttttatacctttctgctggatgatgatgatgatgtcacttatcattgatgtgtgtcttgacagtgtaagtatattattcagattcttttctgaccattctt

SEQ ID NO: 51345 - DNA, 1501 bp, Oryza sativa
ccctcgttcaactccacttcaagagttttctctgggtgaaaacctagattcgttaggatcggacgatgacgtcgttctgtcggcgtgaccttcctgaaggcttcgttttaggagtttatctcttgttggacaactgtacttaggttcagtttgtcaatgtcggggttttgccggttttcctttaattaaccgtgctgttgtaaggtttttgggtccggtttcccttataaactggatcaactctcttcttctatagtgaattgcaggagctccctgtctgtcccatcgaaaaaaaaacatgtgtacttgtatagacaggagacgaaaatcaaatcactgcgataaagaactggttcgcaattatggtagtacgtgcgataggggaagaggctcctctgacataccgccctctgatgtgggtggctgacatgtgggtccaccagctgtgaggctcatatgtcatcctctcaaagttagagggcaatacgttagaggatcacgtttcgtgcgataggacttaggagcggatcggagaagaaatctccgaaccagagacatttgggccgggggtggatggtgattgacccagttcgtactaaacggctggcggcgcaaatgcctcttcggggtttgagctcccatcggatggcaaaaaaaaaactaaattttaaattttcaaatttgattttgagatatttttaaggtagtttttttttcagcattggcttttaagtcaaaaaacatatatataaaagttttacctataaatccatttttattccctaataaatagttttggcttattatgaaaaaaaccaaacgatggggctctcagactcttctacaccgaaccccacaaatcacacgtacgcccgtgcgagactcaacgacgagtgcaggtggaagcccaggttttcgtgcgatgattgtttactccatgaatttgcttaatattctactgagtaaaattgaatcaatgtgtttctttttacagaaacacaaacgcagacgtccatattgcgcatatactcactcttataaatacacaccctacctctataatcacctttaaaaagttgggttggcgtatcttaaaattgatgaagtcatcacgaacacattgttgttgagggtaggtagtctatcactaaaaaaataattagccgtaaatgcgagtattcatatcaaatctaagttttgaattcggatgagctggttcaccgtaagatgaaagatgtttttcatattcttggaatgcgatgcagtttatatagcccaacgtaaaaggctgactaaattttgcattggttaagtacatagttccatatgacgttgtttttaccctaacatcacaacattgttcaccagtttgctagtagttaaataaaggtaaatgaattgaggaaaacaatgtaaataagatgaggtaaaaaaaatcgtaaatatcacatcttgttcaccagtttgctagttgaataaaggtaaatcagttgaacaaaaa

SEQ ID NO: 51346 - DNA, 194 bp, Oryza sativa
ttgcgaagtggacacccagtcacccacccatgtccccgtgttagaaacttctggtaactaaacacactcaaatcgaagaattacaagtttcttgaggatgacatgtagaactatgaacaaaacaatattattgttttatttgtaaatggtgaaaaatgtaaagataatagtaacaaataattttttttgttgca

SEQ ID NO: 51347 - DNA, 250 bp, Oryza sativa
agaagcccttgtcgctacgcttgcgtatccaacaagatgatcggagtgcggtcttgttctaggtcttgttccccagtcgactgcctgtggcatgttaatcgggcccttatattctttgtcttccgctgttgttctctgatagttgttggcctacctggccctaatgtaagtatttaactcttttagcctgaattaatttgtgatatgttgtgatccaactatgtatgtgtgtaccaactactgatccagg

SEQ ID NO: 51348 - DNA, 442 bp, Oryza sativa
tttaaaattgttttgctagtatagtcaagagccagcttggcctatttgacaaacatgtatgttctgctgtagattaacagaatgcctagtactatttgcacaatacagaaggttcatttgtcagaaagtacacactggtctccagaacgcacatggtagtcggtccacatgtttatcagtataattttatatattatattcgatgtaaacacattttattgtgcaattctcgaagcaccaaagaatctgacagctgccaagtgccaaaacgagtggttcaatttgttattttaatgcagcttatctttctcttatctcttttggaatgatatcatgtgggaaaattttcttttcaaacaattttgtgtaataaaaggcgaagttcaggttaggaacaacgcagagctttaacattgaggaatcttgttgcatttttttcaga

SEQ ID NO: 51349 - DNA, 480 bp, Oryza sativa
tgaattcctgcagcccatcctgtgaatacacatacaaacattatctcctacaagaggaaaatatttgtaaaaaaaagccaagagaaattatatagatccgagagactactatatattcaccatgaaaaacatacatatgtgcgtgcgtacatacgtacgtacatacatgcgtacgatcgaaaatagcacgtggaaccacattataactctttataattatgccaatatcatcttaataatgttaataactagcataaacaattttgataatataaattattctttcgtatattacccatgaaaatgcataagtgattagatgcataataaaagaaaaaaacaaaacacatattaactcgtatgtttgtgaaggatggtgataataaagtgatttttgtttgaatataatagacattatcatatagtatattaaagtttatggtctattttacggaataaatattttttttttattctagg

SEQ ID NO: 51350 - DNA, 576 bp, Oryza sativa
aaattcccgcagcaatgcgcggggttttacctagtataaacaaaacttataactggttaagtctctctcacggtaaaacatgtctattcgaaatcaaatcctaaacttgatagctaaacttgataggagagcgtttgtatttatggttaattaaatttccagtagagtatatgtgtgcacgtttatagaatgattgtctatgcgttatgtaagcgtcttatgcgcggttgtacggtgggttgtacatattgttttttttctaaaaaaaactaagacaggattagagaggtactaatcgtgccaccgacctccttattccttcttagttaagtaggtatctactctctccgtctcataaaaaagaatttagaaccggatatgacatattatagtataataaatatggacatatgtatgtctagattcatagtattaggatgtgtcacatccaatactagcttgtttttttatgggatggagggagtataatctatcaagatcgacatattcacatggctcgctaatttcatctcttttggcgattaattctgttggccccattgggtcactcgtagc

SEQ ID NO: 51351 - DNA, 537 bp, Oryza sativa
tatccgatctctacgactcctctcttcgcggagtgatcacatcgggcgctactggtgcgatggacacaccaccaaccggacctacccctgctccttatttccccatccaaagagagctcgatctgagtgcatgtaactacagtacacgtgcgtgtttgctcgctccatcgatagtgcctcccatcagattcagaaagggggtgaaaaccggtcggaaacgatcgaatcggtagcatttcttcgaaaacgatcttcgatcggtcagtaattgaccacattaatacgatgtagaaagaattgtgaaaaaacaacatttaaaaatagtcaaaaatagtatggtcggaaacgatactccttatatagaaacagtgctcgatcgatcaggaatttccgtggccattttcacccccattcagtgcatctttttgttcacggattattgcacacgcatgtgaaacttttgagacggaaatgataggcgaccatgcgtagtacggagtacacgagtgcgcgactcgatcggtggggtggtggcca

SEQ ID NO: 51352 - DNA, 205 bp, Oryza sativa
  unsure (1)..(205): unsure at all n locations
gcagctccgtgcgccggtgctcccttcctccgtgcgtcgccgctgacggcgctccctacctccccgcgggcccccccntccgccggntccgtcgcctagnngcctcgnccgtcgcccctcctcgtcgncganccgccgttcctcngcctngcngnncnnnngccgcccgaccctcctcttcatcgagccaccgccatccctccca

SEQ ID NO: 51353 - DNA, 272 bp, Oryza sativa
caaaccaaaccagccctaaaaggcgagactgagaccgagagaccgagaaaaaaaaaagagatcaggcatcaacatctgcaatgcagccgtgttctacacggtgcactgaaccagtagtagtgtggtgcgttgctgcatccatcactggctaacaaacccttggcttagctgcttaggtcgacctaagtcatcgctttcgtcgtcggtcaattcggtgtgtggaagtacactgaactctcacctacctcgccggagtacgtgttgtacacagc

SEQ ID NO: 51354 - DNA, 627 bp, Oryza sativa
ataaggcacaactacttcttaaagttgtttcataatataagagcaggtacaatagcagactattagccagctgcaaatatattttaatgagataaaacatgagagagaagagcagcgggctacagatctgtagccagctgcagcacggactctaagacgcaatgtgtgtatgccatatgggaccatatattaatagtatagtaagcaactattgtatgaattggcttttagattggctatatatggattggagccagtagtgggctatactattaaacttgctctaaggcatgcatgtcattagctagcacctcttttttactaaaatattattatttaaatcctacaccataagatctctaattttattgggtgcatgctttctatttattaaggtaacccaatctatgagatgataataattatttcttggtctttgggttaagagtggttgtgccttatattttagaatggagggagtaggtcttagacttttggaacaagggagtattatattagggattacatcgagatgctgatcaaagccaagagtgttttgatttttgaagcgtaaaaatgttatttactctgttcttcttctctttttttcttctttttttgcatcaa

SEQ ID NO: 51355 - DNA, 247 bp, Oryza sativa
cctccggccgatctagggttagggttttgggaggaagagggagagggaggaaggggaggtgagaggaagcacggccactgcaaggccaccgccgccacccgccctctccgtccctcagtccctccagccggatctgagagggaggggaaccgccgccgccctcgctcgtcctctatctggctagatctgggagggaggggaactgccgccaccaccctcccccctcccctcttcggccggatctagg

SEQ ID NO: 51356 - DNA, 183 bp, Oryza sativa
tgagatgtttgttataatgcttgtacgtagctaatgcgaagagtgagaaaaatttaacattatcacttattaggagtaataatatatgaaataatttaccagcatattatctaatatctcacttattaggaaataattatttcaaatctcacttactttaacaatgattgttacttcttaagc

SEQ ID NO: 51357 - DNA, 195 bp, Oryza sativa
ttaactttttcatcgtatcacacaagggtcggcctgtaccactccaccataaataaagtaactggagtagtggagtagtactgtagactacccttttccagtcttcttcacttgttctttgggctacaatatggagtattactccagctccagtactggttccccttcccatcctcccactcccaccgatgaagg

SEQ ID NO: 51358 - DNA, 1501 bp, Oryza sativa
cagtgctccatcgaatgccatggtccaggttttattgtccgtttgggcggctggcctatcctctgggatggtccagtcggctacgaagtcagcgaggacctgtgatttaatggctattctaggcacaaagtggacatcgaattggcttagctcgactacccatttggcaattcggccgaccacgtctttattccagacgacttcacccaaagggaaggaggaaacgatggtgtccttgtgagcctggaagtagtggcgtagctttctcgatgtcataactacagcgtagagtagtttttggatctgtggcctcgcttacgtagtacacgggatgttgcactttttccctctctacgacgttaactgtactcatagaataaggcgtggtagcgatatacaggaataattcttcattgatgtgtggagcaacgagtacaggggaatttgacaagtagcccttgagcgcgataaatgcgttctcggcttcttggttccactcgaatttgtcctgcttcttggtgttgacggtcgttatcgatcagtttcaaccgtcaatattactaaaacaagggagaactagtgatgattgcaatgcataaatatgttagaataataatattccacaagtattaggtctactaaccttttgcagagaatgacaataaagtgaaggaaaatcgacatcaacttagacgatagatcaatcgaacgatgtcgagaaacagacttgtgtatgaatgggccaagaatgcagacttgacacgatgaatcgggccaaatttcacaagtctacgaagtgaagcagcagagggggccactagccaaaatgtgggctggttgggccacactaggttcagccgaacctggtggttcagccgaacttcccgtgaagccgatggatgcagggatttgagggaacgatggagtattaccgacctttccaaccaccataaccgtcattacctgcctatttaaggagttcactctcttcacttcaacacacacctcaagcaagagctctctcattcctctcaagtttagtttagtagtatctagctggtggaatagaattagaataggaatcaggagtccggaagtcttcggaagagttcgggtatggctctagtagtttccctttcctcttttgtaagctttgtacttttataagaatactcttctaaatacatttatggtattgaaatactttccgagtatatgagtacctactttacattatgttcatgttatactgaatatattgctatcttatctgggagatgctttggtgcgggtatagtcttttcttattcaattactctatgtcatgacgatgatattagagtaatatctggtagtttcgacgtggtgtctagattatgagatatcattatttgggattatatattgtggatgagaggtgggccgctgatggtgacagctcagtacgggtattcctccaccccggtatataatcctaagttaattcctcggggagggtatt

SEQ ID NO: 51359 - DNA, 1501 bp, Oryza sativa
tggtgccagaaatgcttgttggtatttcttaacgacattacgagaaatataattcccagcaatagcgcagaaatacttctggtatattatggttatagagttcatccgcaagcgcacagatataccattgtagcatttcacccaagagtattccaagggtatcgtatttattttatcccgtgggaagatcatgtagagagaactcaactaataatttatatattacttgccataatcatatctaagcaggggttaagataatccaagggtagagtgacacacaagcatttaactactcatcctcataataaataatctaagctaggtggaaagaaaagagaaaggaaatctattcctatacttctaatatacatagtacacatacattctagttaactgatatactagctaataccctctatccgatccctcctggtacttcgagaagccacccctgactgccgagttccttacgacagcccgtcatgaccatacaaccggggctaaatacggaggaataccctccccgaggaattaacttaggattatataccggggtggaggaatacccgtactgagctgtcaccatcagcggcccacctctcatccacaatatataatcccaaataatgatatctcataatctagacaccacgtcgaaactaccagatattactctaatatcatcgtcatgacatagagtaattgaataagaaaagactatacccgcaccaaagcatctcccagataagatagcaatatattcagtataacatgaacataatgtaaagtaggtactcatatactcggaaagtatttcaataccataaatgtatttagaagagtattcttataaaagtacaaagcttacaaaagaggaaagggaaactactagagccatacccgaactcttccgaagacttccggactcctgattcctattctaattctattccaccagctagatactactaaactaaacttgagaggaatgagagagctcttgcttgaggtgtgtgttgaagtgaagagagtgaactccttaaataggcaggtaatgacggttatggtggttggaaaggtcggtaatactccatcgttccctcaaatccctgcatccatcggcttcacgggaagttcggctgaaccaccaggttcggctgaacctagtgtggcccaaccagcccacattttggctagtggccccctctgctgcttcacttcgtagacttgtgaaatttggcccgattcatcgtgtcaagtctgcattcttggcccattcatacacaagtctgtttctcgacatcgttcgattgatctatcgtctaagttgatgtcgattttccttcactttattgtcattctctgcaaaaggttagtagacctaatacttgtggaatattattattctaacatatttatgcattgcaatcatcactagttctcccttgttttagtaatattgacggttgaaactgatcgataacgaccgtcaacacca

SEQ ID NO: 51360 - DNA, 1501 bp, Oryza sativa
ttactctaacagaaaatagaagaattgcaatctatcaaacaaattaaacagagtattacctactaaaacagaggaattgcaatctggcaaacaaacttaatataatattagctagtaaactgattccatcatccagatggaacctgaagatcatttgcatcatcccagctaggtgtcgtcagaggtgccaaacgcaacaagaatggaaatgcaggacccctgaaaggttcatccgaaccgttgcgaaacatctccagcttcatggtgctgagattgaggacgagaagataggaattagatttcctgatggaccagaactccatgtagacatagccagcctttgctgccagcacacgcaccctcttcatccactcctcactccgcagcttcttcaagtacccaaactgatgcaacaatgagatctccttcttaagcagccatccaccattgatggtgccgctgccgctgctgcggacccagagctgaaggttttgctcctggctggacacgaggcagagcccaccgtgctccgccatgtcagcgacgcagtacgactcccctacctgaaacggcgccacgatgactgtccaattcatggtgcccacatcgagcagcaagatcctctccacgttcttgttgttcttggtgttcgaccgccagtacacgaaccggccggcggacatgccgtcgcggtcggtgaagcggtaacacaaatccgcctccgcgtcgaagtcgaacagggtccatttgttggtgcgggaggagaacatggcggcggatgtgtcgtcacagatgccgatgacccggaacgaggcgtcggcgtcgtcgacgacaatggcgtacctgaccatgtggaacgagcagcggaaggcttggggcgggcggaagaagatggcagtccgcgagatgggatcgtagacggcgaggtcgagcccgtagcggccgcgggagaggagaaggcggccgccgtcgcagccgcggaggcgccactcgtcggagtagaaaccgcggccgtcgtcgtcgtcctcgtccgaatcgatatcggggaggtcttcgaagaagatatcgcaatcggcggcggcggatgccagattgggcttacgggcggtggtgcggacgaagtagatgttggggcagtggcgggggacgggcttgtcgccgcggtcggtgaggatgaaaccgacgagcggaggacggcggagcgggaggaagcgctggagaatggcggggtcggaggccgcgcgccgccagcgcttgcaggagagggcggcattgacgagtgacgccatgttggggaggcgaaggagtatcttccggaggaggtccacgccgacggcgtcgatcggcggcgaggtcatcggcttcttgacgccgccgctctcgcttctcacacacggttccatctcgttctctcttagtagaagtcgcaccgtggaggagtacgcattttatacagttgccatttcggcgcgaaatacactttggattcccgccaaaaact

SEQ ID NO: 51361 - DNA, 1501 bp, Oryza sativa
agaagcgccggctcaaatgtagctccaaaagcttcttaccaaagttgtctttttttaattctttttttgtgtttgctgctccagtaaaaaaaaaactttttttagtctcttctaatataaaataaaatggcagagctcctacctgcttctttgaaaaaaatatactgaactatttgagagagcatggaaaacaagttaaccaagtatattcaatagaaattctttcggtagtgatcttacacgcatggcatgtaacggtgccctaagagcaaggctaatagtatagcccattgccggctacactccattttatagccaacgctgcagccaactgctcatacagtaggttgtctgttggttggctacatctcatagatcaaataattaattataactagcacatgtcaatgtgtatgatcaagagtgaagtggatcattgtagccaatttgttgtggcatgaacatttgtatgctacagaagtaatcataaaacaccacatagttaacacaatacagtgcacatcaaccaaatttgtgttataagatgaagagtctccgtagtataaaaaaatacaaggcaccaacaacagataaataaaataccatagcaagtagattaatggatcatcccaggtctaaacaaaaggatagggtagtgcatgtctaaataaccgacaaggtaatagaggataaaacaaaacatacttaatggtttacaaatccaaaagtcacaaacaatgtgacattaagcaaaatacataaatatgttatctaacagatagataacgatttcttcatctaatcaaagagagactcttcattgaaccattgcatcatatgaccattgcctgaactaccatcatttgctgaaaaaaaaaagacagatgtatcatatgacatgtacatcgtgtgatgaataaatgagaaactaaaaattgcacagtgaatcatcttttcaatgaaacctcactaaaaggagtaactactgcatgctttttccttagtacaggatacgaaaaatgtgatgaaggagatataaatctaaacaagttaattcagtgtgagttctttcaaagaaatagttgctgagataattaattgagtgagagatccagtatatccaaatgcataaacaagttaattcagtatgagttcaacatgtaagagcattaagagaatgccatgctactgcatcccaaataagaagagagaatcactaaactatggttgtaagtagtctggcctaggagtaaatttagttcatacaagttacctgtaagaagttcagcaccatgaattggacaagagaacatcttcctgaaatatattacacaaggattaattgatgatctatatatgacaaaaaaagaaggcaaaaaccacatgcttattaccctaccatgtttatgttgactgcctatttccaaaccgattccaaatatgctcaattaaatcatttttcagctgggtatggactgaacgagcacgaatagcagatctc

SEQ ID NO: 51362 - DNA, 1501 bp, Oryza sativa
ccgatttggttagcttctctttccaaaaccctagctctttccttctcaccgccggtcgccgtgggcctagccaccgccccttagcccctataaaagtacccccaggacctcctctatccgccaccaccttctccttagctcgccgtcgcccgtagcaccttagccactagagcccgtgcgccgccgaagccgaaggaagtccggctgtgcgccgccggcgctccggtcgtcgtcgtcgctcgggaaggctaccatcgggttcgcaaggtcaccaccgtccccgtcccgccctccgtttccgtcgtagaccgctggaggaccaccgtcaccaccgactcgaagctctccgccgcttcaacctcgtcgccgtcgtcgatcatcgccatccgtcgtcgtctgagccaccgatgagttcgttgagccgagctctacgccttggcgccctccgtttgcgccgccgcgccattgttcgctggcgagcatgaggtgccgggccgccgccggtgatgatatcattgtcgatcgcagtgccacgtcagccgtagaccgtggtagaccggatcgatctctgccgtccgattcggtcaattttaggtcaattagatctcggccgttggtttcgtggaccgcttctgtgaacccggtttatggtggactgtccttgatgacgcaataaatctcttttccttttcaaaagtaattttttattgcgtcgtaattcaattaaaatatttatactaggctttaattagattaaatcttgtgaaattcgtaactaattcatatgaagtcacaatgaggccattcaagtctcataattcatctaaatttattatcgacatctttgtttactttatatgtactgtttatttggtttttattagtctttttcctcattttgtgtgttagcttgtcgttttcgtcgtttcggaggttcgcgagtgcgtcggaagtattcaagaagattaattgaagaccgaatattgcaaggcaagtcacacagatcccaaacacaattcctttaagcatgttgatcctatatttaatttctttgtttatttcaactgtgcatttattttcgaatgtcaccgggtggtgtgaacctgttcctttgttatggcccatttgcatgtattagatctaattgcttagccatgcttagaaacattagcacactattaggctgattaatgcttcactattacctaatgatggatatttaattgtagctcacgatggtcaatcgtgattggttaattaattaatttgtcaactaaaacttgacactggtgggttgtgagtgttggtatttcttaacgacattaccagaaatataattcccggcaatggcgcagaaatactcttgttatattgtggttaaagagttcatccgcaagcacacggatataccattgtagcatttcacccgagagtacttcaagggtatcgtatttattttatcccatgggaagatcatgtagagagaacttgactaataatt

SEQ ID NO: 51363 - DNA, 1501 bp, Oryza sativa
tccatagcttccaaagagcatcttccttctcttcttgccaagtatccagctgatgacggtttccaccggtgaaaatggccataaccgtcattgtggagcggtttgctaccgaactgaacttgggcctgggccagcggcctctctcagggtttggccgaaccctggccggctccgttgttcctgtttttcctcgtggacactgattttcaggccctcagtccattggcatggtagttgggcccatttggaggtgtttaattgggtttttgggtccaaaactccataagtttggatataagtttgattctcctccttctttatgtatatttcctttcaactttggtagtttgtcacctgcatccaaatagataccaacactagtggaaataattagtaataaaccctaccactcagttgaataccgtattttattccactatatgcagatattgacggtcagatattatgatttaaggatcgtcaacacgtaccagccgatgaagtcggagccgtgtgcgtgctccaccacgatggaccgccatcaccactagcatcactggagattggatagggggagtaggggagaaagtggattagggttagggtttttggacccctcccccctccggccagcgatttaatcggcacaggaccgatccaagctgtccatcagatcggatggctcagatcggccccacattgggtcggcatgccatttgggccgacactagcctctcggccaaaaattcatttttcatttattttcactctaaaatcacttactgttttatttaatttataaataattttagtcaatttgagccatcattttaagctataaaattgcagtaaattttgttgacgcattttaatttatttctaactaaatacaaccaacaggaagtttagttagaatatttaattattttttattcccccggcccactggaattacgatttaggaataattttgcactttgattttttttttgcctaagtggaaccaacaagaaatttagcaaaaaaatattccttttcaatatgttgtgatacttaaattttaattattagtatttatttattgttaatattaatatcattttcacgcgttgcaacgcacagacatattgctagtagaaaaagatataaataaaaaccgacacctataatataggtaccggttacctatatgtcggttctatataaaaaccaacaactataatattggtaccggtatttttgttaaaaaaaacccgtacatacaataaacaaactataggtgccggtttattgaaaactgataactataacatatgactggcaccctctgtcaatccaaccacccatcgatcgtacttatccatccatgtgcccctctcctcacgccatctctgttctccagttttatattttctattaagcacttaaatattaggcaacattatgcgatattggttgtttgcttagcaacctccgcaatatgctacgaaaaggaatactt

SEQ ID NO: 51364 - DNA, 321 bp, Oryza sativa
aatcgatgccaacgtcaaccccagccaacaacaacaatgaaaagagaggaaacgtagaacgcacacctctgctgctccggattgctatagcgccgccaccgaggaactgcactacttcggctgccgttgttgcttttgtgccaccacgcgcgctcgttaggacaacagctgcatgagcacactgccacgcagcttaacagtcgcgtcgctgcgacaccctgcttcgcctgcagctacctccgctccagagccttgtagatccgggaggagcttcgatttaccaggacagctagaggacgaggaagaagtggtagtcggtga

SEQ ID NO: 51365 - DNA, 384 bp, Oryza sativa
caaacttacatgagtcaggctctgatatgttcgccgtcattctgaagcagctataccagcctagctatcacagagacacagacgcaatgcaatcaaaagtagcataacatgaacaggatagcttgggcaagataagaataagcttttgggtgccaagacaaaaacctcctgatgcagtggtccaaatacatgcatgctcctttaacctctgccagtactccatggcctttctttctggcaaaacagattcctacacattgcatgttgtaacagtgtagaatgcatgctccacctgaggtcttggagaacaaacattgcaaagctataagacagcacaaggctttaatcatgtgattatcctttttcggccatcaatcattaaca

SEQ ID NO: 51366 - DNA, 1501 bp, Oryza sativa
ccaattcatctatagtcaatctaatagctcattcatacaatagttacatactacactattaatatctagtcccacctgtcatacacacactgtgtcttggagtctgtgctacagctggctacaaatatgtagcccgctgctcttctctctcatcatttatcttcttaaaatatgtttataactggcttatagcatgctactgtacctgctcttaggggccacaagtaggagtatatgattaggtgttgacgttggtttcaacaaacaccgagttaaagttagtgttctaactaatcccattagctgatgtgacttctaccaaccacttcgttatgaaaaaagagagattctagacaaacttttagtaggccttttacctcgaaaaaaaagaggaaacttttagactgattttagtatttctttggtgtcccagatcaattacctatgcgtagtattttcactcgatctcctgactcttgaaatttcatgtgtttctcattccaatcaagctgtgtttggtattaattaaacattaaaactatgtctgcaacatagatggatcgatgttggatggtcctccatctagttggcgacctaacataatcacatcttgcactgcacatggagaagggcagaacagcaaaagcacaccgatgaacatggggatgtgactgcgtgagagtacttcagtagttcagttcagtaccaccagcaacctaataaggcaggtcgagaataattgtcagtttgatcaccagcctgatgactagatgagtgcatgtccacgctgggcaagcgttgcaccgctgaattcagggcttcaggccttgtcaactttgttcggattccactttgttcgttccctgcttcttcgatccaggccagttggcccatacatatttaggcccacaaacaacagcatttcactccagttcctccaccctttctttctttccttcttcttcttcttcttcttcttcttcttcttcttcttcttcttcttcttcttcttctaacatacccctcattgttgactagttgaatggacgtttgtgcgttcacaaatatgagtgtacgcatattataagcatttacgtttgtactatgtttctaattatattaacgacgtatggtggaacagggtactctacattttaaggttactatctaacttatgagaatacgaagaatctaagaaatacaacttctagttgctattttattttttagattttcaataacagtttcttataaactggataaaaagatgtacttttagtagaacttttgattatgaaagaaattgcagttgctagaagctttccaaacaagccttaaaattttgagaagcatttgctagaatatgaattagaacaaatataggtctttcagtttctgtcttgttaggctgcgttcatttctctaacaacatttggatgaaattttagatatttatggcacgcttttcaaactactaaacggtgtgttttatgtgaaaatt

SEQ ID NO: 51367 - DNA, 182 bp, Oryza sativa
aagtaaattaagatctgtgatgtgaatgttttgggatgttactttgatttgggatttggggatatgcatctcactcgatttgggagaaaatatagggattaaactctggctaaagaaacaataaaaaaaaaagagaaaatgagacctattgacagtgccattgccctctctttagtcctagt

SEQ ID NO: 51368 - DNA, 1501 bp, Oryza sativa
cgatccggccatatcattttcatttttctcttagctccaagaatccaattcatcgtgacgtcggtatcgtccccatgaaactgaaccgcatcatcttttcatttatacttatacttatcagttaaaatttaagtttttaactttaattttaaagttgattttagaaatttttcatcatagtttattttttagtctccactattagatcattgagaacacgtatgtaaaagttatatccacaagtgtttatttttcatttgtaaatataccgttttgcctttttctctagcggagctagaacgaaataaagtgaggtgccacttgtttaatttactctactttatatcaagtttaagatgatacgagtgtctaaatttatattaagagtgatgcatacatggtgaaaatagatgggtttgcctgcgtgcgtttataaagatgagtgcgcgtgtgttgtgaatgtatatgttgtactgtgtaattttaaaaaataagttatagctataatattttcttgaccaggtttcacccgctcaataccctagttccgcctctgtcctatagtaggataaacaatggggtcggaatctttttccctcgtgtctatccacaaacgccaccgtggcctcccgttcgattcgttcggttcgcaatcacaccagaattattaaccaccggattggtggtagaatgagaattcaaatcgttttttttattattgtggtttttgtgatgtgtggatgctgcactgcttaccagcagtagtaggaaatcgaagtttctaggttagttaggggagaatgcggaagaagaaaaaaaatcctggaataattaagcacgtacttacgatatcttagtctatgattgtacgcaacttggaacttttgataagctgtaatgcgtatttgactcgccaaattggggttttcattaattccaacttgccgatgcgatttgcctggcgttcatttttaaaacgcatgtataagtaggagtagtacgttttacttgtttaataggagtactaatgacgtaagtatacaagtcgatgcagagatcaaagcacgtttgtctactgacttggcttcgccaactagcctttccaattgtaaaaatgcaagtactagtactgtaactaatgttaggaacaagtcaaaacttgtctagagtgttccacagcatttgtttctatttccttctgggtgctacagatcttaattaaactttttagaattttcggctgatgttttttggcatattggttgacttcgggtctccggttaaaacctcctaaaagaaataaacgagccaaaagatttttagaacattacttgtatgtttctactcttaagggttaataaaaaatacacaaccaaaaaataaaatatgataaaaaatacatataataatttaaaatgttggatacggcttacaaatcaatcagcaaacaataaagtgtctatttttataataaaattcattttcattcatgcttcaaatt

SEQ ID NO: 51369 - DNA, 1501 bp, Oryza sativa
aatgatgaaccccctacttctcaacaactcttgagaggagaattatgcagacaataacaaactgttgattatatctttttttttcttttctttttgcaacttttgtatgtatttgctgcactgagtctatttggtggttaagaaataagatgtcaattgaacataagttcccttcaaatactagtttggcgctttacaaattcattttcttgtaacagtccaggagcattctgtttgagtggtggacagagataaagtggtagctggcttttgttctgcagttgaaagactggatgctgtcgtcaggaatttagttagcgaatgttcagtgatcttttggtttcattctgtgttggatagggtagtgttggctcaatgttgtctaagcttttggctatggtttgagacctcttcgctgcgctgttaagctgctaagcaaccttttatgttaccttaaaactcttattcagctttcaatagaagctggggtaatatcactttatccaaaaaaaaaaaagagaagggcttaacattcttagctgtgaccatttctctttgatgattgggcaacactactttggcagctcgcttcatcttctctccgggaatatctatagttatcagtcactacagcaattgattgacgttatttattttgaaaggaaacagttttttttttttgctagctcctgcagagaacattattgtccccttttttttcatctctgttagagcaggtacaataaactgactcagcaggctacaaaactgtgccacatcatcctattcctacgtggagggaagagaagtgaagagagagagaagagaacgaccgactaatttgtagcccggcgatagcgatttttttactccgcatcgctcgcctgcagccgcactcagcgattaaaaaaacacaatgcgggtcccacacaaccacaggggatcacgctttccatccgtatcgccctccccgtccgcatcgccctcctctccagatccccttcctctctctcgatcgccgccgcctcctcgattctcagcgcgcgacgcaatctatccccccggctcccgcgcttctcccctccctcccgcgcggttcccgcgcttctcctctccctctcccgctcgcgaaattgcctacctatatgacagagaaatccagttgctccaaaattccccatcgccatattccgccgcttccgatctccctcttccgccggccaccgaatcgacagccacctcgaccacagacccgctcctcttccaccttgtataatctctcccgcccccgcaagaaattcctgcctaaaaccctagttccccaccaccaacaccatgtctcgtcggaggaagagggaggtagcgccgcctcctcaggccgtcgtgagctctactgctccattcgctgttcctacgtcgcaggcagcgccatatccatatgggggtctcgggttcccgccgccaccgacagcttggcttgcttctccacagccacaagcca

SEQ ID NO: 51370 - DNA, 1501 bp, Oryza sativa
acaactactagctccaaatcttctatagcgcctgaaaattcactagtaattttcaaactaatttatgcaataaaatcatcatccagaaatcagccgaggtacacaaactaataatttaatatacaaatccatcataataataacactacatacttacaaaagaaaagaaaaaacaacagcggaattacggtctagcgaagctccggcttcacttccataggcagctcaactggggtataaaccaaacgtcttctccttctatttccttttcttcaactgaggtttgattgattattgcaagatgagtacatggaatactccgcaagccatacagcaaatatgtaagtgtacaaggataccaaaggatggcataatatatggctcatttgcaaaagaagcatttagcaaacatttgagaattgtaaaacagtagagtaattaattatcaattttaatcaacactgaacatcatacccatgctgcacaggcccaaccaaacctgaacaaccatacccagctgtacagatctatctccaaaccaggaatgtaccgttccaaaccaggagctaatcaaattattaccagttatagcatcatttattatggtgagaagtgtgagactaatcacgaaagacattgttagatccgcccataaccgcgggcacggctattcgaatagctttactctggccagagatgtaccactgtacccacaagacacaacccaccgtcatgtcaccgtgtccgcgcagacacgtcaccatggcgagtgattatgacaagacccctcgcataactcaactcaaagctgtacaccattcctggatcaataatcacccccttataaaacaaggcatggactcccagcaacccccgtgggtttatctccaccacttctcagtctgccacaccacaatgagccttgctatacaaagtgtccagccgttgcccattctggcttgtggttagcatgattaatgtttcataaccgaatctcgcgaaccggtccttaattgtcatgagcacgaccatcaaaaccatgtgctcactgttgacggtccttatcgatcagtttcgaccgtcaatattaccaaaatagaggagaactagttatgcttgcaatgcatatatatgttagaataataatattccactagtattatgtttactaaccttttgcagagaatgatcattaaatggaggagaatcgacatcaattcagacaataaatcaattggacgatgtcgagaatcagatttatgcatgaatgggccaagaactcaaaattgacacgatgaattgggccaaaattcacaagtttgcataaaggagcaatggaggagaccgccagccaaagatgggccaggatggcctagcccatggttcggccgaacccatcctgacgccttggatgcagggttcggcgtggacgtccaggattgcttcccaatgacggttggagggcactttggacaattctccttccacaaccatcataact

SEQ ID NO: 51371 - DNA, 1501 bp, Oryza sativa
gctttggtgcgggtataatgtttgcatatgcaattactctatgtcatgacgatgatattagagtagtatctggtagtttaggcgtagtgtctagattacgggatatcattatctggggttatatgctgcggatgagaggtgggctgctgatggtgatagctcagtacgggtattcctccgcgcgtgtacatagtcctaagttaattctctggggagggtatttctccgtatttagccccggttgtatggtcatgacgggttgtcgtaaggaagtcggcagtcaggggtggcttctcgaagtactaggagggcatcggatagagggtatttgctagtatatcagagaactagaatgtatgtataccgtgtatactagaagaagtataggaatagattatcttccttttttctttccatttagcttagataatttattatgagaatgagtagcttaatgcttgtgtgtcactctacccttggattatcttaacctctgcttaggatatgattatcacaagtaatatataaattattagtcaagttctctctacatgatcttcccatgggataaaataaatacgatacccttgaagtactctcgggtgaaatgctacaatggtatatccgtgtgcttgcggatgaactctttaaccacaatataacaagagtatttctgcgccattgccgggaattatatttctggtaatgtcgttaagaaataccaacactcacaacccaccagtgtcaagttttagttgacaaattaattaattaaccaatcacgattgaccatcgtgagctacaattaaatatccatcattaggtaatagtgaagcattaatcagcctaatagtgtgctaatgtttctaagcatggctaagcaattagatctaatacatgcaaatgggccataacaaaggaacaggttcacaccacccggtgacattcgaaaataaatgcacagttgaaataaacaaagaaattaaatataggatcaacatgcttaaaggaattgtgtttgggatctgtgtgacttgccttgcaatattcggtcttcaattaatcttcttgaatacttccgacgcactcgcgaacctccgaaacgacgaaaacgacaagctaacacacaaaatgaggaaaaagactaataaaaaccaaataaacagtacatataaagtaaacaaagatgtcgataataaatttagatgaattatgagacttgaatggcctcattgtgacttcatatgaattagttacgaatttcacaagatttaatctaattaaagcctagtataaatattttaattgaattacgacgcaataaaaaattacttttgaaaaggaaaagagatttattgcgtcatcaaggacagtccaccataaaccgggttcacagaagcggtccacgaaaccaacggccgagatctaattgacctaaaattgaccgaatcggacggcagagatcgatccggtctaccacggtctacggctgacgtggcac

SEQ ID NO: 51372 - DNA, 1501 bp, Oryza sativa
caaacctgagaagaagattttaaaacctttttctatttaaattattcatgaaatgaaattccatttattaaaaatacttcctttgatcaaataaatcccagaaaaatctaggaactatataaacaatagaagtatataacaaaattttatctagcccacttttatattgagatttagcaaattaaaattagatcttctcttttaggcttttaagattatttctaataattccttttaaacaacaatttataatctaaggatttttaaacaagaaaggcacttaacaaacttataattagatcattaattgataaatttatagattaactaattactgaaacattctttgtattattaaaattaggaattgagctctgaaaaatcgagaaaattccaaagtataattaatcatggagaatttaatacaaattaaatccaaccatgctttatgtttaggaaattttatttcccacatttaacttcacttgtaaattaatgaacatttaatataaattctattaataatttattaaataatttataaatcctaaaacggaaattcaagctgtgacattgtcagttttgcttgttggtgcatttggaagcaacataatggactctcaaatgagattcgtctgcatgtctgcagaatgaatggttctctcacctctttcattcttagctggttacagagcttgtagtttatcaggttttgttttgttttttgtttttctgtacatgactcttcttttttttaatatatataactactaggcaaagccctggtagtaatatctccatccttttcttttctcgtcaagccacattaccttacttttacatttggattatcaatctatatactatttaaattatcataaaacttattaacttatataagcttatattgtttagctattttcatattatttttatttactgctatcatactaaagttaaagttaagtagcaatgcgcgagatttcacttagtatttaagtatgactgaagtacacttgtcttgctgccaggccttcaaccaaacaatggtcactagtcaggctgtgcaaaattcttttatgtttcaagtattccttttcgtagcatattgcggaggttgctaagcaaacaaccaatatcgcataatgttgcctaatatttaagtgcttaatagaaaatataaaactggagaacagagatggcgtgaggagaggggcacatggatggataagtacgatcgatgggtggttggattgacagagggtgccagtcatatgttatagttatcagttttcaataaaccggcacctatagtttgtttattgtatgtacgggttttttttaacaaaaataccggtaccaatattatagttgttggtttttatatagaaccgacatataggtaaccggtacctatattataggtgtcggtttttatttatatctttttctactagcaatatgtctgtgcgttgcaacgcgtgaaaatgatattaatatt

SEQ ID NO: 51373 - DNA, 1501 bp, Oryza sativa
tgaaagaacccaaagcagcaagtaaagaaaagtaggtataagaaagaggccctacgaaagggcgtcagcaaggctgctataacacggccacacgagccattcatcagagatgcaacagcgtggatccgccttcatcttgaccagcggtagcgatggaggacgaaacaatctccattgatgagatgctagttcgtggtgaggaagaggaggggaatttatttgcatctgaactctatctggacggagaagaggaatgggaatggttgcaagaaaatggatcagtaaaagacaggagggcagggcagtgaggcagttagcggtgagtggaagcagcacgggagcggcggccttgcttcctgttggtgtggcgaggcataggacagacggccagatggggggtcgcagcctcgcagggttggatggacaggtgcgtcgatggggcggggaaggtgaagtggccggcgctagaagggggaggcgaagtggaaccggcgcgcagagtggcgccaggaggaggacgcgaagcggggcacagtgtggatgcggtgcgggggcggcggcgcgagatgcaggaggggagttgatgcgcgtggggccgccaaagcagagtgatgcgggagaggagagaaggggagcgtggagccggcgaagcagcgagatgtgggagaggagaggagagaagcgacgcggaaggaagggctcgatgcggatccaacggtggggacaaaaaaggtgacgtggaagcaccaggaagcagagagttctagtagtggggatgatttgtataggtataggattccagtctcctgaaacatgcaggttttctaaaaagaacataaatctacatcgagaggcctatcgatttgtgccatcgcgcaatgctgggaaagccatccatcccgcgaacaagcgacatggtgtccatcccgtgcgtcgtagcgttctgaccgtgagaagggtgcttcttcctttccatctactcaggttatgcttttacgtggattgactatgtctgatgaagaatttgatactttgatggaggatacttctctagtggagggagttcaatcccaggacaatttagttgaaaagcttgctgctgttccagaagtgatattgtctccatctaagaagagtaagaggagaggtagtgacatcattcaacacgctctagaaagggcagagaagataaaggctgacagaaatctagaaaatcaaaaggctaaaggtaacttgcataataatgtttcctttttacatttttctaatgatgatatttctgcctctttacaaaatcttggtatttttgctgcaaataaggatgttagcttagatgacgctattaatgatataagaagtgtagaacatgaaagacttagggatcatgttagtttaaatgataataatgactcgagtttaatctttgataatgatttcgtagaggatcaattagaggatatctttttactacatcagttatgtagtgaaattatggatgagg

SEQ ID NO: 51374 - DNA, 1501 bp, Oryza sativa
agacatgattggtactgggtggtgcttcgtgcgagtgcacgacgctgtgcaagtatgcctccagaaggtgcagagctcatcatcaagttccataaagctgtcgccacaggcatcaggggacctagctgactccgttaccactccaaaggttcaacagcggtatagttttctaaagaacctctggaaatcacaggttggggacgggtgtacaggtagtgaggttcaaccgttgctacgccaaaaccttgtttaacattatggccgactacctttctattagtatctgtctgcctgtttatatttgatgtacatgtatgcatacagtgtaaaggaaaaaaaaggaatatgttattactctcttgcaattttatatagaggaattgagatggggttgtaagtggacagtatatgtgctgccaacacattggttatctacacataaggacgtagaatatgctgtgtactgtacggtgccgcggcttgcctatcgtgaggagttgaaatgttcgcaaaattcttgtttaacttgtaagtttatgtatatacattttcctaggcatgtaataacagccgctttccatctgtatgagtcgtttttaccctattaaggcttctttggttaatccctaaaagaaaaggattataagggtaagaggattaatttcacacctcaatatacgtggaataatttttctccaattccctttcaatcctttatgaatgggcctgagcttggtttgataaaaggaataaggcgtttgacgggtatgcatgcttgtgaccgtaagctgaattataccagtctcctcaattagactttgcatcatagacgattcttaataactggtaacttataaaagtgaattaggataaaaattattttggatgtttttgtcctcatgatgttatatagaaacggtgcttcgagaccataggtaatactgtgggaacatctctgaagaagattttcaatagtataatattgtagacctgtatgaacatctctaaaggagattaatattgatgttgtgtactgatttgtagttggacaatagtaaaatgaggaccacaaaatttgttaggagtgcatttagatcaaaacaatacttgtgcaatgctattcagttgaacattcattggctctaaatcaaactgttcttttatcatgttgactaactcaagtagaatcaaaccaatggccctgggtaagatcttgtcaggcaaaggaaaaaaatagatacaataaattccctaagtaagacattttaggacaatattgttaacgatgaagatgaatggattatgtggcctattatgcatccattgtgggagcagaatagcttgggcacctctgatatctttttttcatataacctagatcattaatttttacagtgttgataggaataaaactatgtaatgtacattggataaaaagaactgaagagagatatttaaagcatagaagatcacctctgggaacaaacttgacaatgcatca

SEQ ID NO: 51375 - DNA, 1501 bp, Oryza sativa
cgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaaccccagaaaccctgaaggggtacctaactacttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtattcatagtagccatggtcacatcaggaaagtaactaatcaatacataaccaaataatcttatccaaagattttgaagccgccatgccatgggtgcaggagcatgtgtatgcatgcttctcctctcttcctgaccccctcatgtgctctacgtccatacatattgctctttgtgccctactgcgaccttgcctaaaccaggatatattgccgtcgacttgggacggaaaccaggactgcactttgcaatccaatcctcatggtgaatgacagcttatgtattatttatgcatgcctctggtgatttccctgtcatgcacctgatttgacccctctgcaacatggatttggatagacttgctatttctaactgttatgttcaagaattttaacttttaggtatcaggttctgatatattattgcagggcaaaaaggtaattctagtcctagtaagtaggaccatgaaaggagttctacgatgattcataaatatagcttcataggatgaggattcctgctctgtcttaagaggacttgcaagagggactcatccaaaggaagtaactagaagtaattaggtcacagtagatgattggaggctgtgattctttgtgccgtagatttttgtgtgggataggaatctgatagtctaaataagtcaagacaaccatattgagagttcaataatcccttgtactgtttggaggttgtgcttgaagaaatttgtagtccgctttgacatatcttttctctcgccatggattgttttgtcgccgttatttttgttctctataggataacagaaatatccagagctgctgcatagtattagagtataacagttgatttaactagattttatggtctgtgtgcagccgtattgggccgcttacctggcaccacagtgtaccgaaatagattgcaataccctgaggc

SEQ ID NO: 51376 - DNA, 242 bp, Oryza sativa
tgtgggatggaggtagtataaaatctagaccattcctttcatcagttattttttttctacacacaccttggctttcatcagttattacttatttagtcagttaactctggcacatgcatcagaaatgttgtacttcagcttgctgatgcaatcatacaggatcgctgtggcaactggcaaggagacattggagtccaaaatttactaaagagtcatgcatttgggctgagttgagttggtca

SEQ ID NO: 51377 - DNA, 307 bp, Oryza sativa
agaacgattcaagctgtgaatcttcctgatggtatggacaaccaattgtattcttctcatatcttttcaggcgtgttgatatggccattctccctctctcgccctcgccgccgccgccacccacatctcctccttcattcttcgattaaagtttttagcgatcatgagaaactaattattgcgcgcctcctgtacgtttttgtttggagtgagaaactaattatcaatgaaaattttgtttacatgctgccaggctgctggaatagtggaagctgtggagggtctactcagatgttgatcgaaatgg

SEQ ID NO: 51378 - DNA, 1501 bp, Oryza sativa
tggttgaccgaattacacccctgaactcgaaaaccggacattttacaccctcgattattgaaaccgaacaaataaccccctaacactgttttgagtggttttgattatatataaattacacacgtggcgctaacgtggcaatccagtcagcaaaacaaaataaaaaaaactcgctgggccacttaaccctcaacccaatcccttcagtccccccaactctctcttgcacatgcgctcggaccagcagccggcagtggaggtggacctcgtctgggcggcgggtggcgaaggtggatgtgacatcccggtccagggtttaataggattaatagaatactcatatcaacaagttgcaacttcttttccggaagccgatctctaaagaactttgaggttaagcgtgcttggcctgaagcaatttagggatgggttggcgaaggcggaccgggcgaccagcgacggaggcggacctcgttgggtactgctgtaatagtttgggggtagttcgtacttttttctataattaaatatatttagatgcaggaaatttacaatcatcaaatcatgtatgagattatttgaaaaaaaatacaagcatgtatagattaacaattacttttgaatatttgcatgcttgcttggtatacatattttggtttgcatgcttcagcagcctatgttagtcgttgtggataacgtcctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaattaaccgaatcaaagatacagtcaacgagtcatcgcaagcagccagctagctcgcaatatctgcatgagaaactgcctagtgcatggacattgggaaagtaatttctacgtctaggttaagcccatagtctcatactctcacactaccatcaacatctgcctgccattgcatgcatgcatgcagccaattaaacagtcaaaaaatggctgcaatcacatcactcctaacccatccaactcatctatataagctccaaccattcctcccgagagaacccaagttacacacacttgatcaactatctaagggtgtgaaacacacagcattgagactgtgagatcgagctatagtgacagccatggc

SEQ ID NO: 51379 - DNA, 1501 bp, Oryza sativa
aaaatacaacaaaattgtaaataatatgtcatgtttgcattatatttaaaatacacgcttacatgtgatttaaaatattttatataataattgctagtaggtgataatatggtacacttgcatattgagctttagaagttagtgggcatcaactatatagataatatagatttaattccgagtccagctacacaagtatgaggatgataaggaaacatacaacttggatgtcaaaatctaaagaggatggtcataaaatttccactatttatggatggagatttagacaaacaattgctttctaaataatgtcttttcatctggattttgttgtttttttaacccttgttattatttgagatgattagtgcatttgttatatcttctatcgaagtaaagacctaaattttttatcatcttaaaaaaatatataagcgtgtttcctttgcctgtaatttatccaatcatccggttggaacgtgccctaaaatggtgttactgtctccacaaacttcttcacaaatgtttccacagatcgctttggtgaccttgcaaaaaagacgcgaatattagcgaatgatttaatatcaaataattagaagatgtgaggctaaaaaccagattgtctagctcaccaccttatggagctagccggaagaccctggatgtttctcagtaatgacctagcttgctttaattgctaaaatggtactccctcctttccaaattgatcaacatataatggaattcaaaatttcttaaattgatcaaaatataactgtatggacatggattttatcagagtacaattaatacggcataagaaaatgtgtatatactaaggtgtaattgttatggtgttttaattgatgaatacattgtgagagaatatatacatgatgtcttaattaatgtgatttaaattatccttagttttagtgcataaacatatatgatgatcgaaggatggagtacgtgcttctatcctcacccattaatgtgccttatttgggcccgggatagatgccgatatggtagaggaggcttatcttgtcaagccttatcgaagagtgatcagatgaacagccatgtggtttcatcaaattgatcatatctcaaaccaaagtagtcggacaaatagcaaatgagaaccgcagaaagctaaaaacgacgtgtgcttatgtgtgttgctcgttttaattttctgaacatgacacgacgtggcctatattgcgtcctcgctcaagctagctacaatcagggcgtgcctacactatactacccggtgtcataggacaccggatagattattcaaatcctatataaattacattatattaattaatatattagttaataattagataattagtatgtattagatctacggtaattttttttctgagttcaccactggctacaatctactgccgtgctcggtacaaactgtccccatgcaacattgaaactaaccacttgtagtagcgattcgtttggcagc

SEQ ID NO: 51380 - DNA, 1501 bp, Oryza sativa
ataaaaactttaaaattaagttttaagatttaaattctagcatcgatgatatatatatatgttgtagagcaaaagatatggcccatgatcgtcgatggctgccgcatgcgtcgttacctaatcttaagctctgtggaatacagattgggcgtgtactactggttggttcactttccactagctacagtgagccgtggccatcggccgaactgatgtagaaaattagtcaaggtgtaataccgtataactcagggatggcaattttgctcatgggtccgggtatccgcggatacccgacccaataggcatgggtgtgggtgtgattttttatccgtggatatgcccgcccgatacccgaagacattgtgggtaacagtcgggtttcattttttacctgtcggtaactcatgcccgacccgatacatatctattagctaatttcaacttatctcttaatttttatacccatttctcttggttcatttgtgatactaactaataataagttgtgatgtaattcaaattattgtcgataactaaaatttggtaaattgttaattttatttctctttgttaaattatctatctttcgaattattatttatgtgagatccattgggtacccgccggatatacccgtgcccgtcgggcatgggtatgggcacggagttttgtctgctaactctagtgggtagggttcgggtgggtgacgacgggcatggggtcgggcatggttttgctctacccgtgcccgacctgacctgctgccatccctagtataactgatcgatactgcacacaacgcaagtgcgtgctagacagtggacactggtgggagtgggggaacctatttccgtatacacagatgcaatgtgacacttctataatttatccctgctttaaaacttcttagtgtaaccttctccctttttttcttctacaaattgaccaagtggcatcatgtatttactaaagtacacggccagtctttaaagttggagcgaggtgtcacttaggtcatgatcttgaaaaattgaccgggttgactggcttacatggccgtccagagtgacagcatatttgcatttcatccccttgggatccgatccaacccttcttccctaaatctttttttagtgtgatttctatggtttgcggttgcgggccgattggggtggcagtggaaacgcggcggcggcagtgacgacgacaatgacgacgaggagggaggcgggtacaacggtgggttggcgagcatgcgcaaagagggagaagggaggcgactggcggggagaagggcgggggacggcggccagcccttctcgccatcgcttgttgtggccgcggcgggacctgcaagcgctaggcgagccgcctcaagtacccggaactggccgagtcgaggtcgccccaggcgaagggaagcggaagggcgagtagggcggtggcagcggctggccagcgaagcggggcggcgagcggcttctagggctcggcggtg

SEQ ID NO: 51381 - DNA, 1501 bp, Oryza sativa
cactccgcagcccatctccgtcgtcaccgccacaacccaatctcttgcgtaagcctccgccaccgccagaaactccaaaacccaaccctccgccaccatcatcgctgccgctgccgccgccgccataacccaaccctaggtcgctgtcatcgccgcggccacaacctagccctccgtcgcccctcctaggcttgctactgccgctgcccctagggcctccgccaccaccgcccctggggcctccgcctccgccgctcctggggcctccgccgccgcagcccctggggcctccgccgccgccgcccctagggtttccgccgccgctgaacatgcgcacgctagatgtgttgcgcgtggtgatgagagggagaagccgcgtggagaggaagagagcgcgatggggtgcggcttggtgaggggagggaggatggggtgcggcttggtgaggggagggagaagcggatcgggtgcggcgtcgagagaggaagagcacgcgatggggaagaagaggaagtgcgattgagataaggtagagcgcttgcaagaaaaaaattcgtgtggaggaggacgcgatggggaagaaagagaaaatgtgattgagataaggtagcgcttgcaggaaaaaaaattcgggtggaggagaaaaatcccacgctactggcccacttcttttttttttttggagcactttcgctcttgggacttgggcgcgccaatctttctggaacagcatctacagggtagaacgaccgctatactgggacggagggagtatctgctgcggtacgcgtggcgtcgtgatcgggtcgtcagtggcgccctcgacatgtagcccgcgtggaggcgctccattgggacaccccagtccaagcagcgtgcggcgcacgtgaacagagctaataagagttcgagatagcgaaagcgacgtaccttcgctcagctgctgcatgctgctgctccattatcctacacttctcggtcgccgtgtatcggtgtatgtacatgtaattaactagggggcagacatagatgctcgcctgtatgcgactgtgagtgagtgcatgcaccacaaacgtacgatctccctgacgttgtaccggtggaagcttcttagattaatcgacttctggacgttggatcccccaatagcttcgtcgttttgctcttcagcttatctttttttttttcacaatcacgcaaaaaaaatgtacaccaatatcttagagagaagaattttttttatacacaatgcaattcagtcagaccggcttatgtcagagaaagaaaaaaaaagtaaaacaaaattattatcctggtttatttttagtattggtttttaaatcgtaaatatatttatacaagagttttacatataaaatatcttacggtttataatcatatcagacggtaggcgaaacgatggctggtgcagtggccgccgcgccgatggatggagacatatgtgcgtcgtggtgggatgtaattataccgagggcgatgt

SEQ ID NO: 51382 - DNA, 1501 bp, Oryza sativa
acacccacacccatgcctattgggtcgggtatccgcggatacccggacccatgagcaaaattgccatccctgagttatacggtattacaccttgactaattttctacatcagttcggccgatggccacggctcactgtagctagtggaaagtgaaccaaccagtagtacacgcccaatctgtattccacagagcttaagattaggtaacgacgcatgcggcagccatcgacgatcatgggccatatcttttgctctacaacatatatatatatcatcgatgctagaatttaaatcttaaaacttaattttaaagtttttatatcgtagtttttttaaacattaacgcttaagtcattaagaacacacgcgcgcgcgcgcgcgcgcacatatacacatacatacatatatacacacacacatattatatatatatatatatatatatatatatatatatatatatatatatatacacacatacatatacatacatacatacatatatatatatatatatatatatatatatatatatatatatatatatatatatatatatatatatatatatatatataagttttaattataaattaactctctatcactcacatatcgtttgatgtattatacataattggtcccagatggcggcccaaactaccggcctactgctagtactgtgagaactggacgacagcctatacaggacaggacgcgtgcacgtcggagcacccacgccggcagcggagacacggtgaggttgatgccaaagatcgattggtcgttttttttttttctcttttgtaagggaacatgcgaaatgctctcacgtctttgtattaaggaacgtgacggttggtcgtcgttctctcgatgatgaattaagaacggatcgtgagctcgttcgggtttctattaattctatttggctgccacctaatgacgactgaatacttaatttagtcgtcctctctccatgtggaattgtggatgcggcttacctgcagcaacagcagcgacgagcgacctgctccatccaccgacggcagcagacaggcagtacacccagcattcagcgctgcgccgcgcatcgtccgatgcatgagccaggcaatggaataaaatccagagatctactaacgccgggattagtaccagtgatagtgtggttgaccgatcaatacgatccagtgggcgacctcgaatggatctgggtctgcctaaatatcaatcccaacttctgcaaattctacgggagatttgtgggcagcaggctgtgctctcttgggccgtgtttagattctaatcttttttttcaaactccaatttttccgtcatatcaaatgtttgtacatatgtatggagcatcaaataaaaacgaaaaaaactaatttcacagtccgactgtaaattgcgaaacgaatcttttgaatctaattacgctatgatttgacaatgtgatgctacagtaaacatttgctaataacggattaatta

SEQ ID NO: 51383 - DNA, 507 bp, Oryza sativa
tttggaatcctaattaacaatgtgtgactttgtttgcatgttatttgagagtacagattatagtgctattgttcgtagatattcctgtatcaaattaagtcttctacatgtataaagaaaggctaacaaacagtacaattgagaagttccctgtatttaccaatgattttgtttctccctttattaatttttcgttcttttccggccctggaatttgtgataggaaaggggtattattatgcagctaacttctggttctggaccatacaatttagggatgtagacaccgggcaacatatcctcacgttttgtattcaagggcgcacatgttttttttctaagcatatgtttatatatgctcctctgctacctagataatagtttatgcgtatggtttggaattcagcttatctttcgataagaatgtttgacgcctcgacccttgatccaaaggatacgaacatatttaattagtagttagtttagcaccgacccttaccgaatcca

SEQ ID NO: 51384 - DNA, 1393 bp, Oryza sativa
ttagagagaataaaaattcattgataaacaaacaatccaaaaaatagtattatcaacgaattgaagttccatataatatcatgaggtcaggtcaccgctagcttagcaatgctggtgttgtgtcgggattgtgatgcgctgttgcaagacgactccaccctttggatcatgcatgcaaccaatgctccagaccgtgcaaaatgttgttactcctagatttccttgcgctgggaagccgtacaagaacagcccggaaagattaggaacagtacaggaaggccgcaggggagaccaatcagctctgacctctgagcacgacagctgctgattcgtccgtttgtttgcggaaaatgccaagaccagattttgttgggtagccctaatcttttgttacagtatgtggttgttaacccgtacgtacggtactcggtacaacctacaacctgatattcaattaatcaatcaagcagtagcagctgctcagctctgtttgtgcaagttttataataggaatgactgctatctctaaatttaattatatcatctacatactccctccgtcctaatatataagaacctagcaccggatgggatattttctaatactacgaatctagacatgccaatgggacatttcctagtactacaaatctggacatgcgtagtactagaaaatgtcccatccgatcctaggttcttatatattgggacggagggagtattaattaagaggcaacgtatacaataatttacttccaacacataaaaatccaattatttttttattgcttcactctcacaccatctcactttgttttgaaagtttatgtaaagatggtcccttgcgtaagggggtgactcatcctatctctcctccgcctcatcatctaatcttatgttgcaacttttaggggtagtataagaatttcatttatcttgaacgaccaacgccagacgaaacgatgattcattgaatagagaagaaaaaattgcaaggctagcactctgtaaggcagtagtcgcgaaagaataaaaccaccacctcgcaccgacaacacatagaacccaagagaaggttggcaccggaccagtcaccactagatcaataaagtagctataaccgaatcgcccaaaaccaggaataattaactatttgccactaggcccacatatcatagattgctagtggcaaattcttaattgccacatcttaaaagtggtagaaagttaaatgccccgagaaggatggaaccgctcttccccacaaggcccgccaacatggttagcttgcattagctagtgtgtcatcataagaggacaaacgtatagagaaagcacaaacaagctatctaagagaagatttggcaagagggcctcctagacgacatctcca

SEQ ID NO: 51385 - DNA, 1501 bp, Oryza sativa
ctggggttaagaaagagcacatgtttattcacggccttcgaaacttcgccggatgttcatttttcatcacgtgctaccggactgagtatttcccacctggactttcaagtttgggcaagtttcacctatttttatgccatgttggtggctaaacttgtactgcccacacatatcatacactagtattcttcttccttctcgcatctatctgtagaagaacttccgtatcttcctgtttgcttatcagctgttgctaaattttgaacattgaaactttagaggtattttctagctccagcttttaaacactaaggacacatacatataagagttttattttgttactttgtccatttttctactcaacagatcaatgcgtgagacttaactcactatcttgcatgcataatccaaatgtttttttattaacacaattgtccatattagttcacattttctaaaaatatggcatcacattttttatttgatttcaattgcttccccttatgcgcttgctacctctatctctgtacataaaagaatgtttccatctctcgtaccttctctttctagtagacaatcattttttactagctcttttctatattgtgcagtaggaaattttattatatatgtatattacttcctccgtttcacaatgtaagtcattatagcatttcacacatttatattgatgttaatgaatctagatagatatatatgtctagattcattaacatcaatatgaatgtgaatatgaatgtgggaaattatagaatgacttacattgtgaaacggatggagtactttaaatgatatcatttaaaatattttttttatcgacatgtggttgtcccaaatactcctccattacgatatataaggattcctgggttatctaggaaatactaagtttacgtcaaaaagatttcttttaagtcactttgttaccttttgaattttgaattgcttatattatgatataaagtctgaatattaaaaaccttcatattttgagaaacagagagtgagtactagtcaaccgactttgccgacttgccacgaaaaaaaaagaacatgaggaagataagcactcgaggtcgaacccaagatactccagcgagaaatactcggaacaacggaacgaggcgaccccgagccagaccccgacccggcactgcaggcatcccaatatccaatccaatcagtgcctctcctctccttcccgtccgcatcacgccctcgtggagtcgtgggtctctctcgcgaccgcctcaccacgcgttatccctacgcgtccgtctcccccctttatttttatcgcgcccgccaccgaaaagacgaaaaaaatctcccaattccccaaccctaacgccgctctcgcctccaccccccaaatcccgaatccgccgcctcttcgttcgtcgtcgagctcgctcgctcgcccaaccctagcgcgccagatctacccgcccccgagcagccgccatggcggagaccc

SEQ ID NO: 51386 - DNA, 708 bp, Oryza sativa
ctgttttttttcttagtactccctccgtcctatattttaatattttgcttgcactatttaactattcatcttattttaaaaattttgaaattattatttttttacttactttattatccaaagtaatttaagcataactttttgttttttatatttacataatttttttaataagatgaatagtcaaaagtgtaagtaaaatgtcaaaatcccttatgttgtatacagagggagtaatagtcagtgttgactgctagtagtgttttaactttgatcattattatcaacatgtaattgatttacaatacttcctccgtttcacaatataagtgattctagcatttctcacattcatattaatgttaatctagattcattgacatcaatatgaatgtgagaaatgttataatgatttatattgtgaaacggagagagtagaatagatgaatatgatgtttgcatttttaccatacgacacattttaaaatacggcatatatttttataaacttattgctaaaaataaatagtcagcagaaaaaaaataaaacgtattgtctaataaagtattgtgaaacgaacagattaatagcatcttaatttacctttcactgcatctaatatgtcactttgaatgttgctactccgagctagctaggttcattatgctttgcactaaagcagcaaagcatgcaatgttagttctggc

SEQ ID NO: 51387 - DNA, 1501 bp, Oryza sativa
gttgcacatgatctatttatatgtttcagcaaatatttttttatgcttcaaaaattgcaggttaacgtttcaagaatgatataaaattttaacaaatcaatatttgcaaatatattgaatcttttttttatgtttcattagttgggacctaatgtttcatgtgacggtggttattgttgcatttagtaatttttataagttacatctctcagaaatatttttttagagtgggctgagttatccgtacaagtgataaaacaattttatggtgcaacaaaaggttgatttttctaaaacacatataaaatgttgcatggcattatttcgatgtttcaataaatatttttctgacgtttcactagtttatttgtgaatgttgcatgtggtattattggatgtttcggtaattcatttataaatgttgcacgtgttgattgggatgttgcagtgaatattttctaatgttttaataattataacttcttgtttcacgtatctctactattataaaaattgaagatgtttccgctgatactttgatacgtcgtccttatttgagttagtttttaagtttgttcgttttttggaaatacataagtagtcgtataagaaattcttttaaaaatctcgcatgctaacttgggacgagagtcggactcctaattgtttcaaaattctcaccagaccataataaagcatgtacaggatgtaaccaactaaccatcatcctaataaggattctgaattagatatctatactccaaaataaaaatcccatataccttttaaataaaaaaaatctaacaataatacgattaaaatagccttctcccattgcaacgcacgtgtattttttctattaatatataaatgtttcagttagtaatataatcatatttataaattttatcagaaatatagccaagtaagattttgttgtaaaaatttaattgtaaagaacacaatggtaaaatcggataagtaatttagaacgaaaaagtttaaagggtacagaaaataaagagagagattacatgtatacatgcatgagagtagggtataggcttgcagcgtagctgcttaactactatagttttttttatatatagtcagatatgtgggtgaacaacgtccgatttttttgctaaatatcgtacgttccatgtgtagcagcctcctctaccacctgcgcgctgggcccggggtatcggcgacacgggagaggataccccttctccggttcggccacggcttaccgaactcccaaacctacccctgctcgagcgagcgttattaccgggactgcctcgccaccgcccgggggcagtgacggggggcaaaagcgtccacgcagcccgtatttgaccaatccccccgtctcgtgtcggcgactctttccccctttcccctcgccttgcgtcccgcggccaccatcaccaccaccaccaccacccacctcctctcctcccggatccgagatccgatccggcggcgatggcgt

SEQ ID NO: 51388 - DNA, 1501 bp, Oryza sativa
tggtggggtgcgagggcagcgacgagatgctgcgggtgaaccactacccgccgtgcctcctcccgccgggccgcgaccgggacgagtgcggcgtgacgggcttcggggagcacacggacccacagatcatctccgtgctcaggtccaactgcaccgcgggcctccagatcctcctccgcggagactactcctcccctgcccgctgggtccccgtgccccccgaccccgattccttcttcgtcaacgtcggcgactccctccaagtacgtactacgctacccgagaatagagttcttaaaatctacaatagatctggtttaaataagaatcgaggctaaaaaaattttcggtttaaaaagcccaagatacttttcgatatttagttccatatttctttaccagtttacaacccgaaactataggggttacgaactgggagaagaggtatttttcagtagtattagggcttattcactttgctactatttttaaccttaccaagttttggtattaccaaattttgataagtttaccaaaattttgggaaggttaccaaattttagcaaaatttcatatgtacttattaaaatttggtaacaagctaaatgtagctatttttttataactttgtaaaaaaaagtaaggttgaaaatagtagcaaagtgaacaaacccttagttgaaattattattgctctatgccttgtttttactatcatttttattattaacgtatgtgtgtacgtgtaggtgttgacgaatgggaggttcaggagcgtgaagcacagggtgttggcgccggagggggaggagtcgaggctgtcggtgatctacttcggcgggccagcggcgtcgcagcggatcgcgccgctggagcaggtgatgcgggagggggagcagagcctgtacagggagttcacctggggggagtacaagaaggccgcctacaagacgcgcctcggcgacaaccgcctcggcccctacgagctgcagcacgccgctgccaacgatgaggccgcgacgaagaaataaatcgatcaacccgacgactgtgaacaactgtgaagtgttactgtactagtgtagttagctccgtggtactggtagctgtgaatatgatcgagatcgatcgatcgatcgatctatccttgtgttgtgttacttttaacccatttctggtaactaaaggccgccgttgccttggcttgcttggccagcccaaaactggcactggcgagctgcctcctcctgcatgcctctgctgtgcagtagtgcagcagtactcctctgtcctggggttttctgcagcagagcagtggagtgcagttcagtgcagcgttgtgcatgttgtgtaaaatagcttgccgcatgcatatgtgattatgtgctgctcctgtcgacgctgccgccccttttgtagcatggtttttaccggctgggcggtcggcaggtgcagtagtagctaatgatgcttactgcgccatacgagtgtacctatatgt

SEQ ID NO: 51389 - DNA, 1501 bp, Oryza sativa
ggcccccataactgaccggtttatttagaagtataccggctgaggaaacatgtaacatctgataagttgcccctaggaggtatcggccaagaggaattttttcctttctcaccagggcttcagcgaagtgaaggaagttcgcagtcggtgcacaagtagacccatagaaaacaaacctctcaagccatagggaaagaaaggcagcatgttcctcatccgaaactagaccagtcttccgatggtcgacgatgaagcctgaccaacaattgttcttcttctttgtgttcagttgataagagcatttaatgtccaagtcaaaaggattagtggacgaaaggatgtccaggcctgttagcatcttcacatcaagcaaagtgggagtcataggtccctgcctcaagataaaagcattcaatgtatcagaccaaaagcagccgacagcggaaagtaggggctcatccttttttatgtctgctatagataaagccaggcattgcgctattcctactttctcccaattagatcgcttagcagccaccatcctcttgtaccatgacttgtaccctttcaacttggacggccaagacctaaaggtcgatttccattgagctaagtctggtttggtctgcttgaaggggatcctctccgtttcagcgttgataaactcggtgggatccggatcacccatcggcccaaggaaaaagtatgtggaattccagaaggtgggaatcaaaagatgatccctggaatgctggcagaaggaaagaaggaatcggatcaccgaagatccaaagaagattgagggaattgctcaaagtaacatggagcttgcctcggggatctccgccacgtatgccatcgccataggtccgaacaaagttggcggggtggaggaattcgccgattgaggaacgatcaccaagagattagggattgctacagtgggggcttcacggggaataatgaccgaaagcggtaaaaaagggaagcagggcggcgtaagtaggatcccaagacggtgatcactatttaaaagggcgcggtaacggccgaaacggaaaagaaaccctagatgcgaatggaaacagaatcgagcaaatccgcaacatcgcaaatatcacagacttgggaggcatgtgttaacgaccaaaattggtaaatcataattggatccgaagtcagaaccaaagcggatttggaggaactccataatcacggaaacagaacccgcatcggctacgagttgcatcagctaccgtctgcattggctgataccaaaccagatagggagaagccgatacagccgatcccggcaaggcaatcatgagaccattatcgagatcggttcaagtgctacacaagtattggcaagtgtggattgagtctggagaaggtaattgtatctattaattaggatattttgatagtttccttatagatattttcggtaagagtccgcctaagggacttgttcgtatttttgagttgtaatagagataga

SEQ ID NO: 51390 - DNA, 1501 bp, Oryza sativa
gctgccttagtacctggacttgatgggcgtcaccttgctgcgagcttgggacaaaagaggacacaagagcgttgccgctcactgccctcgtccccaatgtgcgctcagaccggatctagcgataggatgacctaggcctctagatccagcattggcagctttgctcagccaccaccatgactgcccacaaatcagcttgttgcgctgacgccacacctccacaagaacaatactcttggcgaacgagagaaaggggagtgcgacagtggtgttggttggaggcgagggagaggagggaagtatcatcagcatcagctccgatggaggccttatcggctacgccgctatcaattcagtctgtaccacctgagctcgtcctcatctctagcagatggcgtcaggagatgagtggttgagggaggagtggcaacatgagataagactttattaattaactgacatccttatcctttacctcgaacggtatccagtgtgctagtttttctgatccgtttttacccaagacccactctattttttattctcccactgccttcctcctttttcccaacccctctccctcgttttccacgcacacgcttttcaaactgctaaacggcgcattttttgtaaaaagtttctatacgaaagttgtttaaaaaaatcaaattaatccatttttaaaaagaaaaatagctaatacttaattaatcacgcgctaatggaccgttccgttttccgtgcggaaggatccggtttggatccaggaatagcgaacacacccttaagtttatcccgtagctcgaacggtatccagtgtgctagtttttctgatccgtttttactcaaggagagcagctacacaacgggatcccgttgctacgggatactttaaatgactcctcccctttcctttcatctgtataggtgagattccatgtgtgctccccctgatacgtaccagaggcacgatacctatccggttccaactcggtatcacgcgcgcgatacctcgtcgccggtgtcgctcctctgcagccggaccagtatagcacaggctggtacctaatacctgatacctggtacacctagtacctgatacctagtatctggtacctggtacctgatacctgatacctgataccagtgtatggtacctgtggtacctggtacctgtaaaattatgggattcaagaggataggacaggggaattgatactatccatataagccggagaaaaaatcagcaaggaaatcatcaagaaaaaaaagaaaaacacacatgagtaagggatgcaaagcggctgtgaagcactgccgacatggggggcacctaatacctgatacctggtacacctagtacctgatacctagtatctggtacctggtacctgatacctgatacctgatacctgatacctgataccagtgtatggtacctgtggtacctggtacctgtaaaattatgggattcaagaggataggacaggggaattgatac

SEQ ID NO: 51391 - DNA, 1501 bp, Oryza sativa
gtaagtttgcattttgctttagtctgcatcttgtttatgtagcagaaacaagagctccgaggcaaagcaagagtgtgctgtagaagcttggcacaatgcagatgccttccctgtgcgttaacgctgccgccggcgccgggtttcctactctggcaccgtaaagccgtcctccctcttcctgctccgccggtggacgccatgactgttttgttgtcgtcatttttagccagctgcccggaaggcactaggacaggagacaggaggagttcctttgatatttgattgaacattggggcttcgatcctttgcagtatgcttggtgagattgaatttttagtttatcacttaattgcaggctgccaaaaacagattaactaagacttaactttgttgttggtactattctcccttacctgagtatgaactttagacccggtttagatcacaccctaaaatttttcaccctgtcacatcgaacgtttgaatacatatatgaagtattaaatataattttagaaaaaaaactaattacacagatggggactaatttgcgagacgaatcttttaagcctaattgctctatgatttgacaatgtggtgctactattagtgtctgaacaccccatgcaacaccctacacaatatccgatgtgacgccaaaactttactcccctagatctaaactctcccttagtttgttatggatgcttgtttcaggatgtcggcaggcacttctgttcagtgtccaaaatgcatatatacgattatcattaaggcagcgaaagtgtactgcgtcataattggaattctactactgcaagcatatagcattatggatttatgaagctgtgtccccgatacttctgagatgtcctgctaactgagcccgccccgagcttcacacgagactagagaatcggcaagtggcgatgccgtcggcgtttatggggtcgtgctacaacaaacaacaattattcatagtgacgaggtctagtgaaggtgtcaaatgctcatttgccgatgtcctagtgctcatatagtctgtaatctttctcgcggagtcagatgattttatttgtgtgcaatttttttttcatggatagattttgatgtttgagatgtaactacgtatggtgatggtagaatatctttttactgcgatttttagttggcatataggaataaattacttccttcgttttatatatatgttaatagatatatatgtatctagatttattaacatctatattaatgtggacaatactaaaaaatcttataaccttttctgacaaagctatcgagacattagagagagaataaaccaatgagtaaagaaattactagtggtgaaaaaaaggccacgggggattagagagagaaccggtgaagcaggaagtaatttttcggttttgttaaaatactgtcaccatatttttggcttgtttacagtagatctctagatgatttgatcttctctaagattcatgctgtggcaaat

SEQ ID NO: 51392 - DNA, 1501 bp, Oryza sativa
atcagtagtactcaatgatttaatgccatacctgtacacatttgtttctacttttcactcgttcaattaattagaagaagtgccaacctggatatggcgatccctgtattcttgatacaagtccttgagagcctgaacagcacttgaatcgatgtatgtaacagctgcatgttcagtatttgtttatcttaactagtctagtaaatctacttgatgctcatgagtttcttaattgaaagaaacatttttatgcaaacatgatatgacaaaaaaattaatgtgcctcatatcatgtaacataagaaaaagatcttacgggacatctcgaggatcacaaagtacactcttccgacatcaggtccacggtttgaatttgggagattaagctcatattcacgcaacctgataagggacacaatcaacaaaacatccatcaggacatcagggtaagaaaaaaaattgataacacaaactgttcatacagataaaaaaaatatccacctgtcttttatgtaacttatgttggcaaagtagataggtgcatcaattcgaacaacaactatcccgttgtaggtataagcctcagggtattgcaatctatttcggtacactgtggtgccaggtaagcggcccaatacggctgcacacagaccataaaatctagttaaatcaactgttatactctaatactatgcagcagctctggatatttctgttatcctatagagaacaaaaataacggcgacaaaacaatccatggcgagagaaaagatatgtcaaagcggactacaaatttcttcaagcacaacctccaaacagtacaagggattattgaactctcaatatggttgtcttgacttatttagactatcagattcctatcccacacaaaaatctacggcacaaagaatcacagcctccaatcatctactgtgacctaattacttctagttacttcctttggatgagtccctcttgcaagtcctcttaagacagagcaggaatcctcatcctatgaagctatatttatgaatcatcgtagaactcctttcatggtcctacttactaggactagaattacctttttgccctgcaataatatatcagaacctgatacctaaaagttaaaattcttgaacataacagttagaaatagcaagtctatccaaatccatgttgcagaggggtcaaatcaggtgcatgacagggaaatcaccagaggcatgcataaataatacataagctgtcattcaccatgaggattggattgcaaagtgcagtcctggtttccgtcccaagtcgacggcaatatatcctggtttaggcaaggtcgcagtagggcacaaagagcaatatgtatggacgtagagcacatgagggggtcaggaagagaggagaagcatgcatacacatgctcctgcacccatggcatggcggcttcaaaatctttggataagattatttggttatgtattgattagttactttcctgatgtgacca

SEQ ID NO: 51393 - DNA, 1501 bp, Oryza sativa
agttgcctttgtcacaagttgatttacttgctgttccttgtgataaagaagagttgtgtgataatgtttcacttatatccatgccacaactagtgaatgaacatgttagttctactatttctttgtgtgctgattctaagcatgttgttcacattgctaatgaagtagaggaacgcgaattgctatcttctttaaatactttgggctattttcagtttgatgattttggtgagctcgataatttgaaggagaaattatttgctaaatctgatttgccatgtccaactaatgctatttttcatatctttggcgaatataatgatagaggaatatttttggtgcatagagtttacatttgttcagatttagaacatcttgtagttccggataaaatatgcaagctagagagacatgttactgctaatcatattgtctcgagtttgtcttgttttgattgcaagaaacaggttgttttcagtggactgcgcgaagagcaccatatggaaaaaccgaggacggttttctgtgaagaaggggaggatgatgtgaccatggctactatggatacgaccattgctcacatcatgaatcaacaagaagacatcaagatcaagtccttcatgtgctgcaatctgattcggccacgtgttacattgctgacttcaaacggccgccaaatctacatacgtgctccgttttgggcccgtgagtacttgatggaaagctctcgaagtcctccttccaacggatccagcctcatctcggaaatctatctcgtttggccgcaatcacaaaagcaaggtgctgcgtctcctgtattgggccaatgggcttgtaactttgtttgggaccctggcccatgtggggcccatgtggggtgcgccccaatctggtggagcacgacccttggaccctcttggtcgtcctcccacctctataagtagttaggtaccccttcagggtttctggggttttgtttagatgaaagtttagccattgctacttcgcttgcagcgcgcgtgtcggctagaccgtccgtctgcttgtattcgaaaccccaacttatcatttgtattaaattcctatttgcaatatcagattgcttttatcttgttcttgcttgtttcttcgatttgcttgcaggaatagggttgatctgcaccggcaagatcaacaacccatggagaggtgtatcgatcgctaaggcgcaacacaacgtctcgtacggttgtagtcggatcgtcaacgtttctcccaaatcgtagttatcacaactcaccgaaagatcgggccaacaatagccttgagtgtcgagaggaactcaaggttcatcatttcctttaggggattgtttctgtcctttatctttttagatccattgttaagaagcccttttttgagaagagaggttatcctgttgaaagcaagaacaattaacagaaggatagtccaatccctctgccttatgtaaagaggggtaccatctacccacaggtaaagg

SEQ ID NO: 51394 - DNA, 1501 bp, Oryza sativa
cacacaatattctgactaacaaccacacacacaaatgaactctgtgtgaaggacccgagaagaacatgcaacaccatcaccaaagaagaatagcaagttactaactactatctcctgcagagaagactgtgacaaacaacaacaaatcagtttgtagcatggcctatagtactattctgtgaattgtacaaaagtactacaagttgtggtaaaaatcttaaaaataaaaatgtataggtacatatgtatgtatgtgctcgcgagaacttttacggtgtttgcattccaaaaaaggtaaaaatccaacgctcctcaataataggtaccatgtgaaaagtatttaagtattagtataggtacttagatatcaagggtaaaaacataaatatacttgttgagagaaatggtagaattgtccctaaatttatcggtaccgcataggtaccggttaagtgatttgcttggtactagctgttctcatttgcatgattttctatagatttatgttgtgttctttgagattctcatctgcatgattttctttatatttacatacgttttgttccgaagaaaacgttattggtgtaaaagttttcatttgtgttcccttgtctagatttacgttatgttctcaagaacatgtcaaaatccctccgtttaattcttttgagatttatatcttttttactagaagagatttgtattgtgtttcaaaaacatgaccggttaaaatatcaccgaagatttgcgtcgatttaaattatataatattttatcaatttatccctataaaacatgaaacttcttccttgactacataaacaactaattaactgcgtaaataagtcatggatatctctaaaggtagctagagaagaaaggaaatgtgatctttgattttttttctctctctccgatacagattgaatcaatcgctaaattaacagggtagccatgatttacgttttcatttactcatctcctatcatgttacaataattttattccgtacctgacccctccgttgatccacctttaagtacctctaagtacctcgcaaacaccgtaaaagatctctaggaattattgtgtagagtattttaaatcacatacaagtgtgtcacatcatcacgtactaggaattattttatagagtatcttaaatttcatgtaaacatgatatatcatttataattttgttgtatttttagaatttaatatgcgagcaatgtgaaattatcatctccatatcattatcacattatttaaacatatatatctatcttttatattatataaaatatgcattcatccacatatcctcagcaaaacgcggaatatcaaaactagtatagtatgcatttcaaccttgttcgacgatcgctcaggtttcgatgtcatcgctggagaacatgagcacggtcccagactgcggtgtgccagacatcaccacctcctacttgaggtcatccaagagcaccatcgacctcttcacggcagc

SEQ ID NO: 51395 - DNA, 325 bp, Oryza sativa
ttcacggagagcatcgtcgccaacttcatcattaatattttttatatagacattcgacccctaaaaaaagagagatgcatttttagatgaaaaaaacagattgtagagggcaaatggaacttacattgctcttggtgattatttcatttctcttctcctcgtgtaagcgttgcaaatattgtttcctttcagctttcttttgagctcttgctacatacaaggtttttgatcctaataaaacaattcacaaacaattgtatatcaaattgaatagaataataaggtttcactacttaatgaattttcactatttaattattttaat

SEQ ID NO: 51396 - DNA, 847 bp, Oryza sativa
ccccctcccctcctccccctccccctccccctcccgcatcacagccattcgccacttcaccaccaccaccgccataatccgtctcgccccgatccagccggctcgtcaccgacgcgacgccgccgcggccccccagatcccgtcgtgcgcgcgcgcgatctgctctcggtgagcgcccacttctcttcgtctccgtcgtttttttttccctaggtcggtgtcgggggatcgccccgcccggccgggttggactcgtggatcctctcgtctgaaatttgttctggcgccttgagggggggatagatctggctggcccgtgcggttgtgcgttgtgatctggtgtggcgcggggttctcgtgcgtgcgcattccgcgtttgcggcggggagagggatctatctgtctacctttctggtgcaggggaggcggtgagtggtgccgatcaccgttgttttgtggttcgttcgttcgttctacttggttgtggatcatggtgagcattgccgttagttagtacatatcacaatcacaattgtttaacgtgaagaatttgattatttggtaaattgaaggctagatcatgaagccgaggtgctgtttggtactacgagagagacttcgcacacacacactctctctctctctctcagggatccatgtttatgtcgctccttttctcaaataaatcgatactagatcagttgcggtttttgttttttcttcattttccatgggtgttaactagatctgctttttataattttaactctgtcttggggtgccttttatgacgtcacatgtgaggatactcttctgatgccattttgtacacatcagcaggcgaaga

SEQ ID NO: 51397 - DNA, 1501 bp, Oryza sativa
tactagaaagagaaggtacgagagatggaaacattcttttatgtacagagatagaggtagcaagcgcataaggggaagcaattgaaatcaaataaaaaatgtgatgccatatttttagaaaatgtgaactaatatggacaattgtgttaataaaaaaacatttggattatgcatgcaagatagtgagttaagtctcacgcattgatctgttgagtagaaaaatggacaaagtaacaaaataaaactcttatatgtatgtgtccttagtgtttaaaagctggagctagaaaatacctctaaagtttcaatgttcaaaatttagcaacagctgataagcaaacaggaagatacggaagttcttctacagatagatgcgagaaggaagaagaatactagtgtatgatatgtgtgggcagtacaagtttagccaccaacatggcataaaaataggtgaaacttgcccaaacttgaaagtccaggtgggaaatactcagtccggtagcacgtgatgaaaaatgaacatccggcgaagtttcgaaggccgtgaataaacatgtgctctttcttaaccccagttgccactagatggtcataattaatctcagagagaaccttggaggttggggccgtacatagcacaagttcagtcttttgcatgaaacaccttgtgggagaactggagaagacagtggaagatacttttctcaagcagacaccaaaactataatttctcccatgtataaaaggagatccgatcgtttcgatgctagaaagagagagagaaaaaaaaactcccgtctactgctccacatggccgtgtttgggatccaagttggcgtgcatgtgctcccaccaaggcaccagccaggctccaccaagcctgccttattcttggatcgattcactgattcactcattaatctatcttcattgtctgagtgcgtgcgtacagtctgttcatgcacgcgtctgatttttggtagagatagtaaccgccactgaactgccattagcaagagacgcatggagttttggacacagaaaacaacggcagtaaactatacaagttctggttttatatttattctgcgagtttgatttgatcgcaacaatgtttgcttacaactgcaattgtgttgctgttcatgatgataacgattgtatccgagcaaaaatttgtcttttcggtcaaatgccaagacagcttcgatccaaccagcctcacattccatgcaacaaaaccttccaagagtggactcagggcctgtttggttggtgacctgacacacatgcctgatgaaaactcatgcctgaagctagcctgaaagtttaaagacatttgcctgaccaggcagcctgtgagatgagttgtttggtttgaaccatgtgcctgagaagaataatgcaacgtcaaactgtaataattactcttaacagataatattaactcaacaaacatgatcaatcggtgggaagaatgaaaaaagcaagaaaaagaaaa

SEQ ID NO: 51398 - DNA, 1501 bp, Oryza sativa
taaaacattagaaaatattcactgcaacatcccaatcaacacgtgcaacatttataaatgaattaccgaaacatccaataataccacatgcaacattcacaaataaactagtgaaacgtcagaaaaatatttattgaaacatcgaaataatgccatgcaacattttatatgtgttttagaaaaatcaaccttttgttgcaccataaaattgttttatcacttgtacggataactcagcccactctaaaaaaatatttctgagagatgtaacttataaaaattactaaatgcaacaataaccaccgtcacatgaaacattaggtcccaactaatgaaacataaaaaaaagattcaatatatttgcaaatattgatttgttaaaattttatatcattcttgaaacgttaacctgcaatttttgaagcataaaaaaatatttgctgaaacatataaatagatcatgtgcaacaataactatataaaaattattggctacaataataaccaccattacatgaaacattaggtcctacatttgaaaacataaaaatatatataatgcaacatatttgcaaatactttattttgttaaaattttatatcactcttgaagcgtcaagttgtattttttgaaacacaaaatatatttattaaagcatataaaaagaccacatgcaacattacatctgaattagtgaaacatgagtaaatacttattgaaacattggaataacattatgtgataaaaatcatcggaatattgtcatgtgagatcttgttataaagagttaattgtaacaaatccaatagtataattagttcataattccgataaatagtttaagagaaaagatcatttaaattttaaatccatgtgacttgcatgtacttgtcatttaaattggatgcatacacttgtcatgcacctgcactactactactccattggttgcatgcatttttcctccttcctcggaagtatgatgataagcattttcgggagagttccagagtttgctggtggtggtgggggaaaacgtacgaaacaatcggggatgaatgaatgggtgattgattcggttggcgcgtcgtagcgagcgagcgcgagaggcgcgggtggccaccggacgcggcgttgtttcggggcgacgcacaggtgggtgggtggatggcctccgagcaccgcgcggcccgcaaaacactcccatccaacgggggcggacgctcctcttcctcatcttctctcgcacatcacaaagaggctgagacgtctcaccatttacgagttcctttttttcgtgaaccaaatcacacctcgcctgcagtgtctcgtgtcccagaacgcgattgcgttttttttttgcacgtttggtttccatatccctcgtctcttgtactcccttacccacatttggcctagccggaggcggtagccagggcccagggctgcttcttatggccgcgcaggagatggaggttatgatggttgcgatggcggcgg

SEQ ID NO: 51399 - DNA, 431 bp, Oryza sativa
aagtcatgctagtattgcccacatttatatagatgttatgtgtgtctagattcattaacatcaatattaatatgaaaaatgctaaaatgacttacattgtgaaacgaaaggagtagtaagcaactattgtatgaattagctattacattggttatagatgatttggagctagtaattggctatactattaaacttgctctaatgggagggcggttcacagttagcccagttccggaagaccagcggatgcggaatttactggagaatcgcctctcgctcgtaatcccataaagcacggcctttttgtcatttaacttccccgcaaataaaaaatattggattgaacttttaaagagatgatatgcactaacctaggatatgttaggcacgtagctcaatcatggccttcgtttcttctggctgaattcagg

SEQ ID NO: 51400 - DNA, 1501 bp, Oryza sativa
tatgaatgggccaagaactcagaattgacacgatgaattgggtcaaaattcacaagtctacaaagtgaagcaatagaggaggccgccagccgaagatgggccaggaaggcccagcccatggttcggtcgaacccatcctggcaccgttggatgcagggttcggcgtggacgtccaagattgcatcccaatgatggttggagggcacttcggacaattccccttccacaaccgtcataaccacctctatataaggacttcactctcttcacttcaacacacacctcaagcaatagctctctcatttctctcaagtttagtttagtaatatctagctagtggaataggaatagagtagaaatcatgagtccggaagccttcggaagagttcggatatagctctagtaggttttctcttctcttttgtaagctttgtacttttattagaatactcttctaaatacatttatggtattgaaatactttccaagtatatgagtacctactttacattatgttcatgttatactgaatatatggctagcttatctgggatatgctttggtgtgggtataatgtttgcttatgcaattactctatgtcatgacgatgatattagagtagtatctggtagtttagacgtggtgtctagattacgggatatcattatttggggttatatattgcggatgagaggtgggccgctgatggtgacagctcagtacgggtattgctccgcgccagtatataatccgaagttaattcgatggggagggtattcctccgtatttagacccggttatatggtcatgacgggttgtcgtaaggaacttggcagtcaggggtggcttctcgaagtaccaggagggcatcggatagagggtattagctagtatatcagttaactagaatgtatggatactatgtatattagaagtataggaatagatttttttttctctttcctttccacttagctcagataatatattatgagaatgagtagtaatgcttgtgtgtcactctacccttggattatcttaacccatgcttagaatttgattatcacaagtaatatataaattattagttgagttctctctacatgatcttcccacgggataaaataaatacgatacacttggaataccctcgggtaaaattctacaatggtatatccatgcgcttgtggatgaactctgtaaccataatataccaggagtttttctgcgccattgctgggaattatatttctagtaatgttgttaagaaatgccaacaagcatttctggcgccgttgccggggaagattcataatagagattacttgaactaatactttatatttacctctgtataatcattttactttttgcaggctaaccttggttgttttcactgtttgctgtggaaacagggtagtgcatgactggtttcatcctgccggaaaacttcaaagaaaatccagaagctttcttccggatcgtcatgccgcgagtcgtt

SEQ ID NO: 51401 - DNA, 1501 bp, Oryza sativa
tcagggttgcagcacccggatcatccatttcgatatcaagcctcacaacgtccttcttgatgaagacttatgtcctaaaattgcagattttggattggcaaaactttgccacctcaaggatagtgccatctcaatggctgaagcaagaggtaccatcggtttcattgcaccagaagtattttcaagaggcttcggagttgtgtcaactaagtcagatgtttacagttatggaatgatgctgttagagatggtagaaggaaggaaaaatgttaaaacaaatactgataattctagtgcatatttccccaactggatttatgatcatttagcgaaagatttgcaaagccatgaagtcacatgcgagaatgaagagattgcgaggaagatcacactagttggcctgtggtgcatacaaactgcccccaggaaatcgtccttcaatgagtaaggtcatagaaatgctggagaagaacatcaacgaattggagatgcccccgaagccgatcctttcatgtcatgcagcgccatcgtatttttcatcttattcttaactaagaattttcttttgggatgattcattctatatatgttccgccactcagctaaagtaaatgaatggaagtatgtttttgttaagccattaaatttattacttatcgcaacaactaaactcacccccaaaagctcaacagcctgtttggcaaagttgccccaaaagcttaacaacctgttcggcaaagttgttttagcagaggtgcacaattcagttcgatagatagataggtgtcctcatcaagaattaatcacatacctggggtcatctgcagccagcccagtctggaagtttgttgcagaagcacaccaccttcatccgccccttcttgtcacgcgaggagacggcggttgtcctgcttccctcacagcccctacctgcaacagcacgacactatcggtattggtctcatcagcgaggtcgatctgagccaacgccgctgaaatccgatgccctgattccctagacgacggcagcagtgtcgcgctgaagagacggaggcggcggatggataaaataaaacctaccggccggcggccgccgtcttgatgcaacaatataccctcaagagcgtgtaaaccaagcaagaggtgagacgagagccaccaaaacctcgagggagttcgccgacgggagaggccgcccgcggcggcggcggcggcgatgcatgaatcagccgccatccatcgagggggtttttaactatttgccactcttacgaagcggtactcttgacatcgccactcttccaaatttacagaaataccacaggagagaatgaatttttacaaattaccaattttatctaagggaagggccatgtcagctttaccagcactaaaggggacttcaaatgactcttttgcccctgatttgaccattgtagcagttgactatacaccaaatatttgagaaattatatatagacgtatctaagaaaaatacggt

SEQ ID NO: 51402 - DNA, 1501 bp, Oryza sativa
tgaaaaataaagtcaggtgcatcgactagatgcacctaataggtgtagccctcgactgtgtggttaattgaacaaacaaagcatatagtcaaggaataaataatccaaccaaccgagtggcttcgataattatagtcaaccaagcgactcgatattaatatgtagcatatgcggtgtgaatccctgaataacatgatccgagtgatataccgactgctttgtaaaatatgataagtgtaacctaaagttggctacatcattgaaaattcacatagcaaaacagctataaagaagcttgtatgttgtgaataaagaaatttccaaagtattgggcatacgccatgcgcacactactttaacagatgtgcttaagtccctaaaagacacatggtttcaccacacctgaaaatatatggcatatgtggtataaaatccgagtaaataaactcataaaggatttaacaaccgcctggaaaatgaccaaaatatataatcagcctaagccataatattggtcaataaaagtgcacacttacgtggcaaaaagcaatgatattgtatcgaatcaattgctttacgaacccaaacaacgccttgacttatataaaaaagtcagcgaacagctatataaagcattactgtttggcaccttttaaaatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctgaaaatatgagctgcagacatattaggcctaagccaaaaaaaaatatgctttcgacaccctttaaaggatgacgcatgtaacatgctcccgagtgataaatcttccgggtgatatagaccaagtacagctcatatgaatagcttctgatctgagtgattatcccttatgggatactcccaaatagatatagtaattgaatcccgactggcgcaagtattcggttgataaccctgacggggaataataaatagtccagtctttgagcatagaaaataaactcatgatcataaattcatgttgcatgtatccggaataagtccaaattgaaggtatgatacttgtgtttgagctagtaaacccctgagcatatagtttgtccttctatcgtagtcacaattgtccattgaaggtagctgacgcagttagcatagagacaagacgaccaatatagagataatattgcccaccagaggtggcaaaaatattggtggtagtgaagatagtgataccaatcaaaagtgatgaagttgcacagccgtggaggcgaagaaaccagtcgacaacagtcaggtcagccagcaatgaataggaaggcgcccagtgataaagtgacatgatgaagatgacgatgtcggcgatccagtcaatagtagtgtcgcaaccaatgataatgacgaagacgctcatcagcatttgcatagtaggtc

SEQ ID NO: 51403 - DNA, 198 bp, Oryza sativa
gaggacgacggtggcaacgaggccggcgacccgggcgcatttgaatgagcccccaggcccccgccaatcttaacttttttcttgttctttcttctaaggccttcatgcctcttttttgtacaatttaacttaatctgcaatgagaaatgatgaaaaaaattttgtattagttttattttgctatatatgagatgagga

SEQ ID NO: 51404 - DNA, 180 bp, Oryza sativa
cccgtcaaggtgtgagtttctaagcactcgtccccagctggagctagcgtgttacatccagagatggcacgttaactccgatcgatatataccaggcttcatcctaaccattacaggcaaggtgttacacaaggaagggcaaacatgcatgttgttaaactgacgcgtggtggacaagaa

SEQ ID NO: 51405 - DNA, 312 bp, Oryza sativa
accaagttcaccagcaactaggcctgtctctctagggtttcgatgccatgcttctctccttccctttcccctcgtgtgcagtgtgctaggtggcagtagttgcaaacttgtgcctgctttgtaaattgtgcttgatcataatgggcagcttggatttgaagtaatagacgtgtcgagtgttatttattgtcggtggctgattcgcatcttgtgtttttcttttctctttgcgattgcgatttggggatctagggtttgaggagatgatgctgcgaggtgggcggctgggtggcttggcctctcggatggttg

SEQ ID NO: 51406 - DNA, 1501 bp, Oryza sativa
aaacatggtcttttggaatatttgttagatattgatcatttaggtattactagtaacatatccttgcactataatgggtctggtcatataaaatagggatggattgtaataagattaaggataaaacattggatctggtgaatacctatgtatgctaaccgtgcgagcacagtgggagaagggggtggaaagaggacaactccaattttaaagcagtagagattagttagaatattttattctacatccatcactgcttgtgccacatgacagtatccagtgattatgttgatagatcttgaatatcaaagtagcatgctagctagacattttctcgaaccgaagattgatctaacttcatttaactttttgtcacctttaagatgtggcaattaagtatttgcctcaaagtctttgacatgtgggtcctcatgtgcctataacatgtggacccagtgataaatccttaattatcacttataagagtggcaaatagttaattattcccccaaacatacacataggtctgcacataccgttgttactttggaagtatggccgtgtctagttgtttggcctaaattttttttacgtatacgaacacacatttgaaatattaaacgtagattaataacaaaacaaataatagatttcacatgtaaactgcgagacgaatctattaagcctaattaatccgtcattagcaaatgtttattgtagcactacattgtcaaatcattgcgtaattacgctcaaaagattcgtctcgcaattttacatgtaagctgtgcaattggtttttttttctcgtccacatttaatgttctatgtatatgtctaaatatttgatgtgatggaatttttagaagtttgaagggaactaaatacagcatatatgttttttttttctcccgaaaaagaaaaaacaacaacatagaattgactgcgcacgagtccacggcccaagacctacccgctcccggccctctgaccgtcagtccgtcaccaacccatgggccccacctgcttgccgcctccaggcctcgcaccctaaaaaaaataaaaataaaataaaataaggactaaaaacccggcccgctcccacgctgtgtcacacccacctgccacctcgccgcgacgaccccctcgccgccggccgccaccgcgcgtcaactgccggcgatgccgcccccttccctcctgctcctccatccacgcacgccgctgccgcaccaccaccgctcctccttccggacgagctctccgcggccatccaggatggtctgcgccgctgccgaggggtttatctccgcggcgccgatcctcctccccgacggcccgtggaagcaggtgggtaactggtttccggtgaagccgcgggggcgttgggctgtgggtttttttttttcagtatgctgaatctggtggctggttgctgatcgggtgcgggttcaggtggaaggcggcgtcacggcggcgaaggggttcaaggcggcgggta

SEQ ID NO: 51407 - DNA, 1501 bp, Oryza sativa
tgtagttgtttgtaaagagtctaatcagcggagagatcagttctgcagtcaacttgtccttttcatttagttgtccagttaagtgcctcatctaatttagttgtttgtatcagtggattttttttatccccttagtatctgaagtagatcagagataacatcacaaatgaggcccactcaatctacgagggtaagtgttatcatgaatcacgataaaccactctaggcttcaagtaattaagctagaaatgtgtgtgtggtgtgcatgtaccttcaattccaattgaaaaccaggtagaaagtactatatacagattttcagaactcttctcagataaagaagaatcaaaactaacatcagaaaggtaaattgcgggtcataggcaagataggggatgagcagagcaaatacccgtccatccatttccttaacagctttctctccgtctgcttgagaagaatatttaacaaaaccaaatccttttggccttccagtttggttctcttaccaatcgagctacgcttgataaggtagataaagcagagtgaaacttgaatgccaattaagagcaacaacaaagatttaaattgcctgtgctgaaaagcatgtgactactgagtactgactagtaccttcctcaacagcgccaaatggtgagaagacatttttaagttcttcctctgttgtgtaaaatgatagccctacaaaatcccaaaatgagtgaatggatgtttaagctgtatgagcaagcaacatcaaaacatgatagaacgagtggacaatccactaagaacataacttgcatggctttagcgtgcacaaatagcagaatatctacagacaacttatgtgttctactcatggtccatgtgaacaggtgagcatctcacaggctcagcagattagggacttctaagtactctatcaccaagagaataaatcagcatctgtcaaactctatgagctctacaacaacagctagctagtatgtatctaggctgtaattctctaacccgctagaaagcatcctctgatcgatccttcattgcaatcaaaaggaatcatattctgaaagcaccaagcctcaacaacttaaggcatgccatagctatcatattcagaaaaaaagaagggctaaaggacacaccatttagtgctcatttcatccaccacaccccccagaatcacaccagatcaagaaaccccattcactcatgaagttctgacgcacagatcatcacaagcggacctgtgaagcagcaggacatcacatcacaggctcacacagatccaaacattttgcaaaccacaagattattacgtaggcggcgaaaatttaattacatggagatgaacttactgctcacaaatatctccgtgctgaaaggcttggctccaaccatccgagaggccaagccacccagccgcccacctcgcagcatcatctcctcaaaccctagatccccaaatcgcaatcgcaaagagaaaagaaaaacacaa

SEQ ID NO: 51408 - DNA, 1501 bp, Oryza sativa
ttaattgttgtgatatagtgtgtctctctcctcacactataccacaactatcgcgtatagagctcccacctccatatagacttacgcgacctccccttcttatttcaagtaggttgtgttctataggaaaggacgaagagtagtttttcatgcgcaatttcgccttgtgtttttttaaaaaaatttctatatggaagttgtaaaaaacttattgatatattgtttcagttcacaatcctcacaaataatgcagtaagcacttattaaagcagtttataatttcaatccaatttctagcaaaaggatcattgattttatacttatcacgagaagttcactgaaattacattcttaggagaagcagcgtatacacacggataaaacacggagaaaatctttacgagagatggttggtgtttgggaggcaagaacggccggcggcggggcggccattacgcggatgggagcaccttcttgacgatctcgtcgctgagggaggcgatctgggcgtcgagcgccttgacggcctcctccttctgcgcctcgaggttggcgagcgcctccacgagctcggcctcgacgcggcggcgcccctcgtccagcttcgcctccagctcctgggtggtctccttcttcatcttgttgagcgccgcggcgatctcggcgcgtgccgccttcagcacggcggcggcctgctcctccagctgccgcacctcctcggacgcgtccttgacgccgccgagctcggcacggatcttggcgtcgcgctcgtccatgaacttgcccagcggcgtgaagtagagcttgtccagcgccaccatcagcagcaggaactcggtcgcgatcagcgggagcgtcaggttgaagtcgaacagcgccgccttctccatctgctccgccagcgccggtagcggcgccgcggccacggccacggccgccgtcgccacgagccccggcagctgcttcaatcccctccgcggttgctgctgctgctgccgcctgggcggctgcacggacgacgacgcgacgaccggcgcgcggcgaggggagcacgaggtggcggtcgcagccatcatagccgtcgccatgggctagtgcaaggagtgcgcggcgcggaggaggtaagcagcagcagcggcggcggcggcggcgactcgaggtgtggtgagctgagagagagaggaggaagcgggctatctaatccgaacgggttgggtggtgagattccgaagcaaccaaggccacacgacgccgctgctccatcgccgccactaaaaaacctctcctcgatatatcacgccaatttgggccgtacaaaactagttgggcccattagcccatccaaattttaggcccctacaaaagcacaacgggccgtagcctgtttagtactactacaatcccgagcgttcactccccctcccgcatccaacggctctggagaaattctacgtcatcgatccgcctcccacccatgtcgaccaatggggttccaccacgc

SEQ ID NO: 51409 - DNA, 1501 bp, Oryza sativa
gcccaaagggagcaaaggcatttttaagcttctcatccgtcgttaaccttgaaaggcctgtgttgcatcacattaggcatatgtgagcatgcaaacaaaaacagcatgacataaaaaataaagtctaattcaaatacataaatgtagtattagtacatgcaacaacaaatatagaaacgtaatagaattcgacagtacaggatatgatgtcttcctcaagaatgccgacaagactcagctgtattattagtcagtgggttcagttgttcatgtaagcatatacgggcaaagatattgacaaagagcagaatagagcatgagattaagaagcatactcagagacagatctgtagaaagcaaacacactagtttgctctgatttagcataaaacatgataacatcgcagcacagtacacacagccatcccaaattataccgagaaatcgggctccccaaatcatcttcataacaaatatatccatcttatgcagaaaaatgtgatgtgaaacaaagggaggggagagttaccgctgatgaagagcttgggggcggtcagcggcggcacgttgctgacctcggcgccgtcgccgaagacggaggaaaggggcgactcggtgggcaagggggcggacgaggaggaggagcagaaggtggcgcggagtattgaggaggcggcggcggaggaggaagagacgggggtagagccgcggaggaggcggtggagcagcgaggaggagagcgccatggccgccggctaaaaccctacctccgccttggctctggtgcggtgctgcggatatccccggtccgaccgatctgctgggttcgggttcgacctgaccaggtccgcatagcagagtgggctggagttacgcggttacacgccatccggtccaaaatatggcgcataggagagaacaactcgtttccagcggatagatcatcgagccatccagatcattggagaaacttctgaagcaaaagcccagcatgttgggacaaggtagcagtagagtatcgctattgaaaactaaaatagatgttacatatcctttatcgttttatgacagtgcttgtcagtcgcagatatagatattccagccttgccggcttatgtttgagcgtattggcgcaacttatgcgcacttatagcttgaagaaagtaaatttggtgcaattatcccaacttatgttcatttgatagcttgaagaaagtaaatttgctgcaattgaaattaattgttgtgatatagtgtgtctctctcctcacactataccacaactatcgcgtatagagctcccacctccatatagacttacgcgacctccccttcttatttcaagtaggttgtgttctataggaaaggacgaagagtagtttttcatgcgcaatttcgccttgtgtttttttaaaaaaatttctatatggaagttgtaaaaaacttattgatatattgtttcagttcacaatcctcacaaataatgcagtaagcacttatt

SEQ ID NO: 51410 - DNA, 1501 bp, Oryza sativa
ggaaatgttaacaaatggtcttccctgaaaaggtagaaacccacggaacaatggatcggatttagcttaagccaaaacataaatttaatgatttggattgtggtttgaacaaaggatcatgacttatatttggtttgttgttatggaaccacaggcataagcagacccttcatgcagcatttttcgcattcctggaattccttgatcatttttgttccttccagttccttctttttaaaaatattggagtactaccatagatagcctcattttggaagtgtttctattgccatgccaaaaattaagttgcacaattgttagttgccgaactgcagcctgcaggtggtaacgaatcaggctttttatgtttttttttcggactacttgaagtgataaaggcatttgctctcagccattgcatgtctctctgcagggttatttttcgcttcttctaagtctaattgaggcgcatttaaaggcctggaatgtccgtcttcttacggcacctgttgatcctgaaatggcaccaatctggtctgagaaacttgggtacactattttgtcagatgaacaggtaatacaacccttccttgtatttgtgcattacctgtggttgctgaaaacattagcttgtactagccaacaacagtaatctctccaacaacagtactgacattgcactattgatgctgtgcttgttgacagaagcattctatgctgatggcacatcccttggtgatgtttgcgaacctaagcttggtgcagaaatcacttgcttgagaagaccgattacgcggtttttaggataaaatgttacctttggagagcaacaggacagtttttgtagcctgccatctttttaatggatggttcgaggctcaagatgtatagagaagagagtagaggcatctcagtagatttttttagcaagtagtaatcggcaaaagaaatactaaaaaaaagagtagtttttgtgattaacgtcgagtgaatgattcgaagctgaagtacctaagaatagaagcgtctctgacattatatactctgctgagagggttgcgtgtgtgatgtacatcatttgccacacatgttctcagttccttactttcttaatgtcaattaggcatattaatatcctgtcacacttgtacccgtatcccgtatctgtatggtatgcataccatctcagggcagaagatttgtcgctgattgctgagttcctttttactgcagttttataagccgtgacatatcagatcaacgaaaaataattttagagctggaaatacttctgttgttagtattcttaggactgaacttttatacttttattcttcgctgtttagaagtcgaatctgaaaaatagaaaacaataaaagaacacctaaactaatttgaaattaacgagaaataatgttaggggtggacttttaaacttatattcttaggactggacttttatacttagactcttaacggtttagaagccaaagctaaaaaa

SEQ ID NO: 51411 - DNA, 1501 bp, Oryza sativa
accctactcctgtgtttttgtggatttgtgtatgaatgagctacaaagtgtgagccaactccccccccccgttctaagctctaaatctggaaaagaatccacccaaccccctctctatgggcaaggtcctccttttatacttcaaggggataccacatgcacccctcccctttccaaactggacttttcttctctttatggacggagattggtatggttgctgtccgaatgacactccgatgggacagcccacacctacctccactcccggcgacgacaggcgcaacgtgggatcgtggctgcccgttgctgacgcgaccagtgccagaccggtcattcttgtccaccacgcgtcagtttaacaacatgcatgtttgcccttccttgtgtaacaccttgcctgtaatggttaggatgaagcctggtatatatcgatcggagttaacgtgccatctctgggatgtaacacgctagctccagctggggacgagtgcttagaaactcacaccttgacgggatggggtaaggcgtgcgtcagaccgccagtcgccacctaacccgtgatctgaccggtctgtgactggtcacagaccggataaaggaacgcgccgtactgcgctgcatgcagtgtgacacgcttgaccagactgcaataaatgctgttaggtgagcacagctgtgctcacttatcccatatatgtggcgcagacttccttaagggggtcggggtgcctcggccctcggggccggggcaaacgcaacccgaccccccctcgggggaaatcaggaggagggcggacacctcaccctcgggcccgacgtccccgaaggtgccaggccacgtgggcgattgtgtctgcctcaagcctctagtcatgatactcccggtcccatatcaccgacagtagcccccggcgttatgccagagcaatttcccttcccaagggaagcggtcaggtgtgacgccaccctgtgacaggtgggaccggtctccgtagttgggcaaaataccgaacggtctcaatccatgcacattggtattggtaactttggttgtccataatgggcggtctattcaagactgccacaccacttgagcagcgcgcgaatctggatgagcagattcgtctcgcccggagatatggtaacgccgcttcggtcggcgagcgtaattaacgcgcgcacgatacaatccatttcgattgccacaaccgcatatccactcaatgcgccgtaagcgggcgaatgggattagtggaagcgtgggcacgggaaacgagggagcgagatagcgagatacgagggagcgaggtagtgggcgcgagaaacgaggagtcaggcccagcgatggcaagggtataaaagcatcgagaaaaggatttgcttccttcctttcgccattgttcctcttgccttcgccacctgagctctaactctttctctgctacgccctactttcgccacacgcgctcgttctcaatcatctcttcctccgccgcca

SEQ ID NO: 51412 - DNA, 1501 bp, Oryza sativa
ggttgcgcgtttttacaaccaagtcatcgacatacgcctcaacattacgtcctatttggctacccaaagaaattcgagtagtacgctgaaaagtaggacctgcattctttaatccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaacccggcctccaaaagtttagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcggctttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaaggatgttgagagccgctcctccatctatgaggacacgtcccaacttcacgttgcagatggtgggggaaaccaccatcgcagcctgccctccccgggcaatgcacggtgggtggtcggtctggtcgaaagtgagggcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcgatgtcaacagcgggggccttctgcttggcctcacttcgccgtttgccggaaggaaccgccgg

SEQ ID NO: 51413 - DNA, 1501 bp, Oryza sativa
gcgttccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggccgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgaggaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagaggaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacgaatctgctcatccagattcgcgcgctgctcaagtggtgtggcagtcttgaatagaccgcccattatggacaaccaaagttaccaataccaatgtgcatggattgagaccgttcggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtct

SEQ ID NO: 51414 - DNA, 1501 bp, Oryza sativa
atggatatgcataggagaatatcttctttggtactcctcatttttttttcattaattagtttaaaaatcctgaatatatatataaatatgcactaacaatcaacttactgttttcaacctatctttttcattatttcagacatatatgcataatgcattgctcttctttcaatatggccaggacttccttatgcaaccatcctggtctttcagcggcatggtttcacactagtataagaattgaggaaacaaacggtattgactgttctgctgaatgaatttcgtgcaggacttatccagagtagctagcttaatttaattattttccgcaacttgcagatataagtatgtcgtttcagagtatttattcatgcagtcgatcactgctaaattatttcctaaatttccatatatataactacggtatctccattaattattgttatcatgctgttcagatgaaaggagaaaattaaaaaaagactaattcagatgattatacagtagtgtggatgcgttcgttaggaggataaagggagaagaaatccatctttcactcggatgcttcacgaactaaacatccgagtactaaacatgtgtgttttttttttacatttctataagaaagttgtttaatcttctcatttctcttttctcaaacacaccctaaattaaaaaatagggaaacatatttttactcccttcaactattccttgcttcacttagcattctaaaatatttttggtcattttgtagagccattaatgagaatataacctgtgctatacaatagttccaagatatatctttcatgaaagtttagtatgcagaaactgaatacgaaatccagagaaaaaaaagttgaggcacaagttgcaatgcatcaaaattctcacttagttaaaaagtacttatatacaaggaaacaaaaccaaattaaatactattctattatagaaaaaagtgaacctttttaagtaactaaactaaaaatgacaaaaaaataaaccgaaaaatagtttaagatgttaattaaatggaatactttaataaagtagaagagaatttatcgtaaaaaacaaaactatattgtcaggataagcacagtgagattgaactgcacaagcacaacgactctaaaacaaagggtttaatttgtcatttgttttcttgtggtgcaacatgacaacaatggctatcggccggtaaagcggtcccatcaacgttgattaccagtctgtggatattatgggtaccccatacccatacggcatggttatccgactagtcataggggataacttatatctatgtaatatgtaacagatcatgacttgggtgttacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggtatga

SEQ ID NO: 51415 - DNA, 1501 bp, Oryza sativa; identical to SEQ ID NO: 51413

SEQ ID NO: 51416 - DNA, 1501 bp, Oryza sativa
ctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgtttgccccggccccgagggccgaggcaccccgacccccttaaggaagtctgcgccacatatatgggataagtgagcacagctgtgctcacctaacagcatttattgcagtctggtcaagcgtgtcacactgcatgcagcgcagtacggcgcgttcctttatccggtctgtgaccagtcacagaccggtcagatcacgggttaggtggcgactggcggtctgacgcacgccttaccccatcccgtcaaggtgtgagtttctaagcactcgtccccagctggagctagcgtgttacatcccagagatggcacgttaactccgatcgatatataccaggcttcatcctaaccattacaggcaaggtgttacacaaggaagggcaaacatgcatgttgttaaactgacgcgtggtggacaagaatgaccggtctggcactggtcgcgtcagcaacgggcagccacgatcccacgttgcgcctgtcgtcgccgggagtggaggtaggtgtgggctgtcccatcggagtgtcattcggacagcaaccataccaatctccgtccataaagagaagaaaagtccagtttggaaaggggaggggtgcatgtggtatccccttgaagtataaaaggaggaccttgcccatagagagggggttgggtggattcttttccagatttagagcttagaacggggggggggagttggctcacactttgtagctcattcatacacaaatccacaaaaacacaggagtagggtattacgcatggcagcggcccgaacctgtatacatcgccgtgtctcgtgtgtcttgcgggcagacgatctttccagatacagagggagagcgagagcttgagatctcaccctaagcccccggccgaactggcaaaggggggcctgcgcggtctcccggtgaggagccacgagctccgtcagagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacacggtttcaccacacctggaaatatatggcatatgtggtgtaaaatccgagtaaataaactcataaaggatttaccaaccgcctagaaaatgaccacaatatataatcagcctaagccataatattggtcaataaaaatgcacacttacgtggcaaaaagcaatgatattgtatccaatcaattgcttaaaaacccaaacagcaccttg

SEQ ID NO: 51417 - DNA, 560 bp, Oryza sativa
ggaaatatttgaactgtttagtccataatgaactctgttatttatctggtgtaatctagtttgcatatttgcacaaaggcaaacctattctttggcttaagaagagagatgctgtgcacctaacttggaaatgttaacaaatggtcttccctgaaaaggtagaaacccacggaacaatggatcggatttagcttaagccaaaacataaatttaatgatttggattgtggtttgaacaaaggatcatgacttatatttggtttgttgttatggaaccacaggcataagcagacccttcatgcagcatttttcgcattcctggaattccttgatcatttttgttccttccagttccttctttttaaaaatattggagtactaccatagatagcctcattttggaagtgtttctattgccatgccaaaaattaagttgcacaattgttagttgccgaactgcagcctgcaggtggtaacgaatcaggctttttatgtttttttttcggactacttgaagtgataaaggcatttgctctcagccattgcatgtctctctgcagg

SEQ ID NO: 51418 - DNA, 757 bp, Oryza sativa
acctgcttcaggaccttgaagatgtagatcttgtaggtctcgacgctcttcttcgccttcttcctccccttcttgtcgccggcgccgccctccttggacgacgccttcgacgccggcagccgcttctccgccttgggcttcttccccgccggcgccttctccgccgacttctcctcgccggctgcgggcttcttctccgccggcttcttctctgccttgggcgccatcggagctgcctctcgagggatcggctcaaatggagagagagagagagagagagagagagagagagagagagaggcgggattcgtgaggaggaggaagaccttttcccttcgcgtggagttgaggcaaaaggggaagaaggcctcaattatatataggcgcgtggtggaaccccattggtcgacatgggtgggaggcggatcgatgacgtagaatttctccagagccgttggatgcgggagggggagtgaacgctcgggattgtagtagtactaaacaggctacggcccgttgtgcttttgtaggggcctaaaatttggatgggctaatgggcccaactagttttgtacggcccaaattggcgtgatatatcgaggagaggttttttagtggcggcgatggagcagcggcgtcgtgtggccttggttgcttcggaatctcaccacccaacccgttcggattagatagcccgcttcctcctctctctctcagctcaccacacctcgagtcgccgccgccgccgccgctgctg
